United States Patent 12,642,819 (COMPOSITIONS AND METHODS FOR TREATING INFLAMMATORY BOWEL DISEASE) - sequence listing, part 56

SEQ ID NO: 24 - DNA, 2443872 bp, Bifidobacterium longum (residues 1-1,221,936 of 2,443,872)
  modified_base (101572)..(101670): a, c, t, g, unknown or other
  modified_base (967348)..(967447): a, c, t, g, unknown or other
  modified_base (1466136)..(1466234): a, c, t, g, unknown or other
  modified_base (2133522)..(2133620): a, c, t, g, unknown or other
  modified_base (2431890)..(2431988): a, c, t, g, unknown or other
aactgttagaattacaggaccaacaagggtgttgcacttctaaatagacatcggggaaagatgtgagacctgcattgcgacaatcgaacagacgccgagcggctatgccgcgaggtaatacgaacggcatgagcgcgacacgcgcgaactccactgtcccacctcaatgcttgaataaacaagttgcctgatttgggctcgcaaattggaattaaaaaagcgagcgcgggccgggagccacttcaagtgaagtgacagccggaaaccgcgcactgatgtcggatgaccgccagaggacgtatgtccaagggaggccatgcgcgccggtgccctagaagcaggttggtaaacagtacaacgaacatcgctagaaagggcggacggcaatggcgggacagaaaatccgcatcaggcttaagtcctatgaccacgaggtcatcgaccaatcggcgaagaagatcgtcgaaacggtgacgaacgcgggcgcaactgttgttggccccgttccgctgccgaccgagaagaacgtcttctgtgttatccgttctcctcacaagtacaaggattctcgcgagcacttcgagatgcgcactcacaagcgcctcatcgacatcgtggacccgacccccaaggccgtggactccctgatgcacatcgatctgcctgcggacgtcaacatcgaaatcaagctgtaagggaggaggaagcattatgtctaatcgcaaggctctgctgggcaagaagctcggcatgtcccaggtgtgggacgagaacggcttcttcgtgcccgtcactcttgtcgacgtgtccaccaacgtggtgaccgctgtgaagaccgaggaatctgacggctacaaggctgtccagctcggctacggcgccatcgatcccaccaaggtgaccaagccgctggctggccactttgccaaggccggtgtcaccccgcgtcgccacctcgtcgaggtgcgcaccgacgacgtcgatcagttcgaggccggccaggaactggccgctgacctgttcgaagagggtgctgaggtcgacgtgaccggcaccaccaagggtaagggcttcgccggtaccatcaagcgttggggcttcaagtcctaccgccgtactcacggttctcacaagaacgagcgccgtcccggttctgtgggcgcatgcgccactccgagccgtattctcaagggcaagcgtatggccggccgcatgggtcatgtgaccgccactacccagaacctgaccgtcgtctccgctgatgtcgagaacggcatcctcgccatcaagggcgccattcctggccccaagggcggcatcgttctcgtccgctcggctgtgaagggagcctgataaaccatggcaaacgttactctgaacgtcaccgacgccaagggccaggccaccggcaccgttgaagctcctgaggctctcttcggcgtttccgccgaggatgtccaggctcacatcccgctgatccaccaggttgtcaccgctcagctcgctgctgctcgtcagggcacccacgccaccaagactcgtggcatggtttccggcggcggcaagaagccgtggaagcagaagggcaccggtcgtgctcgtcagggctccatccgtgcaccgcagtggtaccacggcggcaccgtgttcggcccgcagccgcgtgactactctcagcgcacccccaagaagatgaaggccgcagctctgcgctacgccctgtccgatcgcgccaacgccggtcgcgttgccgtggtggagttcggtatcaccgagccgtccaccaaggccgctgtcgccgctctggccccgattaccgcggacaagttcaccacggtcgtcttcactcgcgacaacatcaacgagtggctctccgtgcgcaacatcccgaccgttcacccgattttcgtcgatcagctcaacacgtacgacgtgattacctcgcagtacgtggtcttcaccaaggaagccttcgaggctttcgtggctgccaagaccgagccgaaggaggcctgatttagatggtcgctattcacaagcccgctcacgacgtgattcttaagcccgtcgtctccgagaagagctacgccgcttccgaccgtggccagtacaccttcgtggtggctccggatgcgaacaaggtgcagatcaagcaggcaatcgaagagatcttcaaggtcaaggtgacgaacgtcaacaccctcaaccgcgctggcaagaagcagcgcactcgcaccggtttcggccagcgcgcttcccagaagcgtgcgatcgtgaccgtcgccgagggccagacgatcgacatctttggtaactgaaggttagccgagaaaagttaaaggaagaactacattatggctatccgcgtttataagccgacgaccgcaggccgccgcaacgcgtccgtctcggatttctccgagctgactcgttctacgcctgagaagtcgctggttcgcaagaagtccaagaccggcggtcgtaactcttacggccgtatcacctcccgtcatcgcggcggcggccacaagcgtcagtaccgtctcatcgatttcaagcgttgggacaaggacggcgtgcccgccaaggttgccgagatcgagtacgatccgaaccgctccgcccgtatcgccctcctgcacttcgcagatggcgagaagcgctacatcatcgcgccgaagggcatcaagcagggcgacgtcatcgagaccggtgctcaggctgatatcaagccgggcaacaacctgccgctgaagaacatcccgaccggtaccgtggttcatgccatcgagctccgcccgctgggcggcgctaagatcgctcgttccgctggtgctgccgttcagctcgtcgccaaggatggcgcctacgctcagctgcgtatgccgtccggcgaaatccgcaacgtcgacgcgcgctgccgcgctaccgtcggcgaggtcggcaacgaggaccacgccaacattcagctcggcaaggctggccgcgcccgctggatcggccgccgtccgatcacccgtggtgagtccatgaacccggtcgaccacccgcacggcggtcgtacccgcggtggtaagccgccggtctccccgtggggcaagggcgaggttcgtactcgtcgtccgaagaaggcttcgaacaagatgattgttcgtcgccgtccgtccggcaagaaccgcaagtaagggagtatcgagaagatgactcgtagcatcaagaagggccccttcgtcgacgcccacttgcagaagaaagtcgacgagcagaacgagaagggcaccaagaacgtcatcaagacgtggtcccgtcgttcgatgatcacccctgatttcatcggacacaccttcgccgttcatgatggtcgcaagcatgtcccggtgttcgtcaccgaggccatggttggtcacaagctgggtgagttcgcccccacgaagaccttcaagggtcacgtgaaggacgacaagaaggcccgtcgctaaggataaggaatagaacatggaagctaaagcaatcgctcgtcacgtccgcgtgacgccgcgcaaggctcgccgcatggtcgacctcatccgcggcaagaaggcgaccgaagccgtcaccattttgaagttcgcccctcaggctgcggccctgccggtccgcaagaccctggagagcgccatcgccaacgctcgtgtgaaggccgacaaggccggcgagccgttccgcgagaacgacctgtacatcaaggagacctacgttgacgaaggtgtgaccctcaagcgcttccgcgctcgtgcccagggccgcgctgctcgcatcaacaagcgcacctcccacatcacggtcgtcgtggctaacaaggaaggagcccgctaaagatgggtcagaagatcaatccgtttggctaccgtctgggcatcactgagaaccaccgctccaagtggttctccgactccaacaaggccggcgaacgctaccgcgacttcgtgcttgaggatgatcagatccgcaaggagatgagcaaggacctcgagcgcgctggcgtgtcccgcatcgtcatcgagcgcacccgcgaccgcgttcgcgtcgacattcacaccgcccgtccgggcatcgtgatcggtcgtcgtggcgccgaggctgaacgcgtccgcgccaagctcgagaagctgaccggcaagcaggtccagctcaacatcttcgaagtcaagaacgccgcgctggacgcccagctcgtcgctcagggcatcgctgagcagctgaccaaccgcgtcaccttccgtcgtgccatgcgtaaggcccagcaggacgccatgcgcgccggtgccaagggtatccgcatcaagctctccggccgcctcggcggtgcggaaatgagccgttccgagttctaccgtgagggccgcgttccgctgcagaccctccgcgccctcatcgattacggcttcttcgaggccaagaccacgtacggccgtatcggcgtcaaggtctggatctacaagggcgacatgaccgaatccgagttcgaagagcagcaggctcagcagaacaaccgtccgggccgtcgtggtggcgatcgccgcccgcgccgtggcaaccgttccgccgccccgcaggccgccgaagcccccaaggctgaggctcccgccgaggccgctccggctgcagaaacgaaggagtgagcaagaatgcttatccccaagaggactaagtaccgcaagcagcaccgccctgtgcgttctggcatgtccaagggcggcaacgagatcaacttcggtgatttcgccatccagtccctcgccccggcctacgtgaccaaccgtcagatcgaagccgcgcgtatcgccatgacccgctacatcaagcgtggtggccgcgtgtggatcacgatcttcccggatcgtccgctgaccaagcacccgctcggtgcccgaatgggttccggtaagggtgccccggagttctggattgcgaacgtgcgccctggtcgcgtgatgttcgaaatcggtggtgtgtccgaggacatcgctaaggaagccctccgccgcgctatcgacaagctcccgatgaagtgccgcattatcgcacgtgaaggtggtgatatctgatggcagtcggtaccgctgattactccatcaagaatctcaacgagaagaccaacgcggaaatcgaaggcttcttgaagaagtccaaggaagagctgttcaacctgcgcttccagcacgccaccggtcagctcgagaacaccgcccgtctcaaggctgtcaagagcgacatcgcccgcatgtacaccgtgcttcgcgagcgtgagcttggcatcagccaggagccggccgctaccgaatccaaggagaagtgattatggctgaagagcgtaacttccgtaaggttcgccgcggctacgtcgtgtccgacaagatggacaagacgattaccgtcgagctcgagcagcgttcgacccacccgctgtacggcaaggtcgttcgttccaccagcaaggtcaaggcccatgatgaacacaacgacgcccacattggcgacctcgtgagtattatggaaactcggcctctgagcaagaccaagcgctggcgtctcgaatccattatcgagcgcgccaagtaagtaaagttcggcaaggctcgccatttaccggggcattatgggcaaccacgatgccccggtaaatggggagaaccagctcggctaaggagaatcaatgattcagcaggaaacgcggcttcatgtcgccgacaacacgggtgcgaaggaactcctcgccatccgcgtgctcggcggatcgaagcgacgctatgccggcatcggcgacgtgatcgtcgcctccgtcaaggacgccattcctggcgggtcggtcaagaagggcgacgtggttaaggccgttgtcgtccgtaccgtcaaggaatcccgccgtgcggatggttcctacatcaagttcgacgagaacgccgccgtcattctcggctccggccgtgaaccgaagggcactcgtatcttcggaccggtcggtcgtgaactgcgcgagcacaagttcatgaagatcgtgtccctcgccccggaggtgatctgacatggcagccaagatcaagagcggcgacctggtcaaggtcatccgcggcaaggaccgcggcaaggaaggcaccgtcaagcaggtgctctccaacgatcgactaatcgtcgaaggcgtgcagatcgtcaagaagcacgtgcgtgcaacgcagcagggccagcaggctggcatcgtctccactgaggctccgatccatcgctccaacgtgatggtcatcgacccggagaccaagcagccgacccgcgttggcatcaccgttaaggaagaggcgcgtgacggcaaggtgaagaccgtgcgcgtgcgcgtcgccaagaagtccggaaaggagctggcatgaccgatactactgtcgaagcgccggccaccccgcgcttgaaggtcaagtacaacgagcagatcattcctgagctcgagaaggagttcaagtactccaacccgatgcaggttgctcgtgtccagaaggtcgtcgtctccatgggtgttggtgccgctgcccgcgactccaagctcatcgaaggtgccgtcaaggacctcaccctgatcaccggccagaagccgaagatcaccaaggccaagaagtccgtcgcgcagttccacctgcgtgaaggccaggccatcggtgcgtacgtcaccctgcgtggcgaccgcatgtgggagttcctggaccgtctgctgaccctcgcgctgccccgtatccgcgacttccgcggcatcaacggccaccagttcgatggccagggcaactacaactttggtctcaccgagcagtccatgttccacgagatcgatcctgattcgatcgatcacgtgcgcggtatggacatcactgtggtgacctccaccaaggacgacaaggaagcttacgcgctgctgaagcacctcggcttccccttcaaggagaactgatatggcaaaaaccgctcttaagaacaaggcggccggcaagccgaagttcaaggtccgcgcttacacgcgctgccaggtctgcggtcgtccccactccgtctaccgcaagttcggcctgtgccgcatctgccttcgtgagaaggctcaccgcggtgaactgcccggcgttacgaagtccagttggtaaacatcgacgctgaaggtccgcggcccgaacgcttctagaagaagcgtgagggcggcggaaaccatagcgagaaagggcaacaagcccaaatgacaatgacagatccgatcgcagacatgcttacgcgtctgcgtaatgcgagcgcggccaagcacgaaaccgtggatatgccgtactccaagttcaaggcgaacatcgccgagatcctgaagcgtgaaggctacatcaaggacttcaccgctaaggaagccaaggtcggccagactcttgaggtcaccctcaagtacggtccgaacggtgagcgttccattcagggtatcaagcgcatctccaagccgggccttcgtcgttacgcgaagtccgactccctgccgatgccgctcggtggcctgggtatcgccatcatctcgacttcttcgggactgctgactcagaaggaatgcctcgaccgaggcattggcggcgaaattgtcgccttcgtgtggtgagaaaggagagctgaaacatggcatcgcatattggtaagctccccatcgccatccctgctggcgttgaagtcaagattgaaggccagaacttctccgccaagggcgctaagggttctgactcctacgtggttccggaaggcatcaccgctgccgttgaaggcaacgagattgtcctgaccgctgctgatgacctgcgtccgacccgtgccaagcacggtctggctcgttccatcatggccggcatggtcaagggtgttcacgatggctactccaagactcttgagatcgtcggcaccggttaccgcgccgtcgccaagggccagggcatcgagttcttcctcggctactcccacaccatcaccgtcaacccgcccgaaggcatcaccctgaaggtgaccgacgccaaccacgtggttgtcgaaggcaccgacaagcaggtcgtgggccaggttgccgccaacatccgcaagctgcgcgctccggaaccctacaagggcaagggcatcaagtactccgatgaacgcatcctgcgcaaggctggaaaggctggtaagtgatatgagcgttgctattctcggaaaaggcaagaaggtagctctcaagcgccgtcacgcgcgtatccgcaagcgcatctccggtacccccgagcgtccgcgcctggtggtcacccgctccaaccgtcacatggttgctcaggtggtcgacgataccaagggcattaccctggtgtccgcctccactcttcaggccgacttcgccggcttcgaaggcaccaagactgaggccgccaagaaggtcggcgagctgatcgccgagaaggccaaggctgccggcatcaccgcagtcgtgttcgaccgcggtggcaacaagtacaccggtcgcgtcgcagccgttgctgatggcgcccgcgagggaggtcttgcactgtgagcgacaacgaaacgaaggaaacccaagtggctgaagaaactcagaacactgtggcgaccgaatccaacaacgaggaccgcaagggtcgtcgtggccagcgcggtgaaggccgtcgtggcgagcgtcgtaaccgtcgtgaagaaaaccacggcgacgagctgctcgatcgcgtggtgaccatcaaccgtgtgtccaagacccacaagggtggccgtaccttcagcttcgccgcactggttgtggtcggcgacggcaacggcaccgtgggtgtcggctacggcaagtcccgtgaagtcccggccgccatcgccaagggccagctggacgccaagaagcacatgttctctgtgcctcgcgtccgcggcaccatcacccacccggttcagggtcacgacgctgctggcaccgtcctgctgcgtccggccgccccgggtaccggtgtaatcgccggtggctccgtgcgcgccgtcatggaatgcgcaggcatcaccgacgtcctgaccaagtcgatgggctccgccaccgccgttaacgtggtgcgcgctaccgtcgacgccctcaagcagctcgaagagcccgaggagatcgccgcccgtcgtggcctggcgctcgacgaggtcgctcccgatgctctgctgcgcgcccgcgccgccggcattgccgaggctcgcaaggctcgcgaagaggctgctgccgctaaggccgccgaagagaaggatggtgagtgatactcatggctaagaacctgaagattaccctgcaccacggcatcgtgaaccgtaccccggctcagcgcgccaccgtcaagaccctcggcctcaacaagatcggtaagaccgttgtccgcgaggacaccccggccaaccgtggtctggtgaacgccgtgcgtcacctggtcaccgttgaggaggttgactgattatggcagataacgaaatcctgcagatgcacgacctgaagcccgccccgggtgccaagaaggaccgcacccgtgtgggccgcggtgaaggctccaagggtaagacctccggtcgtggcgccaagggccagacgaagcgcaaccacgtgcgtccgggctttgaaggcggccagctgccgctgtacatgcgcctgccgaagctccgtggcttcaagaacccgttcaaggtcgagttccaggtcatcaacatcgctcgtctcgtggagctcttccccgagggcggcgaggttgctgtggccgacctgatcgccaagggcgctgttcgtgacaacgctccggtgaaggttctgggcgacggcgagaccaccgtggctttcaccctcaagggtgttaaggcttcggcttccgccaagtccaagatcgaggccgccggcggttccgtttccgaggactgattagtcctacggggagcgcaataggctgtacaacccccgcccgccaataggtggacgggggttcccttttctaaaaaattgttgttctgagtgcagagaagcagtctcaacacaatgatcgttttgagtatgcttccccccgttcagtacgacggagcataattcaggtaacattcgcgagacatgaagtggccgaagtaggcactttagactatgctcgtttgttagtttgtgtatttcgcgcgattggcgcgctattgggaggaaatctaggtgaggacactaatccaggccctgaaaaccaaagagttgaggaagaagattctcttcgtcctgttcatcatcatcgtctaccgcatcggttcgttcattccgacccctggcgtggactacaacgtggtgaacaagtgcatggccaccatcggcagcgcctcccaggagaacttcatcggactggtgaacctcttctcgggtggcgccatgctccagctgtctatcttcgcgctgggcgtcatgccgtacatcaccgcgtccatcgtggtgcagctgctgcgcgtggtcatcccccgcttcgaggccctgcacaaggagggccagtccggcgaggccaagctcacccagtacacccgttacctgaccatcggcctggccgtgctccagtccaccaccatcctggtcaccgcccgctccggcgccctgttcaactaccagtgcgaccaggtcatcccggacggctccgtgttcaacctcgtggtcatggtcctcatcatgaccggcggcaccggcctgatcatgtggatggccgagctcgtgaccgacaagggcatcggccagggcatgtccatcttgatcttcatgtccatctgctccggcttcctgccgcagctgtgggagatcggctacggcaccaacggcaccgacggcgactggctcaagttcggcatcgtcgtgggcgtgctcgtggtcatcctcatcttcgtcgacttcgtcgaactgtgccagcgccgcgtcccggtccagtacacgcgccgcatgatcggccgtaagatgtacggcggctcctccacctacctgccgctgaagatcaacatgtccggcgtcatcccgccgatcttcgcctcctcgatcctcgccatcccgaccctgatcgcccagttcggcaagtccgaccagtcgtgggtcaagtggatcaacgccaacctggcgaacaccacctccgtgtggtacatcgcgctgtacgcgctgatgattgtgttcttctgcttcttctacacctcgatcacgttcaacccggacgagaccgcggacaacatgaagcagtacggcggcttcatccccggcatccgcgccggcaacgccaccagccgctacctgacctacgtgattaaccgactcaacaccgtcggcgccgtctacctgctgttcgtggccctgatcccgaccgtgctgatcatggccctcggcctcaacgccaagctgccgttcggtggtaccacgatcctgattatcgcgggcgtgggcctcgacaccctgcgccaggccaaggcccagaccgaacagttccagtacaccggcttcctgttcgaaaacgcggaccacaaagagggctgacgcccgcttggcagcggtcgcccgcaatgggcaggcggccgcgcgaggagtggaacagtccagtggactgttccacgacggagcaatctttcttccgcatataactcaatggctcccttaaccaagggagccaaaaccgtattaataaccgacataaaaggagaccaccatgcgtctgctcatcatgggcccccagggcgtgggcaagggcacccaggctgctctgctcgccgaacacttcaacatccccaccatctccaccggcgacatcttccgctacaacatcaagaacaagaccgaactcggccttgaggcgatgagctacaccgacaagggcgagctggttccggactccctgaccaacaagattgtcaaggatcgtctggccaaggaagactgcaagaacggctggatcctcgacggctacccgcgtaacgccgcccaggtcaccgctctcgacgagatgctcgccgacctcgacactccgctcgaccacgtggtggccctcgaagccgcccgcgacgtgctgctggagcgtatgaagaagcgcgccgccgagcagggccgcgctgacgacactccggaggccatcgccaagcgcctggagacctatgagaaggaaaccgctccgctgctcgacatctacgaggcccgtggcctgctcgtcgtggtcaacggcgtcggcgacatcgacgagatcagcggccgtatcatcagccacctcgagtagtaggttcggcagcccgggcaacaagccggagtgatgccgaaataccacatcaacgtttccatacccctgtgcgacacgccgagtgttcgtacaggggtatgtgcgtatatagtttacagttggtgtgtcttcggatatgccatagtaatcatccaacggaataggactagaggcacatggcaaaagacggtgtgattgaagtcgaaggacaggtcgtggaagcactgcctaacgcgatgttccgcgttgaactcgaaaacaagcacatcgtgctcgccacgatttccggcaaaatgcgtaagaactacattcgtattctgccgcaggatcgtgtcgtgctcgaaatgagcccttacgacctgaaccgcggacgcattacgtaccgttacaagtaaaggtacacaagaaaaggataaccatgaaggtcagccctagcgtgaagaggatctgcgaaaactgccgcgtgatccgccgtcacggccgcgtcatggtgatctgcgtcaacccgcgccacaagcagcgtcagggctgagagcagattctccagcggcactaagtaaataaggcactctctcacagtgcttcccgcaagggaacgacactgaaccacgggtacgtaggcccgtgccgggtaaccgggcgagcgggtgcaagacctacggcaacaagaaggaatcgcaatggcacgtcttgccggagtcgacatccccaatgagaagcgcatcgagatcgccctcacctacattttcggtgtgggtcgcactcgtgccaaggaaacgcttgccgcgaccggtattagtccggacatccgcgtcaaggatctcaccgacgagcagctgattacgctgcgtgactacctcgaagccaactacaagatcgagggtgacctgcgtcgtgaagtcgatgcagatattcgtcgcaagattcagatcaactgctaccaaggccagcgtcaccgtaagggacttcctgtgcgcggccagcgcaccaagaccaatgctcgtacccgcaagggcccgaagcgcacggtcgccggaaagaagaaggccaccaagtagtcggtggcatgattcgggccacgggatgattttcatcccatcgcccgaacgtcaacaacaaagttcgttactaggaaacgagggtcaatggcagcgcctaagcaagccgctcgtaagccccgtcgtcgcgaccgcaagtcggtcccggtcggccaggctcacatcaagtccactttcaataacacgatcatttcgatcaccgatccgtccggcgccgtggtgtcctgggcgtccggtggcgatgtcggcttcaagggctcccgtaagtccacgccgtacgccgctggtatggctgccgagtccgccgcccgcaaggcgatggaacacggcgtcaagaaggtcgacgtgttcgtcaagggcccgggttccggtcgtgaaaccgccatccgttccctgcagtctgcgggcctcgaggttggttccatcaccgacgtcaccccgcaagcccacaacggcgttcgtcctccgaagcgtcgtcgcgtctgagcactcagcaataccaaatccatccaaaaccgcctgaccggtgagtgcaccaccgagttcaagctgaaaggataaccacagtgcttattgcacagcgtccgactcttaccgaggaatctctgaatccgcagcgctcccgcttcaccatcgagccgctcgagcctggcttcggctacacgctcggcaactcgctgcgtcgcacgctgctgagctccatcccgggtgctgccgtgacctccgtgcgtatttccggtgccctgcatgagttcaccactctgccaggtgtccaggaagacgtcaccgagatcctgctgaacatcaagggcatcgtgctcaccagcgaatacgacgagcctgtggtcatgtatctgcgcaagagcggcaagggcgaagccgtggctggggacatcaccccgccggccggcgtcaccattgccaacccggagcagcacatcgctaccctcgccgacgatggcgaactcgagatcgagttcactgtcgagcgtggccgtggctatgttcctgcccagatgaacaagcaggacaacgatgagatcggccgtattccggttgattccatctactccccggtactcaaggtgagctacaaggtcgaggccacccgtgtggaacagcgcacggacttcgacaagctcatcctggacgtggagaccaagcccgccatctccccgcgtgacgcggtggcttccgccggttccaccttggtggagctcttcggcctgtgccgtgagctcaacgcccaggctgaaggcgtcgaggtcggtccggccccggtggccgaggagaccaaccccgagatggccgttccgattgaggacctcaacctgacgcagcgttcttacaactgcctcaagcgcgagggcatccacaccatcggtgagcttgtctcccacaccgagcaggacctgctcgacatccgcaatttcggtatgaagtcaatcgatgaggtcaaggagaagctgcagaccttgggcctgagcctcaagtcctcgccgatggccttcgataccaataatctcgaaggtggcacgttcttctcgccggaagacgagtgatctgcctctttgaccaatcgttcgttcactaggcaagcggatgttcgggcatatgcccacctgcttgcctgaagaacggacatataaggagtaaacccaatgcctacacctaagaagggcccgcgtctggcttccagccccgcacacgagcgcctcatgctggcaaacatggcgaccagcctgttccagaacggccgcatcaccaccacgctgccgaaggccaagcgccttcgtccgctggcagagcgcctgatcaccttcgccaagcgtggtgatctgcactcccgccgtcgcgtgatgcgcgtcatccgcaacaagtccgtggtgcacatcctgttcacccagattgccgagcagatggagcagcgtgaaggtggctacacccgtatcgtcaagatcgctccgcgcgttggcgatgccgctccggccgctgtgatcgagctcgtcaccgagccggttgccaagaaggctgttgtgaaggaagctgaagccgccgccaaggttgccgaagaagaagctccggccgttgaggctgaggccactgaggctgctgaggctgttgaggctgttgaggctccggtcgaggagaccgccgccgctgaggctgaggctcccgctgaggaagccgctgacgccgagaaggccgagtgagctgaatagcgtttcgctaagctagctgaaagggctggaatccgtttgggttccagcccttttgcgttgttttcatagaatctacaacgtacgtacggcccgaatggcctcggctcttgcggccagctgatcatcggcgggatatgcgatatgctccaaagtcaggccctgcggcgcaatcggcccgcttgagccttcacgtactggctcggccattttgccggcaaaccactccagtgatttgcgtcccgaaccaactttgatgcatgagccgaccagggagcgcaccatattgcgggcaaaggcgtccgccacaatcgtgaacactaccaggccggactccagcgacggagtccgatatgcttcatgcgatgccatctcatccggtactaggggagtgatcggcacccgccgccaataggcggtcttgacttcacggatcgtagtgcctcccggattcggagtggcgaaggaaccaaaatcgtgcaggccgatggtcaatgaggctgcgcggttcataagctccagatccagcgcttcatccacggtaagtacgcatccacgcaggcgcgggtcgacctcagacgaacgatcggcgacccgatacacataagtgcgctccaatgcggagaacctggcatcgaagccgaccggagctacggcaatgccatgaatgacgatgtccgaaggcagcacagccttgagtctgcgagtcagcgcctcggtgaccggaatggtcatgtgacctacgcagcgattcagtacctcatcggatacatccagatgcgccacttggtgggaggcatgtacaccggtgtcggtgcgtccagccactgtcaagcgtaacggttcggccgcgtcatcggtcggcacccgcagcaccttgtgcagcgcatcttcaatggtgccttgcactgtacgaagattgggctgtttggcccagccatagaatccgccgccgtcgtaggccaagtcaatgcgcagtcgtgtcatagccattcattgtaacgagtgcggtcggcgagacgagtgcggtcggcaagatgcgtgcggtcggcaagatgcgtgtggtcggcgagacgagtgcggtcgtcaagatgcacgcggccggcgaagtgacctgcctgtaacattctcgcgcgtttgttgaaacgggcccgccttaggttgaaaccatcaaacccggttacggcttgcggcgtcagcgtgcgctcaaaacgcctaaccgcttgaagccacagaagccgccacagcaaggagcaggcacgatgatcgaatccgcagcacgcagactggcccatgaactggtaaaccgtcgcgaagcgatcaatcgagagctgtcccgcaacggtgtgcgtttcggcatctacaagaacggcgaataccatgaccggctgttcccgtacgaccctgtgccgcgcattatcgaatccgacgaatacgacgaattggagaagggcctgaagcagcgcgtcaacgccctgaacgcctatctgaaggacatctactccgacaaggccatcatccatgacggcgtggtgccggaggaatacgtatacacctcggccggctacttcccgcaggtcaacggtgtgacccctcccggcggcattttcgcgcatatcgccggcgaggacctggtccaaggcgaggacggccgctggtgggtgctggaagacaacctgcgcatcccctcgggtgccagctacccgctgttcgtgcgcgacatcgagcgccgcatctccccgcgcctgttccgcgacgttcgtattcgcgataatcgcgaatacccgcgcctgttgcgcaaagccatggactttgtctccaccgagggcatcgccgtggtactgactcccggccgctacaattccgcgttcttcgagcacgcctatctggcggagaaaaccggtgcggcgttggccttccccgaggacctcgaagtggtggacaacaaggtctacttcctcgactacgccggcaaacgccaccgtgtgggcgtggtctaccgccgcctgtccgacgaattcctcgacccgttcgccttcaatcctgattcggtgatcggtgtgcccggtatcctgtccgcctaccgcgcgggcaacgtggccatcgtcaacgcgccgggcaacggcgcggccgatgacaaggccatctactacttcgtgccgcagatgatcaagtactatctcggcgaggaaccgattctcaacaacgcgcccacgtacatgccgatgttcgaggccgaccgcaaggaagtcctgaatcggatgggcgagctggtcatcaaggatgtggccgaagccggcggttacggcgtggtgtttggttcgtcgctggatgccgccgcacgtgaggagctcgccaaccggatcaaggaggagccgcgtcgattcattgcccaagaggtgattcagttccgtgatatcgatgtggtggacccgaagaccggcgagatgtcgccgcgcaagtgcgatttgcgtgccttcgtggtcaccggcaagaatacgcacgtgtggtattcgggcttgactcgatactcgtcggtgcctggccagatgattgtcaactcgtcgcagggtggcggattcaaggatacgtgggtgttggcacccgaatccggcgtggagcatgaatacggtgccgaaacgcaggtggtgaacctgctgaaccagtcccgccgccactcgttgtctctggtcaccgcttccaaggcagacaacctgtattggctgggccggtacaccgagcgcgccttcaccacgctgaaccagttcttcccgttctacgatcgtgtgatggacactgatgtggacgccttccgtccgttcgctcacgcactcgacctgcccgaagatttcgaggacttcgacgggttcgtgaacagcttcctgtatgacgggtccaatcctgattcggtgcggtcggccgtaacctccgcattcaacaacgccgtgattctgcgcccggaattgagctcgcgtctgctgcagtacgtggagttggcgatgaccaatatcaccgatgccgccaaatacgcggccgatgccgaggacatctacaagcagcgcgatattaccgatgacatgctcgccttctggggcggcatcgagaattcgccggtcgaccccacgctgaaggcgttcatcttcatcggcaaatatctggaacgcatcgacctgtacacgcgcttcggcctgacgatggaggagctggaagcgccgctcaagaagctcgccgcctattcgatgaccttggacggcatgccgctgcccagctgcttcgccgacggactgagctggctggtcggtcagctgccgtctcgcggatatcaggaagtcgccgacctgctgaagaagtaccttgacgactactccggccgtgtcagcgcgctggccatcaaagacatgggctcactgagctccatgaacatggacgccaagcgtccctgatcccgacctgacaccctgacgggttcaaatgctatggtggtatggcgaaaaaaccgtgcgcccgagtgccggcctgtgcatatcagcagattgccggaatatatgcgtgggctgtgagcgcacggaccatacctcagccatggctgtagtgttgttatcccgagaatatgccggttgccggctcgtgtgcaagtgcaggagacgttgtgaaaaaactcgtgttcgactatgagatgaggctgtccttcagcgcaccggtcaccgatcacaggttccagcttcgctgtattccctccactggccctcgccaacaggtgattgacgtggaagtgaagattcagcccgaaaccgaactcgaaaccaccatcgactcctttgactccgtggtgatgaccggattcatccctgagccgcacgacatattcagctactcggtgaccggcatcgccttcgtggacaatgcgcatatccataaggaagcctataaaccgctgtaccgattcaattcagcgctcaccattcccggcccgaacgtggaggcgatgattgccgtatgccgcgaacgcttggcggcgctgccttccgacgccactccggtgcagcaggctgccgaagtgatggatgaggtctacaaggcgtttgtgtatacgcccggttccaccacgattcgcaccaccgccgaacaggccttggctcagcgcaagggcgtatgccaggattatgcgcacgtgatgctgtccgtgtgccggcatgtgggattgaccgcgcgctacattgccggtttgcttgggggagagggcgcgacccatgcttgggtcgaggtgtatcaggatggccgatgggtcggactggatcccacgcataaccgattggtggacgacagctacatcaccatcgcccacggccgcgattaccgcgactgcatgctcgacatcggcatcttctctggatacaacgtccagcagtcccaatgggtcaacgcctccgtccacgaacaggtggcataaataaaattccaagccccctctgatgagctgagccgtgaagaaaacgccggaggcgtttttaggcgaaggcgaacgacagtgagcaaataaaatggcagctggaaagctgtccttaattgcgttcgagctgtcagccgtaaggctgaccgagggagagaccactcaatgcagagtggccccgtcaccgcttctaccaccaccaatattcggattttggtagttgaagaattcggattttcgcagttgaccaattcggactgttaatcggctcatcgtctgacccatcgcaatctcacacaaaatcgcattatcccacgccgaatcgagctcagcgaaactccgatttgccaggtcggcagaatgtggcataatgaacaagttgccattttggcagcatggataagtgtccgagcggtctaaggagcacgcctcgaaagcgtgtgaggtgaaagcctccgcgagttcgaatctcgccttatccgcctgcaagggtttcgaggtgacctcgaaaccctttttgtttctgcgaaaccccacctttggggctataggccaaaatggagttataggccaaaatgtgtgtccggcggtctagtcgttcgactgccattcgacccgtgtgtggaactcgttccagtcgatgctggtgcctgtattgcttcaatgtttgttgggcgggttcggcagtgtttttcacagccaaaaaaaatcagtgacgaaacacgaaacatcgacttgactaaatacaaacggcgccgccacgaggagcggacccgccccgcggccccgcattcgctgcagcaccggtcggtctcgtccgtcggatcgcagccgatcagccacacgccggcacacgagcccgacgtgacgtggcgttgcgagaccgggttcaacccgagcctgtccagaccgagcagcacccggccgtcgaacgcgctagacttggaaccaagctgcgcggttttcttcgctttttcgatcacacaccgaataaaaacgcacggcccatacacacccaaatgcgaagggccagttatgacccgagaacgcctataactagcgcctgtatgcatgtaattgcagaaatcgacgtcttgtgcatgcaatttgggtccgtaaatagcgcagaaatgcgaggcaatctgcggacgggaagcgggaagggcggttcaggagctttaaatggtcctcttatgcatgcggcctcatgatcgggaaccggctaggaaatacgttgcatgcatttcggcatcataaggcatcggaaaagtcctacggtagcggtcccgcgattcgtcaattgagtgattactcggtactgtctcccgaaccgaccagttttttgctcatacactagttccgggtttcgatgagattgatgatgggcgataaaagggtccgacgcgctaacgtcgggcccttgcgttgattacggggtcgtgcccctaaccaaaggttacgggacgaatcgtatcatgatgcgcggtagtctgaccgtgagcaaacgcactgtgattgtctatatgacggatgcgcgcggtccaacgtgcgtggcctctggccgttacctcttgctaagactgcttatgtaacggtcgttaaagcatgatgtttcctcgctaggtattttgaccgcggcagttgttggatggatttgattcggatgatgatatagcgttgtatcaattgtggttgctgttatttgtatttgttgaagtatgtgagtggcgagtggcgctttacacgttcttttttctgtcttttggcccgattcttttcggcgtgttgccttgaaaatacacgcttatgcagatgttttgcgcctcgtcgttgcatgatttggttctttgttgtatcatctaactaaatgataagtacaatgttgtatcaagttgtactcagtaattatcttccgcgctgaagcggtgatttttacttatctgagacaacgttgtatcgaatttatggaagcaaaggataacaatggcagagcagcagtccaacaccgcctcagattcctcccgtctgatcgtcgacgatgccttcgaagtggctccggtgaatgatcgtctttttggctcgtttgtggaacatttgggacgttgtgtatatgacggcatctatgagcctagtcatcccgaagcggatgaggatggattccgcaaagatgtcattgagctggttcgtgagttaggtgccactaccatacgttatcccggcggcaattttgtgtccggttatcgctgggaagatggtgtcggcccgaaggaaagccgtccgcgtcgtcttgatttggcttggcattccactgaaaccaatcagttcggcttgcacgagatgtctcagtggttagacaaggtcggcggcaatgagctcatggaagctgtgaatcttggcacccgtggtcttgaggaagctctcgatttgcttgagtacgcgaatgttcctagcggtactaagctctctgatgaacgacgtgccaatggcaaggaaaacccgttcggtatcaagatgtggtgccttggcaatgagatggatggcccctggcagactgggcacaaatcagccgaagactacggtacattggctgcctcggttgcggcgggtatgcgcatgattgatccggatgtggagctggtcgtatgtggatcatccagtcacatgatggacacatttggtaaatgggaagaaacggttcttgaaaaggcctatgacagtgtcgatttcatctcgtgtcatgcctattatcatcctgaatttcaggctgatggcactcgtgatatggcaagcttccttgcatccggcgttgatatggatggcttcatcaaggatgtcgctgccgccatcgacgctaccaaggctcgccttaagagcgaccataacgtattcatctcatttgatgaatggaacgtgtggtatatcgatgaagaaccaagcaaaaatccggaaggtattggtaattggcctgtggcgccccgtctgcttgaagatagctacaccgctgcggatgccgtggtctttggcgacctcatgattacgttgctcaaaaacgccgatcgcgttcatgcggcgagccttgctcagctagtcaatgtcattgcgccaattatgaccgagccaggaggtccggcatggcgccagacgacgttctatccattctcgatgactgcgagatatgccaagaacggtacggtacttgagcccaaactgacttcgaatacttatgccacggccaagtatggagaggtaccggtggtcaactctgtggcagtacgcggggccgatggatctgtgaccattttcgtggtcaatcggtcattggaattgtccaatgacttcgaaatccaagtgccggatgatggcaacttcactgaagcgaccgcacagacgctacatgaagaggacttgctcgctaggaacaccttggaaaaccaagatcgcgtgattcttcacaccaatgattctgttacgttcagtgccgacgatgccatcgtacatgtgacattgcctccggtgtcttggactgccgtgcatgtgcggtgatttgaacgggtgaacatcgaaatataggtacgagataaggggaggagcgtcacatgaattgcagccaattcactccatgtgagggacgaacagagattgtcgatgctgatggacgattgatctggcataacgatgacatctgcatggtattcgtagttcgcgataatgctccggttgtgctcgccggtttgtccggatatggtatgcgtcctgcctgcgaattgaacaacgagaaaggtgcgtttcccattgtggaagtacttacttctatctcgggtcgtaccatgaatcatcaacgcttgaccgatactcgggaaggaagtcagctccgttttgtagcagcttatacctatgagcgcggcatgcgtcatgttctcaggattgatcagaaagatgaacattctggcctgttgactgagacggagttctcgatgttccccggagtcagtgccgtgagttgccagtcccgcatcgcatcggaacgccggctgccggtagaagcagtgtcttcgttgaatctcaccgtgccgttggatgccgctgggggtggagttgacggagtcgaggtctactgggccgacagcacatgggccgcggaaaataattggcatcaggcgccacttcgcgagattggtttgccggacatcaataccaacattaatcctcgtgttccgggcgcacgatttaatctctcttcgcgatccacttggtcgactggagagaagcttccccttggcgttttaaccatgggggaggggattcgtcgctcggctctgatttggcaaatcgaacacaacggtccatgggcttgggaaattggtgaaggcatcgatggccttcatatcacggccggcggtcctaatggggatgatcatcaatgggccgttgtgcttgacgaacgcactgattttgtcacagttccagctagctttgccatttgctcaggcggctggcagcaggtagtcgaacaaatgacgttacatcgtcgggcattgcgctctgctcgtttggctgtaaacggtcagaaccatgattccgaacagctggtcatttacaacgactatatgaataccctgttcggcaatccgacggctgataaagaactgccgctaattgaaggtgcaggcaagctcggcgtggacgtgttctgcatcgatgctggatggtatgacagcgccgatggcggctggtgggacatggttggcgagtggaagccctctaccaatcgtttcggcaatcttggcttgaaaggaatcgcttcggccatccgcaaggccggcatgggactgggactatggctcgagccggaagtcgtaggagtacgttctccaattgctaatgagttgccggattccgcattcttctgccggcatggcgagcgcgtggcagacgatggacgttaccatctcgatttccgttctcctgatgcgcgcgctcatatggatgacacgatggagcgcatcatcgctgaattccagccgaaattctttaaattcgactacaacaccgtacccggggttggtaccgaaatcgatgccggatatctaggtgaagggttgcttggtcatagccgtgcttatgtgcggtggctagacgatctcaagcaccggcatcccgagcttgtcattgagaattgtggttccggtgccatgcgtgctgactacgcgatgctgcaacgtctcgatctgcaatcgacttctgaccaatgtgatccggctatatatgctgccattgcagctggagcctcaatgtcgattctgccggagcaacaaggcaattggggctacgctcagcaggagatggatgacgagactgcggttttcactcttgcagcaggtatcgccggtcgtctgtatctgtcaggtttcgtcaaccgaatggatgagaggcgcttgcgtctggtccgaggtgccattgaagcgcaccggcaggtgctgaggaaccagtccggtcaggtgccattctggccattgggacttccggttttttcgggcgattggttggccagtgggcttttgccttatgcggataataacgagaccggctatatgacgatttggcaccgcggcggtgcaaacagcgttgttgtagaagtgccgcaaggtgccactttgagaccgtttttcccgaagccgggactcatcgacaagagccatggtgcagtcgattggcatgtcgagcctcttgatggcacacatgtccgtctgactgtttccgacaatcgtcgcagtgccagagtgtatgcgattgatatgccggattccaccaaataacaacaagatttgcctgcgcaacaccgcgctggcagcaatgataaggagaaagaacatgaagcaccccttcagaagtgcggttgccgcagtcagttcaatggtgatgctgacttcccttgccgcatgtggcggcagcgacacggcccagtccgatgaaaaggaactcacgatttcttggtattactcctctggcggtggtgacacgtgggagcgtgccatcaagctgtacaagaaggaaaatccagatgtcaagatcaatgaagtccacacttcattcccgcagatgcagaagaatgcatcgttgactctgcaggctgacgatgctcctgacgtggccatgtacaaccaggggaccagttctgttggcaatctcgcatcgcaaggtattctggctgacttaagcgaatatgcggacaaatatggttggaccgatacgttgcctgaatccattcagactgtggccaaatataaggccgatgatggtggcgttatgtcctcggacggcgaatggtatggcgtgccaatcaacggtgagttcgttctggcgtactacaaccaggacatgttcgataaaaatggcatcgctattccggaaaccttcgacgagcttgagtccgctatgcagcagttcgtggacaaaggcattacgccggttgcttttgaaggcaatgagacggcttcgcagcatctgtggtatcagctggtactgtctaaggccaatcgccagtttgttgacgattatcaatcctatgagcacgacgtcgacttctccagtgagccattcacctatgctgcgaacaagttctccgagtgggtccagaagggatatcttccgagcaactccggtggtctggtcgctgaggatatgattacacagttctgtgcaggtgaatacccaatcatgttctctggctcgtggtggttcggacgtgtcaatcaggatggcaacttcaagagcacgttccgtgccttgcccggcaacgagaagctgaacaccggtgcaaccggcaaactatgggtggttccggaaacctctaagcataaggatcttgctgccgacttcctgaacttcctgctctccaaagatgtgcagaacatgcttgctactgaagctggtttgccgttcaatgcctctgatgattactcgattgactctttgccggatgagcttaagaatccgctgaagactttcgatgacatgcaggactctgtcaaagagttcaacacggtgttcgaacagttgctcgacaacgatgcgattgcgttgtacccggattggccaagtgccggcatgtatgatgctctgaattcggctctccaaggcttgattaacggcaactccactcctgagcaggcaaccggtgaaatcaaggctgcttatgaggaaggaaagtcagatctgggactgtaacgagttcctgtctcttcgactacacgataaagccacgtagtgtggcatggtgtgggatggatgttcattgttgatcatcttcccacaccgtgcctgacacattcgcactcatgtacagagctggcactgtcgccagcccgcatcccatatcgtcggtgtccattgacaaaaggaggagaccatgtctcatggcaacggctcatctcaaggaaagcggcagaagaagcagctttccaataacgagaaaatatatgaaaagcgtattcgtagcggttatggccgttacattgttcccggtgccatcggtaccgtggtgattctgctgattccttttatcgccaatatttggatttcattgcacagttggcgtggtggccgcagcaaaatgaaattcatcggtttggacaattatgtcaaactactgggggatgaaaagttctggacctcattttccaattcgttgtacatgattgtggccatggtaattattccgctgcttatcggtctgattcttgcagcagtattgttcgattatatcggtcgtgaattcggtggtaagacatcgagctttttgagggcttgctactacctgccacaaattcttcccgtcggtgtagccggcattctgtggaattggattcttaattcacagaccggcgcgattaatcgaattcttgccggacttttcggcatggataagactcctgattggctaggcgacccagatcttgcgatttatgcggtgatgctgatgttggtgtggagccagataggatatccggttgtcatcttcatgtcggcgttggggcgagtcgatcccgagctgtatgaagctgcatcgcttgatggtgccgggtggtggcggcgattcagcgccatcacgctgcctcagattaaacctgagattttcgtggtggtactgacctgcactgttgcggcgcttaaggtttttggacctgtttatatgctgaccaagggcggtccgcaaagctccacccttgtgccgtcctactattcctacattaatttcttcggtaaatcacagattggctatggagcggccatcgcaagcgtgttggcgattgtcatcgccatcgtcgcatctgtcatcatggtgttccagaaccgtagcgctgctcgggaacgtgaaggagctctgatcgtatgagcgcatcatcatctgtcaaaacaggcatccaagctcgtatgaatcgtattgaacagcgtgatcgagttaagcagtccaagacgcgcaagcctattaatctattgcgatgggtaattctcattgcatgtgtgttgtttgcgattctgattctctcgcctctgttccttatggtgctcaatgcgttcaaaacgtcacaagattacacacagaacggtccgttgagcctgcctcatgaactgtatttcggtggcttggtgaatttctggaaagcgaccgacttccccatcaagttctggaattcattgtggatttccgtggtgtctgcgctgttgtccgtggtgctctcgctatttaacgcctatgcgctgggtatcggccgtgtgcgtggtagctcagtgattattgcactgttcatgattctgaccatgctgccaggagaaggattcatctacccactgttttacatgttcaacgcggtgggcatgggcaattctcaatggaccatcgtaattatatgcggcattatcaatatggcgtttggcacatatttgctcagctcggtgatgtcgacattccccaaggagctgttggaagctgcacaaatcgacggggctggtcgttggcgcacactccgtgacgtcgtgttcccgattatgaagtcgaactgcgcggtcttgttcatcttcttcttcatttggacgtggaacgagttctacttcaccttgattttcctagtgtctggagatactcagaccataccgctggcaatcgcgtcgttgcagggcgaccgcatcatggacgttccgactatcaacgcgggaagccttatctcccttattccggcgtttgtcttcttcctcatcttccagaggacgttgacgaagggcattaccgccggagctgtgaaataaccgaacccgatgcactgttggccggtggttctcctcctctccttcccactggccatagtgtatcgatgtatctttcgcccagcgtggggcaacaatgaagaaaggcaaacaaatgaaattttccgatggatattggcgtgtgcgtgaaggctttaccgcagcatgggcccgacagacacatgacatcgcgaaaaccgataacgggatttgtgcacatgcttctgcgaatctggtcaatgggcgtggggattccttaggaggtccggtattcacagttactttatcgaccccggccgaaggaatcatcaaagtagtggaagagcattttcgtggagcggtgaatccagatccacattttcatctgaatattgatgaggatgcgaatttcgacattgagaccggggacggggccacggtgtttcgtgcgggctcgctcgaagtcgccgtctccaatcctggcgagatttggtccatggacttccgagcgaatgggcatagtctcactggaacgtcgtacaaggggctgggcgcatataccgaacagtcgaccggtatccattacatgcgtgaacagctgcgtcttgccctagacgaaaaagtctacggcttcggagagcgatttggccacttcgtcaagaatggacagaccgtggaaatgtggaactctgatgccggtacctcatctgacgctgtgtacaaagccatccctttctattggacgaataaaggctatggcgtgttcgtaaatcatagcgaagacgtgtcatttgaggtcggatctgagactgtgggcaaagtgcagttttccactaaaggacatcgacttgaatactatgtgattaatggcccggaaccaaaagatgtactacgccgttatacgaagctgaccggacgtgctccctatctgccggcatggtcatacggtttatggctgaccacatcattcctgaccgattatgatgatgccactgtagcgggattcgtggatggcatgcaggaacgagatatcccactatcagtcttccactatgactgcttctggctcaaggaataccatttctgcgacttcgaatgggatggagatatgttccgtgatccgaggggaaccattgccgagcatcaccgtaaaggtctcaaggtgtgcgtatggattaactcctacctgagttccatgtcgccgttgtttgacgaggctatgtctaagggctacttgctcaagcttcctgatggcagcgtttacgagaccgatttttggcagccgggcatgggcctggtcgatttctcgaagccggaagctcgtgaatggtactgctctaagcttgagaagcttattgatatgggtgtggattgctttaaaaccgatttcggagaatcagtgcctactgaagtggtttatgaagatggttccgattcggtcaaaatgcataactactacacgtatctgtacaacaagactgtctacgaattcttggagcgaaagcttggcaagggacaggcggtgctgttcgcccgttccgccaccgttggtggacagcaattccctgtccattggggcggcgactgcgaatcgacttatacggcgatggccgagtcgctgcgcggcggcctatcgttgatgtcgtctggatttgggtactgggcgcatgacatcggtggattcgaaggcaatcctggtcctgacctgtacaagcggtgggtgcagtttggtttgctgtcgacgcattcgcggctgcatggttcccattcggtgcgtgtgccgtgggccttcgatgaagaatcctgtgatgtactacgcaagttcaccaaattgaagttgtcgttgctgccgtatctggcctatggatccaaacaggtcagcgaagaaggcattccgctgatgcgtcccatggctttggagttccctcacgatccagcggcagaatatctggatcgtcagtacatgctgggcgatgatttgctggttgctccggtcttttctccagatggagtggttcgttattatgtgccggaaggaacttggacgaacgtactcaatggagagcgaatcgcgggtccgagatggatcgaggaacaattcgattacatgaccatgccgttgctggcgcgtccaggtgcggtcattccaatgcaggaaggacgttgcgacaccgatggggatttgaccgacgacgtgatcctgaagatttatgatccggcggcccttgactcggaatggcgccaactggtcctgcggcatggttttgaggaagatgccgctgagacgatcttccggattcggcgtacgaatgatgtgcttgaagtgcgctgcgattccgtggaagacggatggactgtcgaatgtggcggtcagcgggttcaagcgcatgccggagccgcaacattgtcggtgcaatgatcccatagtatgcgcaagcatcgtggacgccggaatgatatctatgacggcattccggcgtctgcaatatctgtgtgaccttctgtgaccttgggcttaagatagggggatatcatgggtggataggcgatggtggtgccacgacaagatatgcgaaggagagatatgggcagccgcgtaacgattaaagacgtggccaaagcggctgatgtctccattaagaccgtatctaacgtgattaacaacactggaagaatgcgcccggacacgcgacaaagagtggaaggggccatgcgacaacttggatatacggttaatttgtcggcgcgttccatccgttccggtggcaccaggctgataggcctgaatatcttcgacttttcgcagccgtttgctccgtatctagctgataaggtcattgattttgccaaggagcgccaatacggggttattatcaatacctatggctccgatggcactggcttggcggatggtattgaagagacctatcgcttgggagccgatgggtggattttctttactgaacgcgctcttgtcgatgacggtgctgcacttgaacagccatatcctgtggtaatggcaggcgattatctgtcttacggcaaaagtgatttggtgaccatgcctaacgtgtcagctgtacagcagaccgtgggcagattgcttgataccggagtcagagctattgctctattgggtgccccgccggggataactgattgggattctttgaaaagtcagaaagaaggcacccaagagttacgtacccagggctatgtacgggcgttcaaggaacgagggcttgacgtggactggcgatatgttattccggtccatggatggaatcagcatggtggtgtgcaatccactgcagcgatgcttgactcgttaccttgccctgaagcagtggtctgtctcaatgacgccatggcactaggtgccgttcatgagctacagcgtcgtgatttacgagtccctcaagacgtgcaactgataggcttcgataacgtgccggaagccgagtactcggtgccggcgctgaccaccatcgatcctcatatcgatgattatgccaagcatgccgttgacatgcttatcgaccgcatcgaaggatactcaggcccggcccgtacgtacaccaccgatttcacattggtggaacgtgcctcaactcgacttgcccactagcatccaacaagttcgcatcggcttcgtgaggagtgtgtgtctactcgaacaatgcggcgtcagtcgctgggtagccaagttggaacgcggtgtaggcgtgcttggcggccagtgcggcgaggatgagcagcgtatcgctctcggtggaagatttcgattcggtcacggccttgatctgcgcgcgggcgcagtccatttcgatggcggcggcggtcggtacggtttggccgcttgccttgtcggcgatggtggtggggttggccagtagttggtcgatggcatagaccttttggcgggggtcgttttggccggaagaactggattgtgcgccggaatcatcaaaattgccgttcgccagcgcaaccaactgctgcccggcggtcttatgcatatcgctcaacgccaacgtagccccagcggtctgtcctcgtgcggccaagacctcgatagcgaatccggcgcgatcctcggccacggccatcgcatccaataccgatcgatcaacgttggcggacgtgacgccatcaagacgcgccggcgtcacctcaggcgcggactgcccgaatttatcggccagaaaagccagccattgcttggtctgcgcgtcacgtaacgttccctcggcaaaacgacccgaacaatacccggcaacgtcaatccaagccaggggagcggccagaccggtggcatactgctctaataacggcgtgccttcagccggatgggtggcgtagcccgccaacgtcatcgctttctcgcaaggggtcatttgagcttctgcctcggcccgtccggccagtcgcggcatcgaacacgccgaaagcgaacacagcatcgcgctcgcgcatagtacggatgccaagcgccgggtaaaccgtcctgaagagaagcgtgtctgcatggaaacatacactaatagctaactgtgactactcataggccatgcgccacataacttcataggaggtacggatcgatggaactggacctgacaggaatacacaagctcgccgccgagcaaggaatcgaccccgaaaccctggatgatgcgctggcagaggccctgcgcctcgcctacctcaagaccccgcacgccgccaagcacgcgcgcgtggagcttgacgaacgttccggcaacttcaccgtgtgggccgccgacgaaattccggtcgaacccaccgaagacaacccttaccccgttcccaagctgggcgaggaatacgatgacaccccgcgtgacttcggccgtctcgccgcagccaccgcacgccaggtcatcacccagctgttccgccgcgccgaagatgagaaggtattcggtgcgttctccggccagaagggcaagctcatcaccggcatcatccagcaggatgcttccgacccctccaacgtgcatgtcgcgatgggcgatgtcgaagccattctgcctcgccgtgagcaggtgcccggcgaacgttaccgccacggcgaacgcatccgcgtgtacgtggtgaacgtggcccgtggcatcaagggcccggaaatcgtggtgtcccgctcccacccggagctggtccgcaagctgttcgagcgcgaagtgccggaactggtctccggtgccgtgtccatcatggccatcgctcgtgaggccggcgcccgcaccaagatcgcggtcaaggccaacaccgatggcgtgaacccgaagggcgcgctgatcggccccggcggcgctcgcgtgcgtgccgttatggagaaccttggcccggagaagatcgacatcgtcgactactccgacgatccggccaagttcgtggcagccgcgctgtccccggctgtggccaccggcgtgcaggtgatcagcgagaagaacaagaccgccatcgccttcatccacgacgaccagctgtccttggccatcggcaaggaaggccagaacgcacgactggcagccaagctgaccggctggaagatcggcatcgaatccgccgaggcccatgccaagaaagtcgccgccgaaaaggccgcccaggctgcggccgaggctgctgctccggaagccgaataggccgccgggctcgaaggcgaatgatcttcagggcgcattatttcctgatacgagccgcgtcagcaatggcgcggctcgctgcgtctacgctatccagcgctatgagtatgcttgattggcgtatgtgggctggcgcagtgtgcgcgaaatcgcccacaccagagacgaggtaacacgatcatggtcgcacgatgagacagggtaggcttgccgtcatcaccaactgaccacgcccatgcacgcgcgtggtcacagaataggagtaattagtggcgaaaccacgcgtatacgaactggctaaggttttgaatgtcgatagcaaaaccgtgcttgagaagcttaaggacatgggagaattcgtcaagtccgcttcttctacgattgaaccgccggtagcccggcgtctgaaggcagagttcgccaaggacaacgccaagggcgattccaagcccgtgcagcagcgccgcccggccgcaccttcggccccggcttccacttcatcttccgcaccgactccggccgctcccgcacgtcaggcatcgcctgcctcggcacatcagcaggctccgactccgggtgcaccgacaccgcgtccgcagggcggcgcacgccccggcatgccgacccccggccgccacggtcagaacgacaaccgtgagaatggtcgcgataatcgcgaaggccgtgagaacggtcgtcagagtcgcccgaacgatcgccgtaacaacgatcgtcgtaacaaccagggccgtccgaacaatggccagccggttcagcatcagaacaaccgcggcaatgcttcggctccgcgcccgcacgctcagggcggcgccggtgccaatggcggcaatgccgcttcaaatgcgattccgcgcccgcacgctcagggcccgcgcccgggcaacaacccgttctcccgcaagcagggtatgcacaccccgacgccgggtgatattccgcgtccgcatccgatggctcgtccgactgctgataacggtcgtggcggtcgtccgggccgtcccggccaaggccaggggcagggccgcggcttccgtggcggtcgtccgggccaaggtggtcagggcggtccgcgtcccggccagtggggccacaaccgtccgggtcagggcggcggctcccagggtgccggtcagggcggcgcacgcggcggcttccgtgggggccaaggcggcggcaataacttccagggcggcggtgcaccgagcaacggtcccgcacgtggcggcggtcgcggcggtcgcggcggtgccgcaggcgcattcggacgtcagggcggcaagtcttcaaaggcccgtaagaaccgtctggcaaagcgccatgagtatgaggagctgaaagcaccgaccatcggcggcgttcgcatccccaacggcaacggccagaccatccgtctgcgtcagggcgcgtccctggccgatcttgcggagaagatcaacgtcaaccaggccgcgctggtcaccgtgctcttccacctgggtcagatggctaccgccacccagtccttggatgaggagaccttccagattctgggcgaagagatcggctggaacatccagctcgtctccgcagaagaggaagacaaggaactgctccagcagttcgacatcaaccttgacgaggaagaactgcaggatgacgaggatctcaagcctcgcccgccggtcgttaccgtcatgggccacgtcgaccacggtaagacacgactgctggataccatccgcaagaccaacgtcatcgcacgtgaggccggcggcattacccagcgcatcggtgcctaccaggtcaccgtgaaccttgaaggcgaaccgcgcaagatcaccttcctcgatacccctggccacgaggcgttcaccgccatgcgtgcccgtggtgccgagctcactgacgtcgcgatcctcgtggtcgccgccgacgatggtgtgatgccccagaccgttgaggccatcaaccacgctcaggccgccaaggtgccgatcgtcgtggccgtcaacaagatcgatgtgcccggtgccaacccggagaaggtccgcggccagctcaccgagttcggcttggtccctgaagagtatggtggcgacaccatgttcgtcgacatctccgccaagcagaacctgcacgtcgacaagctgctcgaagccgtgctgctcacggctgacgctgagctggacctccgcgccaaccccgacatggacgcccgtggtgccaccgtcgaagcccgactcgacaagggtcgtggtgccgtggccactgtgctggttcagcagggtacgctccacgtgggcgatgccatcgtggccggcacttcgtacggccgcgtgcgtgccatgctcgacgagaacggtcagccgatggaagcggccggtccgtccacacctgttcaggtgctgggcttgacctccgtgcccaccgccggtgacctcttcctggtcgcctccgatgatcgtgccgctcgccagattgccgagaagcgtcaggccaccgagcgtgccgcccagctggccaagcgtcgcaaggtcgtctccctcgaggacttcaagaagaagttcgccgagtccgagatcgacatgctcaatattgtcatcaagggcgattcgtccggttctgtcgaggcgctcgaggattccttgatgaagatcgaggtatccgacgaggtcggcatccaggtcatccaccgcggcgtcggtgcaatcacccagaatgatgtcaacctggccacggtcgacaaggccgttatcatcggtttcaacgtgcgtccgaaccgtcaggtcgcggacctcgccgagcgcgagggcgtggagatcaagtactactcggtcatctaccgtgcgatcgaagacatcgaggcatccctcaagggcatgctcaagccggaatacgaagaggtcgtcacctctcactccgagatccgcgagatcttccgctcctccaagttcggcaacatcgccggcgttatggtgcaggacggcgaggtcaagcgtggtacgaagtgccgtatcctgcgcaacggcgtggccacggtcaacgacctcgagatctcctcgctgcgtcgcttcaaggacgacgttcagtccgtcaaggaaggctacgaggctggtatcaacctcggcaccttcaacgacattgaactcggcgacatcatcgagaccttcgagatgcgggaagtcgagcgcaagtagtcattgttaagccccctctggcgagggggctgtcagccgcaggctgactgggggagagacatggtagttccatgattttctctcccctggcctcactgcgttcggcagcccctcgtcagagggggctcaagtctagaaaaggaaattcctatggcaggaaccaacccgcgcgccgcacgtattgcggccttgattcagcgtgtcgtcgcctcctccattgagcgcgaactgcatgacaagcgactcgccagcatcaccgtcaccgaagtccgtgtgaccaacgatttgcaaatcgccaaggtctactggacccagctcggccacgaaggccatgaggaaggcgaacgcaagcgcgcccagcaggccctcgatcaggccaagggccacctgcgttctctggtgggccacaaggctggcctgcgtctgactccgcagctccaattcgtgttcgatgaagtgcccggcgaggctcacgagatcgaagacattctcgccgtggccaagaagcgtgacgaagaactcgcccgtgctcgcgccaccgcccagtacgccggcgacgccgatccgtacaagcatgacgacgagcccagcgacgacttcgaagacgactctgacgaggagtagtgtgcttcatacaacccccagcggtctgctcatcatcgacaagccgcaaggcgtgaccagtttcgacgccgtcgccgccgtgcgcggcgcgttgcacatcaagaaggtcggtcacgccggcacccttgaccccatggccactggcacgctggtcatcgccttcggccacgccacacgactgctcaacgccatcgtggcgcatgacaaaacctacgaggctaccatacgcctcggcctgcgcaccactaccgacgatgccgaaggcgaggtgcttgtcgatgacgaagcccgctcccgctggcaaacgctatcagcgcagctgactgagggtggccagagcggcgaaccaacggcgttaccaactgcctcatggcaagacctgctcacacgcaccatcgccaccaatttcaccggcgatatcgaacaagtccccaatacgttctccgccatcaaaatcaacggccagcgtgcctacgacttggctcgcgaaggcaaggatgtggaactcaaaccccgcccggtcaccatcagcgaattcaccgtgctggatatccgcagcggattcgtagcaggggagcagaccgctgaaccattgcgggaagacgcgaacacgggagcgattcccgcacttgatgttgacgtgcggatcagctgttcatcgggcacctatatccgtgcgctcgcccgcgacctcggcaaagaacttggcgtcggcggatacctgacccgtttgcgccgtacgcgagtcggccgattcgcgttgccggacgatgccagcggacttatcgctcctgaggcgatgcttgacacgcgaacccataccgtcaccgcacataccgatcagaagacgttcactaatcgggaagggcaaaccgtcacgcgcaacaagtgcgtattggacactcctgaaggtcttgccggtgacgagcgccgcaactggctgcttgaccatgcccttaccatggaacaggccgctcgaggtgcgatgccggcgcttgacatcactcctgaggaggccagcgaattacgcttcggccgccgtattgagcgtacaatcagcgagcccactgccgccattgtgccgcaaacgcatgatgtggcggcgattatcgagcgtgcaaacgctcatcaggccaagccggtcaccgtattccccctcgcgtaaagtagacgcggtgaaaagtgcagcttgatacaggccgcgcacaacaacgtctatattgcataaataacatcgcacggataaaaggaacagcacactgatggatatcacgcacctgacccctgacgccgaaggttcgattgaatggccctcgttcagtaacgataagaaggccgtggtgacattgggcgcatttgatggcatgcacttgggtcatcaggcggtgatcaagcgtgtggtggaactcgcgcaccagcatgatgctttttccgtggtgattctgtttgatccgcgccccgcattcgtgcacggctgggtcatctcgcaccatggcgaagaacccgcggtgcagaacgtggatgccgaagccttgaccagtgtggatgatcgactgcaccgcatggaacagttcggcgtggaccacgtgctggtggtgcactacacgctggccttcgcagctatgtcatacattttcttccttggccgactcaccggcaagctgggtatgcgcacgttggtccttgggcaggatgccgccatgggcaagggtcgagaaggtgatgtgaagcatatcgccaatcttgccgccgccaccggtgtattcgaacttgatgtggtcgatgaccgtggcccgggtgaagtgcgtattccgcgcgatttcaagccggaagccccgagcgaatggggagagcccgtcgacccgctggccaatgccaccaaggccgagcgccgcgcatggagcaagaagaaccaggccaaggcaatgcgcgcatggagctccaccaatgtgcgctacctgctggctcatggccgaatccaggacgccaacgccattctgggtgctccgcactccatcgagggcgaagtggtgcacggtgaggagcgtggccgcaccatcggattccccaccgccaatcttggctccgacattgcaggctacattccggtcgacggcgtctatgccggttggctggtagatggtgaaaaccgttggcccgccgccatctccattggcaccaaacccaccttcagcgagaaaacaggccttaatgagcgtgtggtggaggcctactgcatcactgaagaatggatcgacctgtacgaccacaaggttcgcgtcgaattcgtcggcttcctgcgcccgcaggtcaagtttgatggccccgaccaactcgtcgacgaactcaagcgcaacgtcgaggagaccaagcgtcttaccgcctgaggcatatctcagggctatttacgcactcccaaggcgtctaatgcgtcggacaatgtgttggactccaccagctgaagtccctcgacatgcaccggcttgcgcagtggcggaatgaccgccgtggtgaagccgaggcgtgcggcctcgcgaaggcgatattccatacgcggtaccgggcgcacctgaccggtcagggaaatctcaccaatggcgcacgtggctcgcgcaatgggttttgacgtggcggcgctcgccagtgccgccactatcgccaagtcggaaccgggctccttggcctggcccccggcaatagtggagatatacaggtcgttggacagcaggttgagcttgctgtgacggtagagcaccgcgaccagcatggcgatacggctggggtccacgccattgaccgcacgacggggtgtgggcagcaccgacgtggtgaccagagcctgtacttcgataggcagactgcgatgcccatccaatgtgaacgtcacgcaggtgccttccacgggtgccgcgttggccgcatcagggccgtctccagacaggaacaatccggcgggatcggtgacctcttcgatgccttcaccgctcatgtcgaaacagccgacttcatcggtcgggccaaaacgattcttcaccgctcgcagcattctcagcgcagtctcgctgtcgccttcgaattggcagaccacatcgaccagatgctccaatgtgcgcgggcctgcaatcgaaccatccttggtcacatgaccaaccagaaatactggaatgtcaagtgtcttagcggtatctatcagcgcgcttgccacttcgcgcacctgagtcgaaccgccggaaatgccatcgacctcctgcgagacgatggtctgcgccgaatccacaatggccaaggccggcttgttctgttcgatcagccccaatactgtggacaggtcggtggtggaggccagtaacaagttcggctccaccgcattgatgcgggaagcgcgcaaacgaacctgcgcctgtgattcctcgccggaaatgtacagcacggtgttggcgtgtgttgatgatgcgttgccccgcatcggcaccgtgttcgatgcgttgccctgcgcccggcccgactgttgggcagaccgctgacctgcccctcggaacgtactgtctcccgccacaacgcgcgcgatattgccggccgtctgcaacagcaatgtcgacttgccgatacccggttcgcccgctatcagcgttactgaacccggcaccacgccaccgccgagcacacggtcgaattcggaaaacccggtaccgagccgctcgacgctttccgtgcccacttcggtaatcggacgggctgcagatctggcgttgttggcaaccgtaaccgactgcgtgcgtgatgttcggccgggagcggccgtgcgagagcctgccgccggccgagcctcgtgaaattcctcgaccgtgccccactgaccacactcggggcaacggccgtaccacttcggcccgttccaaccgcattcggaacatacatactgcacacttgatttcgccatggtctcaccctaacccaaacaccagcggacggtaaatttttaccgttcacaagagtttcacgcggcttgcgcacaacgactaaaattacggccgcctagcgtcacgcggctgtgagagaatcggggcatgactaatagtgagaactcctcgaccacgcaatcccatggcaagttgattgcagtggtggttgccgcagctgttgtgattatcctggcagtgctttcggcctttgtgtggccgggttgggccatccagaagaatgatggcacctccactaccacccaaaacagccagcagaaaaccgaatcatccgagccgaccaagccgaccatcgacgccacagctttgccggatgatgccagtgagctgttgaaggccatgccgggcagcgtgctgaattacgcgcgtaccaaggcggatgcctccacgacgtggaattccgcgtcgccgctcgaggagtacactctgacctactccactggtgatgccgccaaggatgtcacgctggtcgccgcgcagtggtcgtcggcggacaatgccaagacccagtacgatgcgttggtcgctgcgcagaccggcgatgagtcggcatccggcaacgtcaaggtttccggcaacgtcacgggcgcgtacgtggtgaaggccgatgcctccaacagcaagaacgccgttgccatctggcagaacgataccgtggtcttccaagctaccggcaccaaggaagcggtcgatcgcttctaccagaagttcccgatgtagcatctagtatcggctgtcagctgctgcacaaacttatgaacgttggggcatccacattgctgatgtggatgccccaactgcgttcagggcatatgcggactatcggcaacatactggttccctctgtctggcaacacgtgtattatggtgcgagttgcaacttttacgattaatcgaaatggaggcttcagatgggttctgtcatcaagaagcgccgcaagcggatgagcaagaagaagcaccgcaaactgctgcgtaagacccgccaccagcgtaagtagtcttacctgcaatcaaggcattagaaaccccgtgatcgttatggtcgcggggtttctcttttgcttggctctttgccttgttcgggcaacagtaaagcccgcacctgcgatgtgcagatgcgggcttggaaaagcttagtgatgtgagacgatcacttgttggcgttggtcatcacgcgcgggccgttcgggtcgccgacgatgaccttgtcgaccatgttgaggaacaggccgtgctccaccacgccgaccgtgttgatgaggtcttcggccagctcctgcgggtgatcgatgcgctccaggtgcaggtccaccacgaagttgttctcgtcggtgcgcacttccttgccgtcggcgtcaagacgaagcaccggcttgtagccgcgggcctcgaacttcttgatgacttggccggcaccgaacggaatgacctcgaccggcagcgggaacttgccgatggtgtccacaaccttggactcgtccacgatccacacgatctggttggagttggtggccacgatcttctcccacagcagagcagcgccgccgcccttgatgccgttgaagttcttgtcgacttcgtcggcgccgtcgatggtcacgtcgatgtggtccacgtcgtcgatgtccacgatcttgatgccgtagctctcggcctgggcctgcgtgcggcgagacgtggtcacgccagtgaactcaagaccttcctcctgatgacggcggccgagctcgtccaccaggaacttcacggtcgaaccagtgccgaggcctgcgatcatgccgttttcaacgagcttggcggcttcgatgccggccgccttcttcagcgcatcctgctgtgccttatccatggtttctcctttgccatccttgcctccgccgcatggatcaacggcgtgaagccttatctcctatcctaacgcgaatgagcgattttgtgtcatcgtgtccgattgcggtacatattcgtgtgtttgggtgtcagtgtcgtacgaatggtgcgttggtgatggtcaggttgccgtcgccgtccacatagccttcgatttcgatgctgcctttgatcggcatcggctgcccgttgaaatacgggctcgttttcggcgcgggggagaaggtcagcgtaccggataccgtcagcccgctgggctttgcggggggtacaggttgcgttgattgtacaggttgcgttgattgtgccgctaagggtgacgaagacttggtctccggccttgcggcatccgtctgatccgtcgccgcagccggcttgcgcaaacttgccgcatccgctttgccgtccaataccaattgcacgtctggaggcacatcggtgccatgtgcgtattcggagcccagcagcgactgccagccttcaatcggtagatagccgtcgcgcgcacccgaacggcaatcgcccgcataggtgcgtgccagttcatcgaccagctcattgccttcgttgccggcgtgacctttgacccatcggaaatccaccgggccagggcgttgcgagatttcacggtcgatcgcctgaataagctctttgttcttcacgggttttttctgtgaatttttccagccattcttcttccagcctttgacccacttggtcgagcaattgatggcgtactgcgaatccgattcgatgagcaatggctcagggcccggatgcgctcgcaaagcttccagcactgcgcacagttcgccaatctggttggtgccgttggtcgcgccgccggcgtcgtagccgtggtcgtcgtgcttatggccgggcttgccgccggcgttctgctcatgatcggcccaggcccagcccattggcccgtttggattccctaatgcggaaccgtctgtggatactgtgatagtcatgttctccaccctaacgcaagctgtgcaatctcttgctgaagtggggctgcccagcgcgaggcaaaacaacgtagtggagggtgtggataacatcacacctattgactttgcttgaaaaacatgccatcgcgcgtgaataggtgagcgctcacaagaaagacaagacatttcctctctgcgggtgaggccggcaacaatggcgcatccggtatctggaatgagaataagggactgtacaaaaccagtgacggcaacatcgaaatcctcaaaccagaggcggacagcgatggttcgacctccacggccgcatccaagggcaccatgcttatcgcaggcaactccaaaaccgtggcactcggtccaggcggcatggccttggctcccggcctgccgctcggtcttggctggttcatccgacgccgcttaggattggatgcctccgacattctggaccgtaagctcggcttgaagtaacggctggttcggacgtgattgctgtcacgtccggatcatgacgacagcgcgaaggtcctcatcggtttacgtcgatgaggaccttcgcgcgcattaggggagtctgttgcgggctgcgctacgcgggtcatgctgcgcgggcgtgctatgcgaacaaactacgcgaacaagtcgttcagtgcctcggcaatcgtcggatgcgtgaacaccatatcgcgcaacgtgctggccggcgcgtcaagatccatcgccaacttgacgatattgatcacctcgtgcgactcgacggaaagcagcatcgcacccagaatgcggccagtattgcgttccacaatcgccttcatcagaccatccggtcgccgcattacctgggccttcggcacagcggccaccggcaatcgcttgaccacataatccaatccagccgccttcgcctcgcgctcattcaatcccacgcgcgagtaaggcgtggcgaggaatgtgcttgacggcacatgcttgcggtccttcaccgtgtacggacggtcggaaccattgagctgcgaccacaccacgcgatagtcatccagcgaaatgtacgtgtgctgcgggccgccgttcacatcgcccagagcccaaatgtcggctgctgtggtgcgcagaagctcgtcgactttcacggcaccgcgttcggtgagctccacgccagctgcctcaagatgcagtccctcgacgttcggcgtacgtccggtggccaccagtaccgcgtcggtggtcaggcagaatcgggcttcagccggctcggcgaaccgcggctcgccatcatctgatggtttcgtttgaacgtgtgacatcgtggcgtgatcggtcgggttgctagtggggctggtggttgttgtagtgtcggtggcgccggtgatatcggtatgagcgttcccggtgccggcgggggtggaatcgcaagcttgcgatgcgccgcgagtcatacccttcaccgcaacggacaacctgacgccgccgtcagcagcaggcgcgatggccttggtatccgcgttgaacaggaacttgacgccctgcgcttccaactgtgcgcgaatcgcggccgccacatccgcatcctcgcgcggcaggaactcggcattgtgctgcagcacggtaaccgccgtgccgaaatcggcaaacatcgaggcaaactcaagtccaatgaatcctgaaccgataatcaccagtcgctgcggcatatcgtcgagatccatcagtccagtgctggtgtagacgccgggcgtagtgtggataccgggaatatccggaatgcgcggcgtggcaccggtattgatgaagatcttgctggcggtcacggcgatcgggccctcagcggtggcgatttccacgctatgagggccggtgaagtgagcgcggccggtgattacggtgatgttgtcttggtcggcgagcttgtgatagttcttgtcgcgcagcatcgaagtgacgcggcgcttctccttgatagcagcctcgaacgctgcttcgcgggtttcgggagtactgttcgcgccatcccgccgcgcctgttcggcggacaaaatcagtgacttggacggcaagcatccgatattgatgcaggtgccgccgtacatgtcggcgcttgcctcggcgacgacgaccttgcggccggctgcactgagcttggcagccaaggttttgccgcccttgccgaatccaatgatcagggcgtcggtggtgatagtgggggaggtgctgggtgtgctgatggcattgggtgtgctgatggacatggttacttccttacgtattcgagtgataagagtgcgttgtgctgatgtgttgtgtgccgtgcggcgtctgttttcttctttgactgccgaagcgttatcgactgatgctggctaggggaaacgcgcgggattattagcctttgcgctcgctgaatatctgttcggtgatgtcgtggatggtggtgtgttcgagttgttcgaggcaagtgcggttgagcccggcatagatgtcgttcatcactgcgcccattgaagatgacaccagacagtcctcgtgtacgtcgcccggtgtccagttcactttcacaaaagtggtgccggtggcttccgctaccgcgcgcaaagtgatttcggcggcgggccgggccagagcgtacccgccttcagcaccctctttagtggcgatgagtccggctgaggcgagcggtcgcattactttgcgcacgcgcgccgcattggtacatatgttctcggccaggatctgactgggcaggtgtgtggcgcgatggtcaaggtagaccaatgcgtgcactgccagtgaatggtcgccgttcatgaaacgacctccttaccgagtcgaactgtagctatgatgtgtacagttatgatactgtaatcatatcagatacagttagtgtgtcaaatcggggttgaagaggtggatgactatgtgtataagtgaggtgtccacatggttatccacaatgaatgtgcgtaagtgaagctaggaccacatacctcgaatcggcttccgtttccgcacccactacccatatggtggtgtcatgaacaggatgaccgacggcatcaccaactatggagctctgccaggctctatatacgatccgcctccggaagaatcggagacagtttttgttccgcccgaatttgcgggggcattttctgctgactcgaaatacccgacttttcgcgactcgccatcgccaaacagtggtgcacatgattctgcggcggcaccgaccatgagcgaaagccttgcccagcgcaaacgcgacatggtcgcacgctgcactgaggaagcgaaacgggcgggcaagaagctgcttttcggcatgaccacttccctcgctctgcaatccgtaccgattcccgccgattgcgacctcgactcggccaagctgcacactgtatccagcgttaagagcaagcggtttcgtacacgccatgcaccactgcaaacgcatatttggaaacatgcggctaaagccgccaatgtggaaatgaaccaacacgtgtttgcgctggacctgtttcacgtatgggctcaacttgccccgtatgtttcttttgagtccctgattgtgctcggggatgccgtcatcgctgctacgagcaaacagccagtattggccaaggatcgtgatgctgctgcaatctatcaggatctggtgaagttcgtggagcgatttacccgattcagagggcgcccgtcctgcgttcgagcattgccgctgatatcacctggtgctgattcgcccaaagaatcagaagaacgactctctctggtagcgcatgggattccacagccggttgcgaactatgtggtgccggatgcggcttttgcatctggagctcccataacgttggacttagcgtggccggagttcaaggtcgctgttgaatatgatggcgatcatcatcgtacgagtaagactcaatggcgccgtgaccaagagaaaaggggtgtgctggtcgggcggagatggctggtcttcgtcgccacggcggcaagtatcgctaacgaggatgctcgtgctgaattcgctttcaatgtggcgagggcgcttgcttcgcgcggtgccgtattcgagtttcatgtagttgccatgtctcttgaagagttgtcgcagagcctgctgtgaccataatgtccgaaacggactgatgtaaaggcaatatttgtacgacctgttgttgtggtgtgtgcttgatattgcatgccgttcgattgtgatgcctcgtagtgatggatttcgtgaatgactagtgttcgattgtggaggaaaatgtgtcatagtggtcgattgggggggggtattggtgcattgagcgtggatttgcgtcaatgggtgtgggacgctgcgcgtgttttgccgatttttgcgtggcgtcccacggcccctcgggtaatggctatgacgggtgtggcaggaatggcgtctttccggggtttccagtttgagtgtgtgggatgggggggtgtaaaacgattgacttagctgttgtcccacgcttttgtgggatggcaactctggaatgggcgaattcgtcgtggcgtcccacaacgatgttaaaactcgaccatgatgcaagccgaccgaacgcttcggtggtcatctggccgctgtgaccccacaatgatgatggtaggcaggcgaacgtttcgcggtcatctggccgtcctgccctgcagtgatgttgagaaaatgcagtcacggtgcatgaggagaaccgttgacctgcgtgtttcagtggtcgcgaactgcatatgcgctaaaaaagctctgcagtggattgcatgaatccaatgcagagccttattggttgcggtgaacgcgactaacgcagcgatttcactcgctcagggccttgtcgaccacgacggtggcctcgtcgagtaccttgtccagagcctcgggggagacgaaggactcggcgtacaccttgtagatgttctcggtgccggaggggcgggcggcgaaccagttgtccttggtggtgaccttcagaccgccgatcttggcgtggttgcccggtgcctcggtcagcttggcggtgatgtcttcgccagccagggtggaggcggtcacgtcgtcgccggacagtgccgcgaacttggccttctgctccagtgtggtcggggtgtcgacgcgcttgtaccaagactcgccgaagcgctcgacctgctcctggtgaagctgggccgggttcttgccggtcttggcagtgatctcggcggccagcaggtcggggatcagaccatccttatcggtggtccacacgcggccgtccttgcgcaggaagctcatgccggagctctcctcgccgccgaaggcgacttcgccgctgaacagcgggtccacgaaccacttgaagcccaccggcacttcgatgaccttcgcgttgatcgatgcggccacgcggtcgatcagggaagaggagaccagcgtcttgcccacggctgcgccctcaggccagcccggacggttgccgccgaacaggtactccacgcacacggcgatgtagtggttcgggttcatcacgccccagttcgggcagacgatgccgtgacggtcggcgtccgggtcggtgccgccgaccagatcgtacttgtcccaagcgccggcgttgagctcgtcgaccaggcccttcatggcgtacggggaagacgggtccatgcggatcttgccgtcgtggtcgatggtcatgaagcgccaggtcgggtcgacctcaggacgcaccacgccgatgttcaggccgtacttctcgttgatgagcggccagtagttcacggaagcgccgccgagcggatcgatgcccagacgcacgccggagttgcggatcacgtcgaagtcgatgacgttctccaggtcgtccacgtagtgctcgcggaagtcgaagccctcgacgtactcggacttgatggcctcctcgtagggcacacgcttgatggacttgaagtcgccgagcagctcgttggcgcgagcggcgatggcattggtggtctcggccggagccgggccgccggtgacggggtcgtacttgaagccaccgtcggtgggtgggttgtgggacggcgtgacgacgatgccgtcggcgaggccctcgccctcgaagcgctgggtgccgtcggccgcacggttgtgggtcaggatggcctgggagaccaccggggtgggcacgaagtcgtcacgggaatcgacgcgtacgtgcacgccgttggcgacgagcacctcgatggcggtcttcttggccgggccggacagcgcgtgggtgtcggagccgaggtacagcgggccggtgacgccggccttcttgcggtattcggcgatggcctgggagatggcgatgatgtgggcctcgttgaacgaggtcttcagggacgatccgcggtggccggaggtgccgaagatgacacgctgctcggggacttcgggatcggggacgaggtcatagtatttgccgataacctcatcgacattgatcagatctgctggggtggcgggctgacccgcattgtttgctaccatgctccctattctgccacgttttttcgccacgttgggtacgattatgttaagagttgtcaacttttgtgcgaatcgtgtgccggttgtctagcgcttggtcatttcctcctcgatttcctccagcgacttgccgttggtctcgggcaccaagcgcatcacgaacgggatggacagggccgaaaacacgccgaaaatcgcgaacgggccgcccacattgttgccgaacgcatcgagcagcacgaggaagaactgggagacgatgaagttgcccagccagttcgccgccgagccgaaggaggagccgatgccgcgcacgctcagcgggaagatctcgccgataagcacccaggcgatcgggccccacgagaccgcaaagccgaggatatagaaagcgatgagaatcatcgtcggcacggccagcacggccacgtcgcccacgaagttcatcacggcgagcactgcgagcgaaacggtcatcacgatggaaccgaagatcagcacgcccttgcgcgggaaacgatccatgataagcgtggccacgatggtgctcacgaagttcaccacgccgatgcccaccgacacccagattgcgtcgccttcagggaagccgaagcccttgatgaacacctgcggcaggaagtagatcaccgagttgatgcccacgagctgctggaacagcatgataccgatggcggccaccagcgccggacgagcgatacggaacagttcgcgcacaccacccttggtgtcctgtgcggccacggccttgatttcgtccagctcaatctgcacctgggtctgatccacgtccttgcgaatcagcgtaagcactttgaaggcgttgcgggtgtcgcccttgttcaccagataacgcggggattcgggcagcaacaggccgccgagcagcaacaaggcggccggcaccagcgccgaaccgagcatccagcgccagtcgcggatgccgaagaggttgtggttcaggaatccgaggttggaggcgtaggccagcagaatgccgaaggtgaccatgagctggaacagcgtggacagtgagccgcgacgctccttcggcgccagttcggccaagtacgccggggtcagggcggaggccgcgccgacggcgagacccaggatgatgcgggcgcacaccatcatcgcgaatccggtggaggaggcgcacaggcctgagccgagcaggaacagcagcgcggagacgatgagcagcttcttgcggccgaaccggtcagacagtgcgccgatcgacagcgcgcctgcgcacgagccgatcagcaccgaggaggtgatgaaaccggtctgagagacgctcaggccgaagtccgattcgataagcggggaggcgccggagatgatgccggtgtcgaaaccgaacagcatgccgccgagcgcgccgaaggtgaagatgaatgcgctgttgagcgggaagcgcgtggagaagccgtgcgattcggcggcttcgaggtcctcgattgcgttggctgccgcgtttgtggccgcgcccgccactccggccacgccggtttcgatggtttcgattgcggtggccgccgccccggttgcgctggtttcctgcgccgcggatgccgtctgtttcgatacgggtgatgccgttgtcgtcgtcattgccttgtcctttcgccgttgacggaccgcgcctgttgcgtggcccctctgccgcgtgcaaggtcaggcttcgattgtctgaagtcgcccgaaaacaaaaaaagacctggaacaacgtggaattcgcatattacgatacgcaaattccacgtcgctccaggtcttgcctcgttttgagtaacaaccctgctacgcaacgtgtgtgaaagatagaatacgacttccgcagtcgcgacactccgaataggcagcaaaaaacgatgatttttgacaacgattgcaggattctgcatggtggaatgatgtcggaatgggcgctgcggcaaatacggagaacgggtgtggcgaagcatcatcgcggaacattatggcgggacaccatcgcggagcaccgtagcgcatagttgccgtttcgcgatgctttgccggcattgccgtgcttttggggcacccagcgccgataatggaacacagtggcatacggcagcaaggaggaaccgtggcgaacgcatcgaacgcaacgcctgcagtgattgcggcgcgcatcgtcgatgccgtcggcggccccgcgaacattaccagcctgacccattgcgccacgcgactgcacttcgaactggccgatgccggccatgtcaaccagcacggtctcgaatccatccccggagtcctcggcgcattcccgcgaaccggcaatcgttatcaggtcatcatcggcggagcggtcgcctcggtgtacgagcagatcgttcggatgcaggcagcgcgattgactccggcaacgcaattaccatcggcggcgtcgcggccaacgcagtccgcgcaatccactcagtccgcgcaatccactcagtcaacgcaatccactcagtcaacgcaatccactcagcctacgcagcctacgcagtccgcgccgaacctttccgacgacgtcgcaccattgcgcgataccgacaccgagcagagtcacggcccagccaatacatcccgtcacttcacgcctcgtaccgtccgcgagtggggcagtgccgcccgtgcccgggctgccgcgtttttcgactacctgtccgactcgttccgcccgattctgggtgtactgctcggtgcctcgctggtcatcgccatcgtcaacgtgatcgttgcactcggcattgtgcctgatggcgagacgtccaccggttggatactactcaaggcgatttgggagggtgtgttcaccgttctgccgattatgatcgcttacaatgcggccaagaaactggacgtcgacccttggctcggcggtgcgattatggccgcgcttatgaccccgcagcttactggcgtgatgtccggaatgtccgggacgtccgtatccagcgctctctccggggagattcaatgctcggccaccgccacattcggcaccgaaacctgcaccgtgtcggcgttcggcataccgattcaactcaacgactacagtggcaacatcttcgtaccattgctcatggccgccgtgctcgccgtggtctaccgcgggctgaagcgcgtcattcccgacagcgtacagctggtgttcgtgccattcctctcactggtcgtcgtttttgcgctcaccatactggttatcgggcctctgggaatatggctcggcagcgggctgggagcggccacagcatggcttaacgcgcacgtgccattcctgttcgcgctcatcatcccgatgctctacccgtttctcgtgccgctcggtctgcactggccgttgaacgccctgatactgatgaacattcagacgctcggctacgacttcgtccaaggtccgatgggtgtatggaacttcgcctgcttcggtgccaccgccggcgtgctcgtgctggccgtacgcggcaaggattcggccatgcggcagaccgcggtgggggcgttgctcgcgggattgctgggtggcgtttcggaactgagcctgtacggcatccatctgcatcaccgccgcgtctaccgctggctgctcgccggctgcgcggccggcggggtgaccagcgcggtgttcggctggctgttcccgtccgtgctgccatccggccagatggtccggggcgttacgactacggcattcgccttctcctcgttgctgacgattccggtgttcgatcggatgtgggtgtacgcgctgtccatcgccgttgcgtttgtaatggcgatggtgctgacggtgctgttcgggtaccgtacgccgccgcgcgccacggaggcgcagatggtctcggcgggcgagaacgcacgcccgcaggatatggcgagggggattgacacgaccgtgtcggatgtggagtctgcggaagattctccatcgcgggctgcccctgatcgggctcttgactccaacgccatcttgtcgccggtcgccggccggttgatgaatctggaagcgactggcgatccggtgttcgcctcccgcgcgctgggggagggtgtaggcgtcgtgccggagacgaccggtgagacagccgtgctcgcaccggtcagtggcatgctgaaaaccgtggcccgaaccggccatgccttcggcattaaaaccgatggcggcatcgaggtgctggttcatatcggcattgacaccgtcgatatggatggcgagggattcgctgtggtcgtggctaaaggcgagcgaatcgcggcgggagagccactggccaccgtggatttcggcaaagtcgcggcggccgggcacagcgttgtggtggtggtgacggtggtcaacgccgctgaactgaccgtggtcacgccgttgatcggcgacggtagcggcgacaacaacggcggtgactgcaaaaccgtatcagccggcagcccgatcatcgatgtggaacaatgacgttgcgaaaggatgccatggaaatactgcgagtgttcaacaacaacgtcgtgctcgccaaaggcggcgacggcggtgaggtgattctcaccggccgtggactggggttccaggccaagccggggcagacggtcgacgagtcgaaagtcgtgcgcaccttcgtgccgtcggacgggcgtgacccggaccatctggcgcagatgctggcggacattccgcccgaaatcatccgcgtggtcgtcgaatccatgcaggaagccggactgggggagcgcgagaccggcagcaccacgctggtcatggccctgtcggaccacgtggcgaatgcggtggagcgggtgcggcgcggcatcgacatcacctacccgctgctcggcgaggtgagcaacctgtacccgcaggaatacgcgcaggggcgtgcgatgctcgcatcgctcaatgcacggctcgacgtcacgctgccggacggcgaggccaccgcgcttgccatgcatctggtcaacgccggcttcgccaccggcgacctgtcctatacgtacacgatgacgggcgtgatccagcaactgcttgacatcatcgaccacagctacggcatcacgttggaccgcagttccgtgaacgtgggccggttcatcacccacctgcgctacctgttcgtacgcatccaccagcaccagcaactgacggacgagccggcaccggtgatgaaggtgattcgtgagtcctaccccgccgcgctacgatgcgcgcgaaccatcgcctccctgctcgaactgcgcctcgacacggatatcagcgacgacgaaatcgcttatttggcgatgcacgtcgcccgagtcaccggccacgcatcgtagcggatcagcgaatcggctcgagtgtaccggtcatttcggcgaaattcgaggtggcatttgaagcagcggcctgcgcggtcttttccagcgcggaggcgtcgggcacgcgcacgatcagcgcgcggtgatccaccgagaaacggatgtggcgggtttccggcagcatgtcaccgtccacctgcgctttggccggcttttccaatgtgatttcggcactgacgccctgaacctgttcgatggtcgagttcgtggacagcgggttctgttcgggcttgccgatgatcgtctggtgcaccacgtcgccgaacaggttggcccagccgaggatgccgccggtggtgtcgatgatttcgaagtccagcagaccatcgtcataggatgccgccggcatcagcgagaacatgggaatctggccgcagttgccggccatcaccgtgcggaaatcgagattcttgatggtgtgggtcgagccgtcggcgctggtgactgtcagcgtgccgcggaacttcggcgcgaacaggttcttcacgccgcccacgaagtaggcgagccagctgatgttcgccttgagctcggggttggtgtcgtcgatcatggccgcatcgaagccgatgccggcgatgatgaggaaggcgtggccgtggtcgtcctccgggtggtcgagcagggtgagacggcccatgtccaccaggcgggagccgtgggaggtggccacggtcagcgcggcgtcgatatcgtccacgggaacgcccatattgcgggcaaacaggttgccggtgccgatggggatgatgcccagcgcatggccggtgccggagacggcgctcgccaccgtgcgcaccgtgccgtcgccgccgaccgcgatcaccacgtcggcgccgtcctccagcgcctcaagcgcgcagaccctgccgtccttgtcaagctgggtgtcgtagaagcggatgcgattgagccccttggcctcgcagaacctctggatatgcagcctgcgggcttcggcctgcggtttggacggattcacgatgaaggcgtactgcacctcgtcgtcccggcgcttctccagcgtctgagccagcttgcggcggcgctgcgcgcgcagagcgatgacgatgacggcgatgagcaccaccacaatggcgattgcggcgatgatcagaaacacggtgagggcaggctgaggcatggctcctattgttatcggtggggaggtcgtttgcggccatggtgcgccgtacgtgaacatttcctgcacgcaacagccccgtggggcgtgattatggttcaatcgcgtctcatctgacgaaattggccgggtggacccgtccgcggactttcccgggcttccctgtgatttccgcgtgactcccgcgcattcggccattgtcggtgtctgcttacgcggctagtctggtgcccatgcttgatattcaattcatccgtgaacacaccgatatcgtcaaggaatcccagcgcaagcgcggcgagtccgtggaactcgtcgacgaagtgctctcctccgacaccgcacgtcgtgaggcgctgaaggccttcgaagaggctcgcgcccagcagaaggaaatcggcaagaaagtcgcctccgccccggcggacgagaaggccaagctcatcgccgaaaccaaggaactgtcccagaaggtctccgaatacaagtccaaggccgattccgcagccgaggaatacaccaccgccatgtggaagctctccaacatcgtggagcccgaagctcccgaaggcggcgaggatgactacgtggtcgtcaagaaggttggccagattcgcgacttcgcggccgaaggcttcgagcccaaggaccacctgaccctcggcaccggcgtggccggcatcgacatgcgccgcggcgtcaaggtcggcggctcccgcttctatttcctgcgtggccaggtggcccgcatgcagattgccatgctcaccatggccgtggaccaggccgaagagcacggcttcacgctggccatcaccccgacgctcgtgcgccccgaggtcatgcgcggcaccggcttcctgaactcccacgccgacgagatctaccgtctgcgcgagcccgatgaccagtacctggtcggcacttccgaagtggcgctcgccggcatgcacgagaacgagatcctcgacctcggcaacggcccgctgcgctactgcggttggtcctcctgctaccgccgcgaggccggtgccgcaggcaaggatacttccggcatcatccgcgtccaccagttcgacaaggtggagatgttcgtttacgccaagcaggaggactcctacaaggagcacgagcacctgctggccatggaacaggagatgctcgccaaggtcgaggtgccctaccgcatcatcgataccgccgccggcgacctcggttcctccgccgcccgtaagttcgactgcgaggcttgggtgccgacccagggccgttaccgcgagctcacctccacctcgaactgcaccgagtaccaggctcgccgcttgaacatccgcgagcgtatggaagacggcggcacccgcccggtctccaccctgaacggcacgttggccaccacccgttggctggtcgccatcatggagaaccaccagcagaaggacggctccatcgagatcccgaaggccatgcgcgcctacatgggcggcaaggaagttatcgagcccacgaagtgggaggcctgagtctcatcgtgctttagctccctctgatgagggagctgtcagcgtagctgactgagggagagattactgagggagagatcgctgatagccagcaggcgaatccaagaccgaccgcactgccgaatatcaacatccctcccttctgtataatgaatacttgcgcgtgtgaacgcgcatcaggacaggtgtctgagcggcctaaagagacggtcttgaaaaccgttgaggggcaaccctccgcgagttcgaatctcgccctgtccgcgaaccgaggcctgggcaacatgcccaggccctttttttctttttctggaacctgtcttcttgattgccgccggggtgctgatatattggtttgtgatgccgtaacatgcggtgtccccgttgatatgacgggccgatcggcgtgagccgataagaaaaggcccgacgtttgcagcatcgggcctttgcgttgattaccggcttgcgcctttaatcaacaaggttgcaagatgaatcatatcacgatgcacggtagtctgaccgtgaacgggcgcaccgtgatcgtccatatgggcgatggcgaggcgaacgccacggttgacggcacgcacttcaacgtgcgtagcctgtggcagctctaccagttgctgagactgctcgtgtagcgtctcattaaggtgcggtgccccctggtcgggtatcgcgccggcgacctgaaaaccgataatgttggcaagtgcttgcaatttgcggtggacgattgcaagctaacgtcttggattgttgccgctatccaatatctcattaggcctaccggtggaccaaaagtacgttgctttgtaaggggagttaatgaaatgaacaaactcgcacaatcgagcatcgaaccggtttaatgctactcgcctcaacgggacgcgcggtaattgttagctaagttgacaataaaagaatgagggcatacattagtaatcagtcatcacactgagatgatgatttcactacgaaggagtagagatatggtatctcgcaataagcgcatcgtggctgcttttgccgcggtagcagcaatgggaatgggcttggccggttgcggcagcgacactgccggcgacacgaagaccaccgatgatggtggcgtggtcaacatcacctacatgcaccgtctgccggattccgagggcatgactctggtcaacgacatcgttgccaagtggaataagcagcatccggatattcaggtcaaggccaccaagttcgatggtaaggcctctgacatgatcaagaagcttgagaccgacgtcaagtccggcgaggctccggatctggctcaggtcggttacgccgagctgcctgaggtcttcaccaagggtctgctgcaggatgtgacccagtatgccgagcagtacaagaacgacttcgcatccggcccgtacagcctggttcaggttggcggcaaggcttacggcctgccgcaggacaccggcccgctggtttacttctacaacaaggctgagttcgagaagctcggcatcaccgagattccgcagaccgccgatgagtttatcgccgctgccaagaccgctgccgccgctggcaagtacatcatgtcctaccagcctgatgaggccggcaacatgatctccggtctggctggcgcctccggtggttggtacaaggtgaagggcgactcctgggtcgtcaacaccgagaccgatggctccaaggcaaccgctgacttctaccagcagctgctcgacgccaaggcagccaccaccaacccgcgttgggatccgtccttcgatgcatccatcaaggatggctcgttgatcggtactgtggccgccgcttgggaagccccgctgttcatgacctcctccggtggcaccggctccggcgaatggcaggtcgctcagctcggtgactggttcggcaacgctggcaagaccggccctgacggtggttccgccgtggccgtgctgaagaactccaagcacccgaaggaagcaatggagttcctggattggttcaacacccaggttcctgatctggtttcccagggcctcgtgccggctgctaccactgaagacgctgagactccttccgagtggtccaccttcttcggtggtcaggacatcatgaaggaattcaagaccgctaacaacaacatgggtgacttcacctacatgcctggcttctccgcagtcgccgccaagatgaacgaaaccgccgccaaggccaccgatggctccggcaaggttgcagacatcttctccgacgcacagaccacctctgtggatacgctgaagaacttcggcctgtctgtttccgagtgacattaacggttagggttccttccagccgctgatatcctcaaccacacatcgaaaggccggagctcaacactccggcctttccttttactcgagttcggttcgtcattaattgtgtttgatctgactgcatcgattcgaactgcattacgtactttctatttctcactgttcttttgaaagacaggtttccctatgactgcaacaacaaaaacggcgaagacgggggtcgccaggcgtgccgataagccaaaggcttctgatgctgtgaagcgtgagaatcgtaccggctgggccttcatggcaccgtttggcatcctgttcgctctggtatttattcttcccatcatttgggctatttattccagcttcttccgccaggtcaccacgggcggtggcgcatacggcggcggggaactggtcgataagttcgtcggacttcagaacttccaatacgttattacttccggcaacttctgggctggcgtgggcagggtagtgctctacaccgtgattcaggtgccggtcatgatcatcgcggcacttgctctggcaatgctcatcgattcctatatcgtcaagcacatcaccgcattccgtctgagctacttcctgccgtacgccattccgggcgtggtcgcatccatcatctgggtgtacctctacaacggccagatttcccctatcgttaagggacttgccgccatcggcatcaaggtgaacttcttcggcgacaatgtggtcctcggctctatggccaacatcacgacctggaccttcaccggctacaacatgctgatcttcctcgccgcactgcaggccattccgcacgatctgtacgaggccgcacgcatcgatggcgccagtggcttccagatcgccatgaagatcaagctgccgaacgtgcgtgcagccgccctgcttgccatgctgctctccatcgtcggcaccatccagctgttcaacgagccgcaggtgatgtcgatttccgatccgagcatttccaagtcgtacacgccaatgatgatggccctcaatacctcgcagggcacgctgaccccgggtggtgacggacctgcatccgctgtggccatcgttatggcactgatcgctggcgtactcgccgtggtctacacgctcgttgaaaggaaggtgaacgcagaatgagcaccgtagaagctactgataaggaatcccgcgcggtcgcacgcgctcgtaagaaggctgacaggattcgcgacaagcatgccaacgacctgcctcgttccatgcagccttccgcgctggtcaagaccatcaccatcgttgttctggtcttcgcgctgatctactttctgttcccgatttactgggccatcatcgcctcgaccaagacgccgagccagatgaccggcagcaacggtctgtggttcgccgtgggtctgagcgatttgcctgccgccatcgccaagaactatggcacgctgattggttggacccgtggccagttctggcgctgggtgctgaactccctgatctactcgggtgtttccgctctggtgggtacgctcgtggctgtgatggcgggatacgctaccgcaaagttcaacttcaagggtaagaaccttgccattggcgtgattatgggctgcatgctgatgccggccgctctgctgaccattccgcagtactccatcttccatgccatgcacctgaccaacacgatgctctccatcatcatcccgtgctgcgtctctccgttcggcttcttcctgggccgcgtatacgcgcagacctcagtgccgaacgagctgcttgaggcggcgcgtatcgatggtgcaagcgaagctcgcatcttcttcaccattgtgttgaggattctggctccggcaatggtcacgatcttcctgttcctgttcgtggccacttggaacaacttcctgctgccgttgatgatggtctcttccgacaccttgaagccggtgaccttgggtctgtacggcatggtctctctggctaccttcactgatcgtggcgctctgatgatgggtgctctgctcggtgtgctgcctgtgatcgtgctcttcctcggtctccagcgctactggcaggccggcctcgccgctggtgcggtcaagggctgacgcgttaagcggacagcccggtgggctgtctgtagcgtcggcccgagcgaggcggtagccgagcgaaggcagcattgagtctcgccgtaggcgagtccttaattgcaggggccgaaggcgacgcgttaagcggacagcctaagaccaataattcccgccgtccggtgcctcgtgctactccttccggcgccggacggcttctcaacaataagtagcacgcaaccataccgatccagagccttcctgattcttgtcatgagattgtcggtgaaactgaccgggaagctccggtgatgttcaattcgctcttccggcgttgccgtggggctactctcaaggatttatacagtcaggatcctggacgcccgacggttgtgtcggattcttgttttatatgcatatattgtttacaatttaattatccaaaaaaataatcaatgtcctcaaaggagagactatgactagcaccggccgcttcaccttgcctagcgaggagaattttgcggagaagaccaaggagcttgccgaactgtggggagcagacgccattcgtaactccgatggcacgcatctggatgaggctgtgcttgccttgggcaagaagatttacaatgcgtatttcccgactcgcgcgcataacgagtggattacgctgcatatggatgagacgccacaggtgtatctgctgaccgatcgcattctcgccgaatcggatacggttgatattccgctgatggaaagcttcttcgctgagcagctgaagccgaatcgtgatgccgaccctcacaagtattgggaggttgtagaccgcaccaccggcgaggtcgttgattcggcgaactggacgcttgacgcggacgaggacaccgtgcatgtgagcggcgttgccgcatggcatgagtacacggtgagtttcctggcctacatcatctgggacccggtcgagatgtacaaccatctgaccaacgactggggcgacaaggaacacgagatcccgttcgacatctaccatccggccacccgcaagttcgtgttcgacacgttcgagcagtggcttaaggacagcccgcagaccgatgtggtgcgattcaccacgttcttctaccagttcacgctcctgttcgatgaaaagcgccgcgaaaaggtcgtcgactggtttggttgcgcctgcaccgtaagcccgcgtgcgctggatgatttcgaagccaagtatggctaccgcctgcgcccggaggacttcgtggacggcggtgcctacaactccgcatggcgcgtgcccagaaaagcccagcgcgactggatcgacttcctctccggcttcgtgcgcgaaaacgtcaagcagctcgccgacatgtcccacgccgccggcaaagaggcgatgatgttcctcggcgaccagtggatcggcaccgaaccgtacaaggacggattcgacgaactcggcctggacgccgtggtcggttccatcggcgacggcaccaccacccgcatgatcgccgatattccgggcgtcaagtacaccgaaggccgcttcctgccgtacttcttccccgacacgttctacgagggcaacgatccgagcatcgaaggcctcgacaactggcgcaaggcccgccgcgcgatcctgcgctcgccgatcagccgcatgggctacggcggctacctctccctggccgccaagttcccgaagttcgtggacacggtgacccatatcgccaacgaattccgcgacatccacgaccgcactggtggggtggccgccgaaggtgagctcaacgtggcgattctgaattcctggggcaagatgcgctcctggatggcgttcaccgtggcacacgccctgcccaacaagcagacctactcctactacggcattctggaatccctgtccggcatgcgcgtgaacgtgcggttcatcagcttcgacgacgtactcgcgcatggcatcgatagcgatatcgacgtaatcatcaacggcggcccggtcgacaccgcattcaccggcggcgatgtgtggaccaacccgaagctcgtggaaaccgtgcgcgcctgggtgcgtggcggcggcgcgttcgtgggcgtgggcgagccgagctcggcaccgcgcttccaaacgggccggttcttccagctggccgacgtgattggcgtggacgaggagcgctatcagaccctttcggtggacaagtatttcccgccggtggtgccggaccacttcatcaccgccgatgtgccggtcgacccggcggcccgcgaggcttgggagcaggccggctaccgcatcccgctgagcggctgcggcggcggccagtccatcaagccgttgggcggcatcgatttcggcgaacccgtgctcaacacgtatccggtcaatgaaaacgtgaccctgctgcgcgcggacggcggccaggtacagctcgcgaccaacgattatggcaagggccgcggcgtgtacatctccggcctgccctattcggcggccaacgcccgactgctggaacgcgtgctgttctacgcttcccacaacgaagacaagtatgcggcctggagctcgtccaatccggaatgcgaagtggcacacttccccgagcaagggctgtattgcgtaatcaacaacaccgatcagccgcagaagaccacggtgactttggccgacggcaccaccgaggacttcgacctgcctgacagcggtatcgcctggcgtgaagcctgatcccacgttttggagaacggacccatcatgactgaaagcaatgaagttttattcggcatcgcctcgcattttgcgctggaaggtgccgtgaccggtatcgaaccttacggagacggccacatcaacaccacctatctggtgaccacggacggcccccgctacatcctccagcagatgaacaccagcatcttccccgatacggtgaatctgatgcgcaatgtcgaactggtcacctccactctcaaggctcagggcaaagagacgctggacattgtgcccaccacctcaggcgccacctgggccgagatcgatggcggcgcatggcgcgtctacaagttcatcgaacacaccgtgtcctacaacctcgtgccgaacccggacgtgttccgcgaagccggcagcgcattcggcgacttccagaacttcctgtccgaattcgacgccagccagctgaccgaaaccatcgcccacttccacgacaccccgcatcgtttcgaggacttcaaggccgccctcgccgcggacaagctcggccgcgccgccgcatgccagccggaaatcgacttctatctgagtcacgccgaccagtatgccgtcgtgatggatgggctcagggacggttcgattccgctgcgcgtgacccacaatgacaccaagctcaacaacatcctcatggacgccaccaccggcaaggcgcgtgcgatcatcgatctcgacaccatcatgcccggctccatgctgttcgacttcggcgattccatacgctttggtgcgtccactgctctggaagacgaaaaggacctcagcaaggtgcatttcagcaccgagctgttccgcgcctacacggaaggcttcgtgggcgaactacgcggcagcatcaccgcgcgcgaggccgaactgctgccgttcagcggcaacctgctcaccatggaatgcggcatgcgctttctcgccgactacttggaaggcgatatctactttgccaccaagtaccccgagcataatctggtgcgcacccgcacccagatcaaactcgtgcaggagatggagcagaaggccagcgaaacccgcgccatcgtagccgacatcatggaggctgccaggtgagccgtcagccgaaccatacccgaaccagcatgatggaggcagagcaatgaacgatcagctgaccgaggtatacgccagcatcgacgccctgatcgattatgccttggcccatcttgaccttgacccacgcaacgcagactggacccgcaaccaaatcttcgccctcttccgcctagattcctaccccggacccaaaaccacaacgtcggcggcgtcagtgtcagacgtagtccaagacattgttggcagccgaagccaggccccctatggcgaaaagacccccgaccccctgctcgccgccttccgcgccgccgccacaaccgccggccttttcaagccggaggaaggcccggcctacgccgacaccatcatgggcatcctctccgccaaccccgctgatctcgacgaccgattcctgctcgtcgagcaccgggatggcggcatggccgccatgcaatggttctacgactactgtgtggccaacaattatgtcaagcgtgcccagctcgaccggaacccgcgcttcgactcgcacgggctgacggtgaccatcaacctcgccaaacccgaattcaagaacatgaagaaggcggcggccggcaacgccgtggccggcggctacccgaagtgcacgatctgccatgagaacgagggcttcgccggacgtgacaagcgcacgctgcgcaccttgccggtcacgctcggcggcgagtcatggttctggcagttctcgccctacggctacttcgaccagcacggcatctgcgtgaacaccgaccacacgccgatgcatgtggaccgcgacaccttcggccatctgctcgacttcgtggaccgtttccccggatacttcctcggatgcaacgccgcgctgcctcgcatcggcggctcggtgctcgcccatgaccattaccagggcggcggcgaactgctgccgatgcacaaggccgccacttgggccgccttcacacttgccgactatccggacgccgtggttgaaatccttgactggcccggcaccgccgtgcgcgtggtgtcgaagagtcgccagagcatcatcgacgtatccgacatcatccgcgaggcatgggtcggttatgacgacgcggcgaacggcatcgccagccatgacgcggatggcaaccgccaatccgctctctcgcccagcgcgatcatcaccgaacgcggctatgagatgagtctcatcttccgcaacaatgcgatcagcgacgagtacccggaaggtattttccatgcacaccccgaatactggccggtcaagcaggagccgatcggactgatcgaggcccaaggcttgttcattctgcccggacggctcgtcgaccagctcggcattgtcgaagaggcgctcgccgaaggccgcgatttgcccgatgaagtcagcgaattcagtctcgaatggggcgaactcgctgaaacgttggccggaaaccacgaccgcgaggccatccgccaagccgtacacgacgagctcggcagcgtctgctaccgcatcctcggcaacacggccgtcttcaagcagaaagccaccacgcaaacatttctcgaaagccttggttttgccgctaggtgaaacaggtcaagtgaagtaagctcaatactgaaggaaaaaccgaaggcaagtccttccaaaggagggaatatgactactgttctggttacgggcggtgctggattcatcgccacccacaccgacatcgaactgctcaacaagggctacgacgttatttccgtagataactacggcaactcgtcgcccgtggcgcttgagcgcgtcgagcaaatcaccggcaagccggtcaagcgttatgacggcgacgtgcgcgatgaggcgctcatggaacgcgtcttcgctgaaaacaacatcgactgggtcatccacttcgccggtctcaaggccgtgggcgagtccgtggccaagccgatcgaatactacgacaacaacctgtactccacgcttgtgctgctcaaggtgatgaagaagcacaacgtcaagaagatcatcttctcatcctccgccaccgtgtacggcacgccgaaggaactgccgatcaccgaggagacgccgaccggcggcaccaccaacccgtacggcacctccaagctgttccaggagcagattctgcgcgacgtgcatgtggccgatccgtcctggaccatcgtgctgctgcgctacttcaacccggtcggcgcgcacgagtccggcctgctgggcgaagacccgaagggtattccggcgaacctcaccccgtacgtggccaaggtcgcggtcggcgagctcaaggaagtccaggtctacggcgacgactacgacacgcccgacggcactggtgtgcgtgactacatccacgtggtcgacctggccaagggccacgtggccgtcattgaccacatcgacaaggaaggcgtgttcgtctacaacctgggtactggccacggctactccgtgcttgaggttatcaaggcttacgagaaggccgccggtcatccgattccgtacgcgatcaagccgcgtcgccccggtgacatcgccgcctgctacgccgacgcttccaaggcggagaaggagcttggctggaaggccgagctgaccatcgacgacatggccgcctcctccctcaactggcagaccaagaaccccaacggtttccgcgacgcggagtgatatgagcagatgagctccctctgatgagggagctcatctgtcgtttatcacacaatgcgcctatcggcggcccagcgggtgagctcggtgcgattcgaaagctgaagctttcgcaacaccgagctcacgtgcgtttcgaccgtcttgatcgaaatgaacagttcggccgccacctctttatacgtgtaaccacgcgcgatcagccgcatgacctcctgctcgcgggcggacagccggtccagctcctcatcatgagcccgtgccgcaccatcagcgccgccatcagaccccgccgccggcacaccctggaaggtcgaaagtacaaaaccggccagttttggcgagaacacggcatagccctcatgcacctgcttgatggatgaaatcaaatcagcgccggtaatcgtcttggttacatagccctgggcgccggcgcgaatcaccgaccccacatcctgcggcgcatccgaaaccgacaatgccagaaacacggtagtgggggagtagggccgcgatttggcgaggatctcggcaccgccgccaccctcgccgccgggcacatgcacatccagcaacaccacctgcggcttggtctgtgcgatcatcgccaccgaaccgggcacgtccgccgcttggccgacgatatcgaaggaatcgcgcaacgtggcgattacgcccgcacggaacatctcatggtcatcgaccatggccacacgaatcttggctgtctcgttctcgctcatcgatgttctccctgcgccgctttcagcgcgatcggcatatgcattctgacctcggtgccccagccggccctggacactatctccactgtaccgccgcgccgtttgatgcggccgataatcgattcgcggatgcccagccggtcgggcggaatggcgtccatatcgaagccttcgccatggtcgcgcacgaacacttcaaccatcgtgtcgctggcctcgcaatacaaagacaccggctcgccgccatgcgtgaccgcattgaccaacgcctgacgggtggcgtccagcagcgcatcggtctgggcgctcggccgcgcgtcgcccacggtgaccacctcaatcggcttgccgtgctcgtcctccacctcggcggcgatctgcttcaatccggctcccaccgaacgatccgatgtggaacgttcctgatacagccattcgcgcagctcgcgctcttggctacgcgccagggcgaatacggtggtcggttcctcggagttcagctgaatcagcgccaacgtttgcagcacgccatcatgcagatgggcggtcatgtccgcgcgctcctcttcgcgctccttcaatgcctgctcgtgggtgagtcgttgcagcatcgcgttcgcccacggcatcaccgccaccacgataccgacgatcatcacgaatccgctggcaacaatgcgtcgaggagaggtgccccacccaggaatgctgacattatgcacatacaatgcccatcccatgaaaatcagtgcgatgccgcccaacatagacaacagctgcgtgcctcgcggactaagattcatccatgccagtgcgatgccgcccaaccctaccagcagcggaaacacaatctggacatccgcaccggtgctggtgagcaacagtccagtggccatcaacgcgaaaccggccaatgccacgacggccggtttcggagcacgttggatggcctcggacaatgattccggtgcggcagccgattcgtcgtcatgagcggcaagtggctgattgcctcgcgcaagcggcgcctgattaacgggcactgtgcgagccgcagccgccaccgggtctccggcaggcatgaacacccacaggaatacataagcgatgatgcctgcgccgtagaggacggtcagtgcgatgaacgcaatccgaacccatgccacgccgatgcccaagtgcagggcgatgcccttgcacacgccggtgagccaacggccctgccgggggcgcatcaacggcatgcgcgcgggcagcaatggttcgggagatgacgtcatactcctattgtgccgcgctcagggcgttgcggccggggttttacccggtgttcagggaacaatcagggtgttccccgagcgttgtggcagtggtcgggcggtgtaatggaatcatgagcaatccaaacgcgaatccatatcagccacagccgcagcctggtccgcaaaaaaacaagacatcgcgacgcttcttcacttgggtgcgatccagtggactggttcgcggcgacgaccggtggatcggcggcgtatgcagcggcatcgctttacggcttggctggagccccacattagtacgtgcgttggtgattgtatgtacattgttcttcggttttggcgcagctctgtacgcactcggctggtttctgatgccggatgtacgcgatgggcacatcttggccgaggacctcattgccggccaatgggactggaattgtctgggatgcttcctgttcctcgccgtggcaatcgtgattccaggtgcggggtggggttgtattgcgctcgccgccttagcgctatggctgttggccaaaagcggcattcgccagcaggaagggtacggattcggggcatctgagccgcgaccggtttcacagcctgtgtcatatccagccgcgcaaccagtacctcaatctcctttgtattcagctccgcaaccttttccacaacctgtttcacaacctgtttcacaacctgtttcacaaaccgcgcctagtgtttcacagcctgtttcacagcctgtttcacagcctgtctatcagtcgatgcccagcgtgatgccgggtactgtgcccggcgcgatgcccggcacagtacccaacgggccgtttgcccccgaccgtatgaatgcgacggcctatgcccccaccgagtccaagcgccgcaagccggcgggcccaatcgtggtcttgagcatactgggccttaccttcctctcctttgccggtctgatgggactgatttgggtaaacgacatgggcattatcggcattatgcgtctgggcaccatctggattgccgcagtatgcatagtgatggggctggtggtcatcattctcggattcagaggacggcgtaccggtggtctgattcctctcggactggttgccggtggatgcgcgctctgcatgaccatcgtttcaggcacgtatggcgtgtactaccgtgatcttggtgccagcggcatcaatactgttgtttcactgagccaatctgtcagtgcgagaaacagcgacggcatgaacgatgtgcaaaaggatggcatcttcgttgccgatgccagcgatgccacgtttgaaacattgcagcaaggtgtggcgttcagcggtgaaaactacaacaccgatcaggcaatcattgattggtccgattgggacaagacacatggaccgcacacggtgaagatgctggatggcaaaacttccatcagtaattgcccggtcggtaccatcaccatagccgcaacacaggcgcaagtgcatatcgttctgccggattcctgcacttacgccttcggcaccgccgactcctactactccacttcgagtgacgttggcggcaaatacgagatggtatacaacaactacatgggtccaagctttgttttcttcgaagctgaaagtgccaccaatgggcctgatcacgaatggttgtataaggaatccgccatgccggacaacggcccagaattaaaaatcaatattccctatgtggtggaagcacgtgtcaacgtggtgtacgcctccgattgggaaggctctacgttccagccgcttgccgatatatacgacggcaacagtacaagcaagaacacaaccgaacaatcggaatgatcaagccgttgcaactaggagatggaatcatgactgatgaaaccaaggaattcgcctccatcgaggatgcgacaccgaccacggccataccttccgaaaccgacgcgaccaccgcgaccacaaccatggtgaccgtcgatgaccgaaccgataccacggtgctgccatccgcagcggatgatgacgaaacggctgtgctgcccgtccccgacaatcatgcggatgcgtcggtctcggatgtggatacgcaggcaacagctgcctctccatcgcccatcgaaccaaccacagatcggattgccctggaaacagttgccgatgccgtggagggagatggtgggccgattccatctgccgatgatgtgccgatgtacgcagcatcttcagcacgacctccctatgggcagtctcagaccgccggcaaaccatgccagcctggggggagcgccaagaacgtccagagcgccaagaacgtccagaatgctaaggatgtcaagagtgccaagaacatccagaaacagagcaccagcgcgcctactgtggtattcggactattaggcgtgattatcggcgtgatcgcgctggttttcgggtacatatctccggatcggatgatttcgttgttctcgccgaatccgcaattgctgacggctattatttgcgccgtagtgggactgattctggtaatagtggccgttgtatgggccatagtcggtgccgtcaagaagagaaaatagcgttacaaaccattgcattacggtcccagtagaagcacattatgacgggagccgaccgataagagccgaccgttctatgctgatgggggggggaggcatagtaactatgaagcggatttcggtgcggcgggtagcgagcgtcatcgtcaccgcgatggcgatgacgctggtattcgccacacttggctgggcgatgatgccgcaatggaacacacggccctacaccaagcacatcgttatcgcttctgccgacaccaccatcacccctgcccatgcgaacattccccacgaggggcgatatcgtacgcgtgaaacccgactatccatcaagaccggcgacggcgtcacgctacccgccgtactacgtgaaccggtcggcgctcccgggccacgcccggcttgtctgttcattcacgggtccggtaccagtggtgccgaggatttcggcgatatcgccaacgccatggcctctgccggtatcgtgaccttggtgccggccaagcgcaacgacaactacaccgtgctgcatcgcgactacccgcgttttgctcgcgaatacgggcgttcgctcgacgtgttgcgtggcagaatcggcgtggaccccgccaaaaccggcatctacgccgaatccgaaggcacctggatcgccacgattctaacctcgaaacggcaagacattgcctttgccatacttacatccgcaccggtgttcaatggacgtgagcaaatggccatggctgtcagcgcctatacgcatgaggccggcgcgcccaagcccgtggtcaaagacatggccaaattgatgtcgctggactacgcgccattcgatctggcctatgccgactttgatgccgaccggtatctgaaatccctcaccatgccggtgctggtgaactacggcacctacgatacggccatgcccatcgaacagggggcgcagcggatcatcgccacggccaacaagtccggcaacgagaacgtcaccgtacgctatttcgccggcaaccatcagatgcgggctggtgagggcttattcaccccgaacctgccattggccgaaggctatacgcaagcgctggaaaattgggtgaacggtgtgactgccggaaccaaagccgatggatgggcaacgccccaagtcgccggtgcgacacctcaccagcgcttcgccgcgccgcaacgtaccagatccggtatcgtcggctcgctcggcgtgctggccggtctgatggtggcagggcccgtgctgatcgtgatggcggcgatattaggtattggcttgactgtgttttcttggctacagacgttgctggccgggcgacgtagtgtggcgactgtgcgggccatgcatgcgacgccgagtgggctgggagccgcccaacagcgtacgttgcacggcattgccggcttatctgccggtatcggcacagcggtaatggtgattaccgtgctgttgtatggctatatgagcgccgtaggcgtatcggctgtattggttatgcctcaaccgcggctgtttgccgtcggatgggtggtgctgcgaatagcgaccatgctgttggtggtgctgtttgcttgggaaatggaacgtgtctggtattgccgcgccgatatcgtcggtgtacggcgcgtcatatgcgtgatggtagcgctcggcactctcaccacactgatgacactggcattctggggcctattctcgctgtaattctgccgatgtgcgccggtcaatggggcctggcgggcaagctgcgttggtggtctgggtgtggggcgatcggcagattgcgttggactgggtgtggccggccggcgtacatcagtcggggggccggtacacagtgaatggctgagtattacgcttgggaggcttcggcctcctccaaggtgtcgaaaccgccgagctggaccgtgtgcaacaaggtttcctcagtgatattgcgttgcgggctggctgcggcgcgctcgctaatcatcacctcgtagagctggaaggtccgttcggaatacgtaccaagctcgccgcgcagataggtttcgaatgaggtggcagatggtgtgtcgtcggtggtggtgagtacgcgcatcgcctcgccgagcttggggtagcgctcgcggaaatccttggcccaggcgacctgctgggcgatgacctgttcctgacgggccacgcgctcttcagagagacgcggaatatacggctctatgttcttcgtgaaatcttccggcgcggtggaggccatcatgcggccgtatttttcggtcacgaggttgcggcccacgtggtcggccgcgtcaagatcagcggcatagctggtgagtaatggccgctcccatgtgaggaactgggccagccgcatctggtggaacaccggccagttgccttggcatgccgcgcgtccaccctcattgttggtgcgctggaactgatcccattcatggcgcacaatagcctcgcgcagttcatcatcagtcagttcgttggtcatcgacgttcctttcactaatcctctgatgagggagatggcacggcgaagccgtgacagagggagcttgaatctacaaacttttaagcaccggatcatcagaggcgatgtggtcctcgacatacgggcgctgccattcgaggaaggtctcgccggacgtggtcaggtgttcgcgtttgagttccttgacgatatccgccgcaatctgctccacgatatcgttgattttcttgattgctgtagccgcgcccttgccgccttcgccgaatccggccccgccatagcaggctgccgaactcaatcgcatcacggtttccaactgttcgcccacgttcggcaacagcgcgaacatcgagccagacagcttgcgcaatgctgcgaactgccacttgtaatacggcatatagcccaccaccatcggcacgttaaccaggaacaccaacgaggcggtggcctgcacgaactcgtggatggacagccatgcggccgcgccgtcgccgcgtttcaacgaacgcggcagattatattgaccggcctgggcgatcatgccgagtcgcttggagatcagcgcgagccgcacatcgtcgggcatgttcttgaacccttggcgcgtcttggaaaacagaccggtgggatcggcgaacacctcgccattggtggcggcggccaaggtcgattcctgaagcattagccactcatgcggcgcggtctgcgccggcgcagtgtgatacccggtgatcgactcaaagaagtcaccgatgcggaacacgccgtcacggcgattcgcgccctgtgcgcgcggcgtgacgggggagagcggtgcatcaatcggagtcgtcatcgcttccgccacatcagaggacgccgcgcctgactcggcagtggcggtatcgtgcgtagcggtgccgggggtgggtgcgtttgccgcatcgggtatgacggtggagcctgcacctgcggaggggaatgctccggaagcatcggacctggcctgcgcctcgaacgtcacgcggccttgcgcatccacgctgaacttgcgcggcagtgcctcgtaatcgacctcaagttgctcgccgatcgccgcgtaatcctcatccgtaagccacaggcagaagcgcgggccgaaatcgtggtcctgcgaatacgcatcatcgaatccgtagcattccgagccatgacccaccagaccggcggcgatacgcccggcatactgcggatacttcgccgcaatcatcggcttgcccatctgcgtccagaacgcgcgggccagcttcagtccggacaccgggcatgcggaaacggcctcggccgcgcccgcagaaccggtcgacaccgaaacggtggatggggaagatgccgcgttcgcaccggtcttgccctgtgccgggctgttcggcagccgcgagccggactggggcagcgcgcctgcatcgccggcaacacctgcattgtcaaccgtcaccccggcctgcgccgccgcttcctcggcctgccgcagattgtcggcggtgatacgccagtaatcggtgtccttgccgtaacattcctcgatcacggccagcgcatgccggtatccagtaaccgcatccgcataccgtctctcggcaaagcacacctgcgcgaagcccgccagtgcggaggcataatgcgcggaatgttccagatggccggtgcgatagatttccagcgccttggctgcatgccaatgcgcgtcctccaacttgtgttcggtcagcagggtcaacgccagattcgtgtgcgagctggacacgtcgatatccgcgtccgggttcacgctcgaggcttcgataatgcgcagcgcttcacgcaactccagttccgccttgtcgggccgattcgtctcgctgtagagcatcgacagattgttgtgcagtgctgcgagcctacggtcggtgggcgccagcgaatgccggcagacactctgcgcctgatgatacaaatcctcggcctgatcgtattgtttggccgcgcgcatcgaggtggcgcaattgattagcgtgatggcccacgcctcggatgtgccggtggtcaagcccatacgagcggccagttccagcgctcgctgcacaatccactgattctccttgtgccgaccttgcgagcgatagaagcccatcgtttcgttgagcacggtgagcagtccggcctcgtcgccggcgttttccgcgtccaccatcgcctgttccaagtacgggccggcttcggtggcggccgtgtggcgatcgaaaatcgcgtccagtccgttcaggaattgttgggtatcaaaggttgcgggcgattgatcggcatcgtccgcaacctggttcgccgtggaatcggcaccttgtgctgcggccgccgcatcggtgtcgtcggcatcgtctggaccatgcgcgaattgcgcggcgaattgtttgagcagtgcttcctcatccataccgccagacctccctgaatcgtgtctgatttcagtctattaatactgtgaacaaacacgtcagggagtttgctgtgagcttggtctcagtccaccttggtttcgcgcaagcggtgaatggcgtcggtatcggtttcgcagcgccacgagtagaaggccagcagccctacggcaagcagagccagcggcataccgcccaggccggtatagcgatagttcatcgagaaggtggtgagcatcgcgccgccgacaatcgagccgatggcattgccgaagttaaacgccacctgtacagccgcgccggcgatcagctcgccgccgccctggccggcttcggtcatcagcaattgctgtggagcggaagtaaagaacaatccgatggcgatccagaacgtcagtacagcggtcatcggctgattacccggagtgataagcaccagcaacaagccgaggcaggagatggactgacctattgcggccgcgccggcatgcctccaatggtcggtcagacgacctccaagcagaccgccgatgaccataccaaagccggcaagcatcatcagcatcggcaccagggaagacgaccatccgccggttttctgcagccaaggggagacgtagctccaccagcagaacacaccggcattgccggtgaacacggcggccaaaatcacccacgggccacggcgggtgaggaacttgaactgaccggcgatgcctgcgtccttgatcggtgcaacgtacggaatccacgccgacgccagcacaatcgtcattgccgcccaagcggccaaaatgccgaaggcaagacgccaggaaaggaactcggccatcaaggtgcccgccggtacgccgagcatattggccacggtctgtccggtgaccatcacggatacggcctgcgcctccttgccttcctccgccagagtcttggcgatgagtgtggctgtgccgaagaatgcgccgtgcggcaggccggcgacgaatcgtgcgacgaccagcatggcggcattgacggagaatgcggaagccagattgcccaccaaggcaatcaccataaacaatatgatgaggtccttcggcggcaccttgcggccgaataccagaatcagtgtgccgaagcacacgccgatcgcatacgcggaaatgtaatggcctgcggtggggatgtccacgccggtggcggccgcggcctgcggcagaatgcccatcatcacgaactcggcggcaccgagaatgaacgcgcccgaagccagtgcaagcagactcttcttcatggttcctctaattacttcagtattacttacaaaaacagtgcggcaatcgattgattcgagcgatatattacggtggtccgccaacaaatacgggggcttgccgtgatgtggtttgtcgctgtgtgcggcgggttgtttaccgctgttcgatcgcttggtttgattgttgggacaggaaacgaaaaaccggattgctgatttctcaacaatccggtccagttgtcgggctggcgggatttgaacccgcggcctcttcgtcccgaacgaagcgcgctaccaagctgcgctacagcccgtttggcaacagatgtagatattacattgtggtggtggacaatgcaaatcggcatgtcgcgagtgttgcgtgatggtggattcgccatgtgtacaggtctctcaagccttgtgcagggccggttttgcgtcatgtgagcgggtgttcagatggccgtgcggtctgccgggctcataatcgccggccttgcgtacactgatgaatcatggctgaagttgtcgaaaataccgaaaacactgagaatgaaaccccggccgtcccgcagatgagcaccgtcgaacgtgcggaaatgctgctcaagcaggacgccaccatccgcgagaagatcaagtccggtgccacgctggacgaagccgtggacccctccaacaaggagttcggcccgctggcccaccccgagcaggtgcagatgcgcgtggccaagcgcgcgatgatgcttgaggccggcattgccccctacccggtgcacttggacgtcaccgacaccatcgaggcggttcgcgccaagtatgacggcaagctcgaggctggcgaagagaccgaagacatggtcggcattgctggccgcgtgctgttcctgcgcaacgcgggcggcctgtgcttcgtgcagctgtccgccggtgacggcaccaagattcagggcatgatctccaagaaggagattggcgccgactcgctcaagcagttcaagcagctcgtcgaccttggcgatcacctgtacctcaagggccgcgtcatcgcctccaagaccggcgagctgtccgtattcgccactgagtgggctatcgcctctaaggccctgcagccgctgccggccctgcacaaggacctgaacgaagacacccgcacccgcaagccgtacatcggcatgatcgcggacgagaacatccgcaacatggtgcgcaaccgctccaaggccgtggcctccctgcgccgcacctttgacgaccacgacttcctcgaggtcgaaaccccgatgctgcagaccctgcacggtggcgcggccgcccgcccgttcaccacgcacatgaacgccttcgaccttgacctgtaccttcgcatcgccccggaactgttcctcaagcgctgcctggtcggcggcatcgatcgcgtgttcgaaatcaaccgtgacttccgcaatgagggcgtcgacgccacgcacgcccccgaattcaccatggtcgaggcctaccaggcctatggcacctatgattccatcggccagctggtcaaggagctcgtgcagaagaccgccatggacgtctacggctcgcacaaggtcaccctgctcgacggcaccgaatacgacttcggcggcgaatggaagaccatcagcatgtacgactccctgtccgaatcgttgggcgaggagattgtgccgaacggcggcccggacgcccccggcacctccgttgagcacctgggcgccatcgccgacaagctcggcgtagagcgcgacgacgtggagaaccacggcaagctcgtcgaacacctgtgggagcacttctacgaggacaagctttacgagcccaccttcgtgcgtgacttcccggtcgaaacctccccgctggtcaagggccaccgcaccaagcccggcgtggtggagaagtgggatctctacgtgcgcggcttcgagctggctaccggctactccgagctcaacgacccgatcgtgcagcgtgaacgtttcgtggctcaggccaaggacgcgctcgctggcgacgaagaggcttgcgacatcgatgaggacttcctcgaggctctcggcgtgggcatgcctccggccggcggtatgggtatgggtattgatcgactgcttatcgccttgaccggtgccacgattcgcgagaccatcaccttcccgctggtcaagccgctcgttggctgattaggcatactctggctcccctcagagaggggagccgagttatatatgaaaggattgcttatgtccatcggcttgtgggttcggggcgcgcgtcccaagaccttggccacttccatcgcgtcggtgatggttggggcgacgatggcatacgcgcatatcgagcagtcgggcacctgcatcgcaatatatccagaaccggcctcctgcgccacggcccgtgaacagcagaccctgctgatggaccgattctggccggtgaccatcctgtgcctgctagtcgcgctgttcctgcaaatcgccgtcaactatgcgaacgactattccgacggcatccgcggcactgacgccgggcgtgacatggacgaatcgaaatcaggcaaaccccagcgactgaccgcatccggactggtaccggccaagcatgtactgttcgcggcgatgatttgcgccgccatcgcctgcatatgcggtgttgtggcggtcgtgctcgcccaagcatggtggttgctggccgtgggcgcggcctccttgctggccggctggttctacaccggtggcaagcatccgtatggatacgtcgggctgggagaagtcggcgtgttcctgttcttcggcttggctgcggtattgggcaccgaatacgcgctgtgcggcacggtggacgtcggcggactattgggtgctgtggcggctggcctgttctcctgcctgatcatgatggtgaacaatatccgtgacatcgacgaggatcgtgagcatggtaagtgcacgctggccgtacggctgggtgaatccggcgcgcgtacgctgctgattgtgtgctgcgtggccgcgtgggccatagccctgctcatgtgcgcgaccctatggtggccgtggggcgcagtgctgttgatctcgggcgtcggaatacctgtgcgcatggtctccagcgtgaataaacgtcaattccgcccggctctgcccgccgccagcttccagaccttgctgtttgcggtggtgctggcggtttccgtgacgctctgagagcgaaataataagacgaatactcgtgtttgggcgcacgcggctgtagactgaaccgtatgacttataaactagtactgctccgtcatggacagagcgcatggaataaaactaaccagttcaccggctgggtcgacgtaccgctgaccgagcagggtgaagccgaagccaagcgtggcggcgagctgctcaaggagaagaacgtccttccggacatcgtgttcacctccctgctgcgtcgcgccatcaacaccgccaacatcgctctggatgccgcagatcgtctgtggattccggttcagcgtgactggcgtctcaacgagcgtcactacggcgctctgcagggcaagaacaagaccgagatccgcgaagagtacggcgacgagaagttcatgctgtggcgccgttcttacgccaccccgccgcccgagatcgacccgaacgaccagtacgcccagaacaacgacccgcgctacgccggcgatccggttccggaagccgagtgcctggccaacgttgttgagcgtgtgaagccgtacttcgagtccgctatcgagccggagctcaaggccggcaagaccgtgctgattgctgcccacggcaactccctccgcgccatcgtcaagatgctggacaacctgtctgaggaagagatcgccaaggtcaacatcccgaccgccatcccgctgctctacgagctggacgagaacttcaagccgatcaagccgcgtggcgagtacctggacccggaggctgctgctgccggtgccgccgctgtcgccgctcagggccagaagtgagcctaagccgctaacacggtacaagctgtaaggggagtcgcacataacgtgcggctcccctttgctatgcctgccaaatcccccatggggcggtgattaccccatggggcggtaaaaccctcatggggcggtatgccagaatggcttaattccgcggtttcacatatccttcaaaccgccccatgggcaagttaccgccctatgggtgttttgccgccccatggatacgccggtgtaccgcccaaaagcaacaaaaacggcgtccagccgtagccggatcgccgctttcgggcatcctcctcaaaccacaggagaacaagtgttcagttattcgcccaatgtgagaacaagtcccaatcagtcgatgtcggtgccctcgtcgcgggtcggctccttagtggggtcgaagccggagacgatgtacaccacacggcgggcggcggacacggcgtgatcgccgagacgctccaggaagcggcccagcagcacgatatccacggtctgctgacgggtgatgtcatcggacagcgctagatcgaaggtctggtggtgcagattgtccagcttgtcgtcagccaggatgatggcctcggcggtcttggcatcgcgatcgaagagcatggccaccagctggtcagcggtgttgtccaggaagtcgatcatctcggcgaacaccggttgagcggattcaggaatcgcggcggccggataggtgcggcgagcggcctcggccacgtggcgggcaagatcgcccatacgctcgaacgtggaagccagacgcatggtggaaacgaccacacgcagatcggtggccaccggattctgcttggcgagcaacttgacgcactggtcaatcacagaggactccagggcatcgatttcgatgtcgccgtcaatcacagtctgtgcggcttcaacgtcctgattcagcagggcttccccagctcctttgatcgccttgcgtacgttctgcgccatacggtcgaggtcgtcagcaacctgcttcagctcctcgttgaaaataacgcgcatttctctagcctttcatgcttgcttattgcaacctgtaccagtgtattattccagtacttgttccccacttcaacgtaggtaatggcaacctcaagttgttctactgttcattgggttgttcacctgaaattcatgttaccggcgtgccggcaaaccgcaatcccggcgtgtggtgtgaaagaatgggggcatgacacagatgccgctcgtcgccgcgattgctcttattgtcacggctgttttatttgtggtaggaatcatcacgctcatcgtgggatttgcgacacatcgagtgtccatggaatcgccgctggccgatgatgacgacaatgacgatctgtccgacgacaccgccacgctgctgtccatgctgccaggtgcgtccgtggtggtcgacgagcacgacgaggtggtccgctgcaatcccgccgcctaccgcctgggtgtggtgtcagatgacgccattgcccagcagcatgtgctggatgccattcacgaggcgcgcaagtccggtggcaggcgccagttcgacttgaccaccgatactccggagcggtacgtcgcagaccagaacaagggcgatcacgtcgccacgcagtccgtccaccgccccaactggctgaaggtgactgtagggcgtatcaacgagcagttcgtcatcgtgttgattaccgatgtcagtgatgtgattcgtttcgctcaagtgcgtgactcgtttattaccaatgtgtccgagcaattgttgggccccactgaggctctggccaaactcgccgattcgctggagtccggcaatctggacgaacagcaggtggctgccgacgctcgccaggtgcgttccagctgcagcaagctcaaccacatggtgtctgatttgctgctgctcatacgcgcgcaggagccgattacgccgtcttccgccaaccgactgaacgttatggaacagctcagggccacggcggcgcgactggagccgcaggcagccgaggctggcgtgcagctgaacatcaagggcgacgatgatctagtcatcaatggtgaggcggaccagatcgacagcgccgtgaccaagctcatcgaaaacgccatcggctattccaaggaaaatggcgtggtcagcgtgtccgcatccaaagacaaggatggcgaccgcgcggtgattcgcgtgattgaccaaggcacgggcatcgctaagaaggaccaggcgcgcatcttcgagcggttctaccggggcgtggaacagagcaatcgcacggcggatggcgtgggcctaggcttggccatcgtcaagcatgtggcgctgacccatcatggcgatgtgaccgtatggagcgcgcccgggcaaggcagtacgttcagccttacgttgccgttggcgcagtgaggtaaggaattggtggcatgccttgcatgccaccaatgctgtttgatgagcgacctgcggccgcggtctctccctcaatcagctacgctgacagctcccgtcatcagagggagcttgtgatgcgttactgtccgaggcggcggtagtcccagcggtcgaagtattcccaaatcagcagtagcaagccaataatgacaccggccacgcacataatcaccaacggcattacgctgtagcccacggccagcagaatcagcacgacaatcaacgccacaatccatagaccggtaccgatggcaaacaccttacgcaggtccacccgtacgggcttgggcgcgggtttgcggacggcagggtcaatgagaggcgcgaacttcatactcatgcactgtagtaagagtagggaggggcgtcaaacacctctccctacgatttattcaatcggtatcggttgagaccgatcaatgtgcatggcatatatggtcggccatgcgaggcatagaccgccatcacaggtgctcgaccacatagtcgacgcacttggtgaaggccatgacatcagccggttccaccgaggggaacacgccaacgcgcagctggttgcggcccagcttgcggtagccggcggcgtccacgatgccgttctctcgcaggatggacagtatctgggaggcctggacgcgctcgtccagatcaatggtgaccacggcgttcgagcgggcgtccgcatcgacgacgaacggagcggcgtattcggagcgctcggcccacgagtacaggatggatgcggacttggcgcaacgcgtggtggcccaggcgaggccgccgttgctgttgagccagcgaatctggttttccatcatgatcagggtggccacggcgggcgtattcagggtctgatccttgcgggagttgttcagtgccgtggtcagcgagaggaacggcggcacccagcgatgtgcgccttccagatgagcgcttgattcgacgcatgccgcacgatcgatggcttcgggggagaggatggcgacccacagaccgccatcggcaccgaaggccttctgcggtgagaagtagtagacgtcggtctggctgatgtccacgggcaaagcgccggctgcgctggtgccgtcgatgacggtcagggcaccggcttcacgactgccgggcacgcggcgaatcggggcggccacgccagtggaggtctcgttgtgagcccagcaatatgtgtccacgcccttggtgagctcaggcagacggtaagtgcccggctcgccggggaacagcaccgggtcttcaaggaagggtgcgttcgcggcagacgcggcgaacttggcactgaacgagccatacgtgccgaatgcggcgcgacgggtgatcagcgaagcgcaggcaatctcccagaacgcgctggcgccaccgttgccaagcgccacctcatacccttcaggcaggtggaagaactcgcgcagaccttcacgaatcgaagcgaccagttgcttgactggtgcctggcgatgtgatgtgccaagcagggtggtggcgccggcatcgagcgcggcgatctgttcggggcggattttgctgggaccggagccgaagcgaccatcttcgggcttcagcgactcgggaatactcagtgcgatagtcatggtttcaagggtagaccagtgttggggaatatcgcggataatgctcggtgtgcgggattgctgcggggctactgcggaattccggggtgccgggcggtagtagcggcaatgcggaatgcagtgcagaatgtacgcagcacatcatggatacggtgtgtcggaatgacatgagttagtgattcttccgataaccggatagtgaggttcgtgaacgggcggaaacaaggcagtttttcaccctgccgcacggttacgtaaatcgtttgacatgcccggatggtgggggatcgcattgaggattgacctctgttcgttgtacagtactcaattgtgccggtcatacggggtcgttgaaaggaccccgccgaacccatccaaggagttaacgtagtatgaagcatgcttcgcataaagcgaccacggtctcgcgccagaagttcagcttagcgaaggcattgtttgcctccggcaagggttctcattccgttcgtgccgtgcgcgcggtgcaatccgctggcagcgacgccgttgttttggggcttgatccggccattgccgagaagatcaatgaaatcgctccccagactcgtcgttccattcgtgaggccgctcgtgccgctgaacgccgtagccatattcttgcctcggcctcactggccgctctggtcggcacggccgcaggtgctctcgcattttccaacaataaagacgccacgaactcgttcgtggctgatccggccacgacgaccacgcagattaagcgcatcagcgatgtgactgcggcttctcgttccgaagcacgtactgatctgagttcatcctccgttaccgcacagtccaccaatgaaggcggttgggggctgagcaattcagacagcaccttggacgccaagctgatgaatcgcaataatgcgaacaatcctgtggtgtcggctctcatggatgccgatggcgatgctgtgccggctggcttcaacccgaaccatgccgttggcaccaactccaacaactatccgtggggtcagtgcacgtggtacgcgtaccagcgtcgtgccgaactgggactgccttccagcggcaacttcggcaatggtggcgagtgggcggcgtcagcttccgctctgggctattgggtggacaacactcctcgccatgtcggtgatgctgtggtgttcgctcctggccaggccaatgccgatggcacatacggccatgttgccgttctggaaaagatcaatgccgacggctccattgagatctccgaatccaatgccaagggattgggtgtgatttcgacccgtacgttcagcgccgccgaagccggtaagttccagtacgtccactactgattcatttcattggcttacattcggtgattactgttcggatgtgacgtcgccctatcggcaatcgttcgcgcgaaatgacatttcaagtgttgcgaccgcgtattagtccgaactgacctgtgccgacacgccgatatatcccaatagctccggggtgttttatttcttccatcctgtacgagttaatgcgcaccgtgtaaggtgatggttctatgaagaccaaaactgtagcttcttccattgttgccgcgattgtctcctgtgcttgctcgtttatgtttgttcctacagcaactgcagctgagggtgttactgtgacttccaccaagtccttcccctcgtacacccaggtgcgcaaagatctgacgactgaagccactgccacgagcgttgaggacaatgctgattggggcggcattgagaacctcgatgtgccgcagacggaatctcaggcggaaaaggatgccgcagcggccaagaaggctgccgaagaggaggccgagaagcaggcggaggtcgaggctcaggcgacccaggagcaggccaacgccgcgagccgtaatgagtctcgctcttctgttacttattccgatgccagtggttcggtttccgctggtgccggtgcctctatcgaccgtgcgtattctttgatcggacagagcatggactgcaccgcattggtcagtcaagcgttggcggcccgtggcattaacttccacggttggcctgaagagtacgtcaatgttcctggtggccacgtagtcacagacggatccctgcagccgggcgatattctgatttatgccaacaccggtggatggaacggtggtgcacactacgatcatgtggcgttgtatgtcggcaacggtcaggcggtccatggtggatggaatggctatagcgtggctctcgctagtgccatgaccgaaaagctcaccatcgtggtgcgtatcccgtgatgcagtcttattgattgatttattgcaggcctcggatgccgatcggtatccgaggcctgttgcgttctcctgccgaatgatgcacccgcgacatcatcttcgaaatgctattcctgttatgaaatcgacccatgtgtgctagtgtatggcgttgatgatgagcgttaagactattatttccacatcagtggcgattatcgccacgggtgccatgtttgcgtgcgtagccccgtttgcctctgccgattccgcgcagacgagtgctgtggtgtcctcacgttctttcccgaaggcgagttcggtgaagaagaatttgttcgccgaatccacctccacctcggttgatgagaactctaaatggggtggcatcgagactcttgatgtgccacagaccgagtctcagggcgagaaggaagctgctgcagcggcggcggctcagaaagccgctgatgaagctgctgcagcccagtccgctgctgctgcggcagccagccgctctgaacagcgtgcgtcgattccacaggttgacttgggtaaaatgactggcactggcactggcgctgagcttgctagcttctcactgaagttccaaggctatccgtatgttgccggcggcaacactccggcaggatgggattgctccggttttgtgcagtacgtcttctcccagtttggcatctccctgcctcgtacctctggtgctcaagccaccgtgggtactccggtcgcaagcttggcggatgccaagccgggtgacattcttgcgaatggtactcatgcggccatttacatcggtaacggacaggtgatgaatgctatgaacccggtgcagggaacggcagtaagcgacgtttccgtattcggtggagctggatattccattcgccgcgtgatgtgacaagaattatgcggtaagcgaattcgtattaaggcacgtcctttggggtgtgcctttttcgtatacgcggatttctttttgagcggaggataccggccaaaccgagtgtcgcggggtattgttgagatacgcggtattcgtgccgcaataacttcaaggaggtcgtcatgattaacgacaaggctattctcgtcggcgttgacgggtcgcatgccagttacaaggcaacatggtgggccgcgaattatgcaaagcacgcggggctgacgctgcagattgtctgcgcatattccctgccgagctatgccgccgtttcgttcgatgccacttacacggcgatgggggacgataacgccgcgcattccgatgctcaggagattctgtccaaggccaaggccatcgcagacgagcagggcgtcgaagccgccacactgattgttaccggagatccggcatcggtgttcgtcgaattgtctcgtaactacaatctgatcgtcattggcaaccgtggcaagggcggtctggccgagcgcctgctgggcactacgtcctcatcgctgccggcatatgcttactgcccgattgtggtggtgccgtacaccgatgatgacggtaacctgatgcacctgaacaacacgatcaccaaggtggccgtcggctccgacgaatccaagtggggtctgaaggcgctggacattgccgccgacttcgccacgtgctggggtgcggaactggacgtgatttccgctgtgccgaacctgaagggtgtggacggcgaggacgccgtcatggagtcctacaaggacgatcttgaggtgcgcatcaagccgttgcaggaatcgcatcctgatctgaagatcaacaagcagatcgtttccggcccggccgtgagcgccctgaccaaggccagctacgatcacgatgtggttgttgtcggctcccgtggtcgcggcggcttcactggcttgctgctgggctccaccagccagggcctgctgcagcatgcggtcggcccggtgtacgtggtgccacgcaagtatgttgaggccgcggaatcgcgtctcgacaccgtgccgagctcgcccgccgaagtgcctaccaagtcgctggaggagattgccggcgtcgaggagattccggtgtccgcagccgagcctgaagtcgcccagcagatcgaaaagaccatcgatcccgatcgccagtaaagtccgaatatacggaaagaggctcccgccagggagcctcttcaatttatatcccgtctcagtgcttgacggtgacgttcatgcgcaccggggtctcctgcacgtaggtgtgcttgaccgtgcaacccttgtcgatatggcgggtgacgcgctccttgagcttgtcggcatcctcctcggacagaccggcgtcggaagcatcaatcaccacctgctcctcgaaaccggtgtaggcgtcattttccgggtcgtacgtgccatccaccacaatcttggcacccttgccctcacccagcgtatgttcgatggcgaactggctggacagcgcggcgcaaccggccagcgcgaccttcatcagatcgcccggcgtgaactggccacgatccttgccgaacttaatgtgtgcgccatcgtcgctgaacgcatcccacgaaccgtccttgttacgctcaacccacagtcgcttacccatagctgctcctttattttcagccgccggcgatctggcccatcgccatgccagcgggggagcgcggcacctggccgctctcccgcatcagtggacttctctattatgccccctaagctacactggtgcacatggctttgaccgaagaacaactcgcagatattcgctcccgtatccccgcacgtcccgaaacggacattccgatgccctatgaggacctggtgcgcaagatcctgaccgaaggcacgctgaagtccgatcgcaccggcaccggcacgatttccctgttcggccagcagatgcgctttgacctgtcgaagtacttcccgttgctgaccaccaagaccgtgttcttcaaaggcctggcctatgagctgctgtggtttttgaagggttcctccaacatcaactggctgctggagcacaacgtgcatatttgggatgagtgggcggacgagaacggcgatctgggcccggtctatggcgtgcagtggcgttcctggcccgcgccgacccccgaggacccgaatcgcaccatcgaccagatctccaatgtgctcgacctcatcaagcatcatccggattcgcgccgcatgatcgtctccgcgtggaatccggccgaggtggagaagatggcgttgccgccctgccacgcgctcttccagttctacgtggccgacgacaagctaagctgccagctgtaccagcgttcctgcgacatgttcctcggcgtgccgttcaatatcgcctcctactcgctgctcaccatgatgatggcgcagcaggccgggctcaagccgggcgaattcgtctggaccggcggcgactgccatgtttacgacaaccacgtcgaccagttccttgagcagctgggccgcaagccctacccgtacccgaccatcgagatccgtaaggccgattccctgttcgactaccagtatgaggacttcaaggtcgtcggctaccagcatcaccccactattaaggcacctgttgcggtctgatgctgattaccgtttcgtggacagcgaatactgtgaaggtgacggcccccgagtcttcgctgtccactacactaaggcccagttccgcaatccaggaggagtaagcgaaatggagcatgacagtagccgtagcggctatcacgaacccgagcccggatctgccgggctgtctgccactgaagaagactggggtgacgattatcccaagaccttctcggtgaatcttatctgggccgaagcccgtgacaaggaaggtcgcgccggtgccatcggcctcaatggtggcatgccttggcactgtgccgaggatatgaagcatttcaaggagctgaccgtctcccatccggtgattatgggtcgtaagacctgggaatcgctggggggcaagtaccggccgctgcccaaccgcgacaacatcgtcgtttcccacgatccgatgtaccgtgcgccgggggccactgtggtcaccagtcttgacgacgcgctcgatatggcccgtcaggaggcgattccggacgacggtctggaccgttcggagatttggatcctcggcggcgcccagttgttcgccaaggctttgccgttcgcggacaaagcctatgtgactgatctggccgccaccgtggatgccgacagctacgcgcccgatatggcgtcgctggtcgaggccgggatgtggcgggaagccgaagtgggcgagtggcatacgcccgccaaggaggagtccggcatcgattcctatcgtttccgtatcttggccaaaaccaagtaagcatgcgaatccggcttatgccctttatagcggcatgagccggattcatattcattcgaccccaacaatacagtcgggccgtgtgcggcccggtgaagcccgattgaggattgattcaaagctatgagcaatacccagccctacaccgtaatgaccgtctgcaccggcaatatctgccgttcgcctatgggtgagatcattctgcgtcacttctttaatgagcgcggtcttggcgaccaggtgaacgtggaatccagcggtgtgtccgacgaggagtggagccacccgatcgacccgcgtgccgtgcgcgtgctacgcgaacgtggctatggtgatgagattccgcgtgaccacttcgcacaccgcatctcgcgtgaggaaatcgaccgtaccgacctgttcctgccgatgaccgcctcccacatgcgcgccctgctgcgcatgctgccggccggcaagcgcgccgaagtgcacatgtaccgcagcttcgacccgaatctgcccaagccgaagcccggccgcgaagatcagatcgatctggtggacccgtggtacggcggcaagcacgagttcgaggtcgccatcgaccagattgaggaagtcgccccgtacatcgtcgattgggtggcgaagcagctgtaggaatcggcctgtggccgatgctgtgtgtttcgcagtcttacgactgcgggtctctacctccgtcaccgcttcgcggtgccgcctccctcgtcagaggaaggtacagaagattacctccctctgtaagggaggtgctgagcatagcgaagcggagggagagactaacgagtcgggtgcctcagaacaccagttgcaccagcaacatatatacaattgtgccgccggcgattgaaagcagcatattgcgtttccatacgtgcagcagcacgatgacggtgcaggcgatgagttccggaaggccgtgtgaaccggtcagaatcggggtgttgcgcagtgcgtataccaccagtagaccggtcatcgcatagggcaggacctggccgaaatactcgatgatgcgcggcggctgcttggactcgggaaacaccagaaacggcagaaaacgggtgcacatcgtgcccagcaccaccgtcacgatagtgattgcgccttgccagatggtcatcgtcatcgcgtctgtccttccttctgctggtccgctgcgtggctcatggcatggtctgccgtggcttccggggcgtcggcggccggccgcaacacgtccagatgcgggcgtagcgcgacgaacagtatcagcatggcgatcattgagggaatcatgaaatcattggccccgaatatcagcaggcaggccagtgatgtcagcacaccgatgacggcggacagtcgctcgcgatgcttgccgtcgagccactgatcgaggaagatcaccagaaacagcgcggtcagtacgaaatcaagaccgtcggtattgaacggcagatgcgcgccgatcagcccgcccagtgtggcgccggtcacccaatacagctgattgcacagcgtaacccagaagtagaaccagccacggtcgatgccggcggggattttcgcggtggagttgatggcaaaagtctcgtcgcacataccgaaaatcaggtatgggcgcttccagccgagccctttgaatttgccgagcatggatagtccataaaacaggtgacgggcgttgaccatcagggccagcagaaagccggcgagcgggttgaacgcggagagcagcagattcaccgtgacgaattccattgaaccggcgaagatgaacgcgctcatacacatcggccatacgaaggagaagcctttggtgcccatgagaatgccatacgaggcgccgagaaacaggaaccccaggcaaatcggtatggtcagcggaaacgccgctttgagcgccggcagccaggcgttggtgttggtgttggcggtgtctgccatgtggatgatgttctccttgtacaactggtctgccggccgatgttcgccgatgatgccatatgcggttatacacgcatggtgtcgataaacggggtgagggtggcgtcgggaccctgtgcgcgaagtcacagtgtggaggatgtcacatcgtctacggtgggatagtccttgtggcgggcgcgaacacgtgctgagatgaaaccatgagcacatatcaagcgggccgaatgctttcagacctggtcccgcgaatacgaaaagacctcggtcgctatgaccggggtctttagtgaagtacccccagagagagtcgaaccctcgttgtcagattgaaagtctggtgtcctaaccgttagacgatgggggcgaacaactcgaattactttacgggaggttgttcggttatgcaaatcgacggcatttcggcgtgtcgcaatcagttcagggtaacggcctgataggtgaagtcatgaatcacgcggccggcggccaggcccttcttctcgaagttggtgagcacgcggccctcgaatcgctcggattcggtgaagtcggcgtgcggcatatcggcggccatgtcggcattgcccttgcccacgtgctccagcggcaggctgacggttacgctgcccaggttcttccagccatcgaggccgtccatcacctcgtgcacgtgcagggcatagtcctcgatgtcggtggcgatacgccagacgccgtctgtgaccagcgcgcgatgaatgtcgccggccatggccttctgcacgatgcggcgcttgtggtgcttcttcttgggccaagggtcggggaagaaggtccatacctcggccacggtgccggccgcggtcaccttgaacagctcgggcgcattgacctgggccacgcgaatgttggtcagcccctgcttgccggcgagcagcagcgtgtgggccacgccggggtcatagacctctagagcaaggaagttcgtctccgggtgggctgcggctgctgccaccacgttttctccctgcccggtgccgatttccacaatgagcggattatcgttgccccatgcggactccacgaacgcgcggtcgagcgtgacgccttcgcgcacgtccagcaggttgccggccgcaatatccaacagatatgtgccggcatagttgtcccatgcgcgctgcaggcgatcgtccaaacgtccggagcggcgtacgaaggagagcaccttgtgcagggggtgcgccggtgcctcggtgtggtctgtgcccatcgcggcgacgggatcgattgctgtggattcgggattggtcatatattcctcggattttccttgtgcgccgcaccgctgttcattcattaggtcgatttggcgttcattaggtaggtggtgtgcgataccaaccaccatatcaagccgtttacccggtgtccgtgcgggccggctccgggccgacctacctaatgaacgccaaatcgacctaatgaatgcagatattgccggacgacaccaccgttttgtgcgattatgttcgtgtgatatactcaaattgtttcaaaaggtaacaaagcggaccaaaagtgaacagccgctgaactccccacggccgacgctttgcaacccgcacaaggaaaggtcaactatgacagttctcgtcaccggcggctgcggctacatcggcgctcatgtcgttcacgcactccatcaggccggcgaaaaggtcgttgtcgtcgacgatctgagctacggcaagcccactcgcatcgaagactcccgcctgtacggcatggatatcgccgccccgggcgccggtgagcgtttggccgaaatcctcgatgccgaaggcgtcgactccgtgatccactttgccgctcgcaagcaggtcggcgaatccgtggagaagccgctgtggtactaccagcagaacatcaacggcatgctcaacgtgctcaccggcatgacccagtccaagaacgccaagaagctcgtcttctcctcttccgccgccacctatggtgtgccgccggtcgatgtggtgcctgaggacgtcgtcccgatgctgccgatcaacccctacggccagaccaagctgttcggcgagtggatggcacgcgcctgcgagcagccgttcggcatccgcttctgcgcgctgcgctacttcaacgtggccggctgcggtccggtggagcttgaggatccggccatcctgaacctcatcccgatgctgttcaatcgcctcaagcagggcaaggctcccgccatcttcggcgacgactacccgactccggacggcacctgcgtgcgcgactacatccacgtctccgacttggccgacgcccacatcgccgccctcaagtacctcgaccgtgacgagcgcaagtacgacgccttcaacgtcggcaccggcgaaggcacctccgtgcgccagatcgtcgacgaagtcaagaaggtcaccggtctgccgttcaccgaggctgtcatggcccgccgcgccggcgacccgccgcacctgatcggctccccgaagcgcatcaacgaggagatgggctggcatgccaagtacgacgtggaagacatcgtcaagtccgcgtgggatgcctggcaggccaaccccgaacaccacatcgacgtcgacacctggaagcaggctgactgagattgacggtcactttgcggtggatgccgcgaagcgtttccgtccataagggcgtggccggggttccggtcgcgcccttcgtcgttttgtggatgtttgtgacagacgtgttcgcgtgctggtgatagcaaaaaccttgaaattatgcggaacacgccgaagtttgcatgactggcgaatttcagtaatatatacatctgttgcctcacgcaagtgagaacaatggccccgtagctcagttggttagagcgccgccctgtcacggcggaggtcaccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggccccgtagctcagttggttagagcgccgccctgtcacggcggaggtcaccggttcaagtccggccggggtcgctggaatggttatgaagcccggattatccgggtttttgactgttcatggctctgtagctcagttggtagagcgagcgactgaaaatcgctaggtcaacggatcgacgccgttcggagccaccataatgaagccccgccttgtgcggggcttttgcatatccgtcgcgtacctactccggcgggggttataggccaaaatggcgggctggccggtcaatgcaaaggctcgcgttcgccaacaactgtcttcctcgccgcaactacgcacgccaacagcaccaatgcgaacatcgatccgaacagcaacccggtcttaagactgtcgccattggcagaggccaccagtcccactacggcagggccgccggcgcatccgaggtcgccggccacggctagtagcgcgaacatcagcgtaccgccaccgggcatggcgtctgcagccatcgagaacgttccgggccacataatacccactgaaaaaccggtgagcgcacaggcaagcagacccagtaccggtgccgtggttagggctgcggtcagatacatggccacgcacagtacggaactgctgacaatgaatgccgtgagatccagtcgatgccccagcactccgtaaatcgtgcgggacaggcccatcatcagggcgaatgcggcaggtcccgccaagtcgccaatcaccttggtcacgcccagaccggactcggcgaacgcgctggcccactggctcatgccctgttcggccgcgcccgcgcacagcatcataaggaacatcaggtagaacaccggcttcttcgacaagtcggcgaaccgcatggtcgccgtgccttccggcacaatgcgcggcatgggagcgccagcgaacatcgcgatgccgatggcaggcacaatcgcccacaagcaagcgagaaccggccatgagccggtgccgaacgcaaacagaaacagcgtggagatggccacggtgccgagctggccccagcagtagaaggagtgcagcaggctcatcgccttggccttgtgttcgctcgggcaggcctcgacgatggggggagaccatgacctcgatgagtccgccgccgagcgcgtagaggaaaatcgccgccagaatcgcgagatacgggtccggcacgcgggtggggagcaagcccaacgccagcagtccggcaagggcggccaggtgggcggcgataatgcacggcttgtatccgatgcggtccacgaacttgccggccagcacgtccacgaccagttgggtgacgaagttgacggtgatgagggcggaaagccgcgccatgtcgatgccgagtgtcgccgcgaacgtgacgaacagcaacggcatgaagttattgattaccgcctgagtgatgtatcccacgaagcaggcggtgacagtgtggttgtagttcggggctgtggcgctcatagagtcagtattgcagaaaaagcacccgcgaaatgcgcgtgcgaagagaatcgtgtgggacggcagatgaacaatggtaaaaaccgcgtgccgtcccacaaaaaggaatcaggcctgccaccattggcgcagggggtaccacttgccgtccgggtgggccacgcgatccggcttgacggccaagaactggtgaatctggatgccgtcgagctcgaagttcagagcgcaggcggccaatgtacataccccataccttggcgcgttcaaagccgacctgcttgaccgcgtcgtcccaatgctcggagaggttctggttccagtgatgcagggtgagcgcgtagtgctggcgcaggttctcctgatgcaccacgttgaagccggcgtcatggatgcacgattcgatgaagccgggcgcgccgagatcaccgtccgggaagatgtaacggtcgaggaattcgtcggtaccgggcttgccgtgaggcttgtcatggctgatggtgatctggtggttcagcagtcggcccatcggcttcagaaggcggaacatctcttcgaagtagctctggtagttcttgacgcctacgtgctccatcatgccgatcgagcagataccgtcgaagtcgtgctcaggcacctcgcggtagtcctgcacacgcacttcggccagatcctgcagcccttcacgggcgatccattcgttggcgtacgcggcctgttccttggaaagggtgacgccgagcgccttgatgccgcgacgggcggcggtgatgaccatcgaaccccagccgcagccgatgtccagtaagcgctggccgggctgcaagtccagtttgtcgagaatcaggcgcagtttgttggcctgtgcgtcttcaaggctcatgtgttcgttgtcgaataccgcgcaagtgtaggtcatggaggatccaaggaagtcggcgtagaactcgttggacatgtcgtagtggaagctgacggtttccgaatcggccttttcggtgtgcggcatcaggccacgcttgatacgggcgaacttgctcgggccctcggtggcgggcaccggcggcttcttgaagccatggctcaggatgccggcagatacgcgggcaattgatgtgggagtgagtgggcgaacgtatttggacagcgacaccagcttgcgcatcgccggatacgggtcggcgtagtcaatgccgtccacgtcgaaatcgcccagaatgtatgagcgcacgatgccgatttcattcgggtgcgcgagtagctggtacatgcagttcggcgtggcgattttgaccttcaaatccgcgtctgccgggccgaaatgcgagccgtcgaaagcgtcgatacgaacgggagtggcggggtcgagaaacagggacgccatctcgccgaccgtcatagccttgccatttgccattatctacctcattctcttatgatgatcaccccaactgtcgaggtatcttagtcctcttcaggagactgaaaccgttgaatacaccatctggtgaaccagttcgcgttcggctgatgaagcacgaatggaattaggcatctcgcatattgattgcgctacgcgcgaagtaagcggatgagagacgagtttctcggagagcgtcagatgactccggaaaatggtcttatcgttgagatttcgggcgatggaactggtttggtcaatggacaataattcgacaagtgcggaattccgccatttcttgccattattttcagtgttgttctttcagcgtgttttcaggtgaatgctcatgcgcggagtagactggggaaccgttggaccactcaaagacagagtggaccaccagttaagacactagctcaaaaggagagcccctatggtgtaccgcatgattttcaaccagactgcatacttcggacgtggcgcgatcaaggagattccggccgtcgccaagcagcacggcttcaccaaggcatttatcgtcaccgacccggtgctgctggagaccggcaccgccgagaaggtcaccaaggttctggatgaggccggcctgccgtacgaggtgttctccaacgtcaagccgaacccgccggtcgagtgcatcaaggacggcgtcgccaagttcgccgagtccggtgcggacttcctgatcggcctgggcggtggctccccgcaagacacctgcaagggcatcggcatcatcaccgccaacccggagttcgccgacgtgctttctctggaaggcgtcgcggataccaagaacccgtccgtcccgatcttcggcgtgccgaccaccgccggcaccgcctcggagacgaccatcaactacgtggtcaccgacacggccaacaagcgcaagttcgtggctgtcgacccgcacgacatcccgatcgtcgctttcgtggacccggatctgaccgactcgatgccgcgcggcctgaaggtcgccaccggacttgacgccctgacccacgccatcgagggttacattaccccgggtgcctggagcctgtccgactgcctgtccatgcagaccatccgcatgattgccaagaacctggccaagtccgccgacggcgacattccggccggcgagcagatggcctacgcgtcctacatcaccggtatggcctactccaacgtgggcctcggtctggtgcacggcatggctcacccgctgggcggccgtctgggcgtggcccacggtgtggccaacggtattctgctggccccggtcatggaatacaacaaggacttcaccggtgagaagtaccgtgacatcgccgatgcgttcggtgttgaggacgcctacaccggcgacctggagaaggtgcgcgaagaggccgtgcaggccgtccacaagctgaccgtggatctgaagaacccgaccacgatttccgaagtgggcgccaccgaggccgaccttgagccgctggctcacgatgccttcaacgacgtgtgcacccccggcaacccgcgtcaggcaaccgaagaggacatcctcgcgatttacaagtcgctgatgtgatcagtcgatgacagtaagcattagctcccttatcagagggagcttgcataagcagagggggctcgtatatctagctacttttcgtgcttttcgtcgtagacttcgtcggtgggggtctcgtcgtacagctgcttgccttgcgcctccgccagttccatctgctcgttgatccacgcggcttcagccggattgatatccgcggaattcagcactttctgccacaccgggtagaacatgtgcatcgccggatacatggcggtgaacaacacctccggcttatgcgtgcgcgtatgttgcggatgcgcatcaaacgtattcttaaaacgtcgcatgtagctcaggaacgaactcaacgacgtatccatccgtcgcgcactcatcgcggcgatcatgcgcggcgagtacacggttttcagatccttgcccatcagatgcagggaaatatcgatatcctcatgcatcacatcggccttatcccggcagacctcattcgcaatctgatgccaggccgaagcgcgcaaggccatattcgagccgaacagcagcggctggccgccatcggcgcggtagattcgcttgcgcaaggaattgtcgcccttcaacccaaaatggcgtgagggcatgtcgtaatacatcaccggaccagtggcacccatcgcggccgggtcttcggtgaagatgccggagaccacctccacccagtcaggccggatcatacagtcggcgtcaaaacggcccagcacatcgccggtcgcggcgttcaggccaaagttgcgggtgggaatcagcccctgttcatcgttctggtgcaacagtttgaccggggcctcgggatgttcggcaatgaactgttcgacaaccgcacaggtgttgtccgtagaacgattgtccaccaccagcacctcatgcggcatgatggtctgacgggtggcgttcagcaggcagtcgcggatgcgttcggcttcgttccacgctgggatgatgatcgaaacgttgagcataacatcaacaatagaaaagcgggtgtacgccgccggcgtatccgagcttcaaacccctcgctacaatggggagccatgagcgaacgcgtgcgaaacgtaaacagcaccgacacgtcgagaaccggtgccgcagaggccggggcagacccggacgacgagaatcgtatcgactttggtactttgttccccgccaagggagattcccgtaggccaccggaatggttcggccgcgcgctgctgtatgtggcccttgccgtcatcgtattcatgttctgctggcgctcgtggggcgacatctcctatctagtgctcgacatcatcatctcgctgttcctggcgctggccgtcgaaccgttggtggtggcgctggtggctcatggctggaagcgtggcgtggcttccgccgtcagcttggtgggcgtggccgtggtcgtgggtgtgctgctcacgctatttggcaacatgttcgtacagcagatgattgccatggtccgcggtttgccggccatgtatgagcagattcgtgagttcgtggaccagtatgccacgttcaagatgccggaaatcagcaatctcggcatggaaatcttcaacaatatccagacctcgtgggtcaccgattttgccggtaccgccatgagtacggtgggcggcctgttctccttcctgctgaacctcatgaccgtggtcatgaccacgtattacatctccgccgccggccccaaactgcgccgctccttctgccagtggctggcccccaacacgcagcgccgattcctgctggtgtggaccgtggcccaaggccagatttcgtccttcctgttctcccgttcgattctggcgttgatcaacgccacctgcactgccatcttcttagagattctgcatgtgccctactggctgccgttggccctgttctgcggcgtggtatcccagttcatccccacggtcggcacctatatcggcggcgcgctgccggtgctgttcgcttggggcaaccgcggatggacgtacgccgtggcggtgctggtgttcatcatcgtctaccagcagatcgagaacctgattctctcgccgaggatttcgcagcgcacgatggatatcaacgcggccgtcgccttcctcgcggtgctggcgttcggctcgctgttcggcgcgtttggcgcgttcctggcgctgccggtcaccgcatcgctgcaggccatcttccgtgcgtacaccaagcgctatgagctgattgactcaccactgatgaacgatccgactccggagaagaagtccaagatcgtcgaggcgtccgaagcgttcggcgagcatgtgctgcagccgatcggcgagcacatgccgcgtgcggccaaggggtccaccagccgtgtgccgatgaatgaggaactgcgtttgctgcaggaacagatctatgcgattccgccacacgagacgaaagaatccgatttggacgattccgccactgtggcgattccgcagcgtggtgccgcggatacgcagcagtctgagcagcccaagcaacgcaagcaaaccaagcagtctgatcaatctgcctccagcaatcctagggcggggtggcgctgatgaccctgctttccgtactcgatatttttctggtaatcgtcggtggtgccggcatgatatatcagggactgtgcatcgtgatgtccctgttcgccaagcccgtgcgcttccccgacgccccgatgaccaaccggtatgccgtactgatctccgcgcgcaacgaagaaaacgtgatcggcaaccttattgggtcgattcgcgatcagacctacccgtccgacctcatcgacatctggctggtggccgacaactgcaccgacaacaccgccgacgtggtgcggtctttgggctgccatgtggtggaacgccacaatcttgaactggttggcaagggatatgcgctgacgtatctgttggggcatatgctcgacatcggtgtggccgatgattatgaggcctacttcgtgttcgatgccgataacaagctggacaagcactacttcgaggaaatgaacaaggcgttctgctccggattcaagattctgaccagctaccgtaattcggtgaatctggcggataactgggtgtcttctggttctgcgctgtggttcatccgtgaatcgcgattcctgtctaactcgcgtatgattctcggttcctcttgccatgtgggcggtacgggattcatgttctcccgcgaggtgatgaagcggaacaagggatggaagttccacctgctcactgaagatcttgaattcactatggattcgattctgcatggcgaccgcatcggctattgcggtactgcgatcctctacgacgagcagccggttaccttctcgcaaagttggcgtcagcgtttgcgttggagcaagggattcctgcaggtattccgttattatggctcggcattgctgaaacgcgcggttcgcgaacgtgatttctcctgcatcgacttcaccttgatgctgtgtccgtttaccgtgttgggcgtgattcgcgcggtgatgggcttgctgttcgccgcgtgtggcttcgtgagttggtcgagccagctgcaatcgctggccggttggtccagcggcatcatcacatcggtgttgggcctgatggcattggctgcattgaccatcattgtcgagcacgaccagatcggtgccacgaacaaggagctgctcgcctatgtgctcagcttcccgatttacatgctcagctacgtgccgatttccttccaggccatcttcgccaaagcccagtggaagcccatcgcacataagggctgaccgagtccgctagtccggagctgctcagcggggcaatccaacagcaacccgggggtgctgcgctgagggttgactggtgggttagagtagatgcatgagcttagacaatactcaaaggaatgtcggatttcagccgccgatgatgccagccgccgctcccgcgtcttcgcagtcgcaacagccacagccgcaagcatggccgccgaacccgaatacggcggtgtccattcgcggcctgttcaagcacttcgaccggaagatcgccgtcaacgggctcgcgcttgacattccaatcggctcgttctacggactggtgggccctaacggcgccggcaaaaccaccacgctcaatatggtgaccggtctattggtgccggacgccggcaccgccatgattctgggccatgacgtgtggagcgacgtgaacacggccaagcgcatgatcggcgtcatgccccagcccgaccagatcttcgaccgactgaccggtttgcaattgctcgtctactccggcatgctgcgcggcatgagccgcgaggagaccacgcgtcgcgcccaggacctgctcaatgctttcgacttggccggggccgccaacacgatggtcaccgattactcggccggcatgaccaagaagatctgcctggcctccgcgatgattcacagcccgcgcattctggtcttggatgagccgtttgaatccgtggacccggtgtccagcgccaacctcaaagacattctcatcgaatacgcgaagactggcggcacggtgatcatctcctcacacgtgatggcattggtcgaaaagatgtgtacgcatgtggccgtaatcaacgacggtctggtatgcgcggccggcacggtggacgaggtcgctgctggcgaagaactcgaagaccgcttcctgcaactagtcggtggccgccacgaagccgcccatctcgcgtggctcgatggcgggcaggcccaagcccaagcaccaacttcggcccagacgattcagccgattctgcctacgcccgccacacccaccgatgaggcccgccgatgatcagcagcgccatcaccctggtccgcctgcgctggacgctcacgctcgccaccctgcgaaaatcggcgtggcagaccgtcgcctatgtcttttccgctgtactcgcggccggcaccatcatcggcaccggcgtgctcgcatggttcatcggcatactgccgcccttcaccgtgaacgcggatggctttccgctgaacatccttggtcccggaggcatcgtcaacatagtcgtcgtgctggtcggcgcgaccatgaccatcttcatcggcttcatccagctcatgatgcttggcgaaggctccaccatgaacccacgcaaattcgcgatctacggcatcgccgaccgcaacctgcaattcggcttgctgctttccggcctgtccggcatcccctcccttactggcgtggcctcactgatgctctggacactggcctatcggcatatgggaccagccgtaatcatcagttccctcctcgccgcagtgctggccgtcatcaccatgatgagcatctccaaactggtcatcgccctatccaccacgctggtgaccagcaaacgcggcaaaggcgcgttctacatcttcatcgtgctgactttcgtcatcatctgccagttgccgaacattctggtcaactccggcatagccttcagcctcaacaccgagacctggggcgcggcgaccgccatcgccgcatggacgccgttcggtgcggccttccaactgccgttcgacgcgcttaccggagcttgggcggtgctgatcgcccgcatcgccatccttgccgtcacatggatcgtctgcttcgccgtatgcacttggtgtctgaggcatgaacggctcaccatcggcgcaaacagtccgtccgagaccgccaaaggcatcggcgcattcgcatggatgcccgattcggcatccggcgcggtgtccgcacgcctgatcacctatctcaaacgagacccccgccaagccatgaccttcgccatgccggtcctgttcctgatcatcttcgccttccaggcgcacggcatcagcgcggtcgtctggcagtcgctgatctggtgtggctggttcatgtcagtggtggaaagcaacgggctcgcatatgacggccgcggcttcaccatggaagtcatcgccggcgtgcgtggccggaccgacagaatcggccgcgtgcgcgtctacgtcggcatcatggtcgtctacatggtgctgctctatctcgccggcatcgtgctggtcggcgcactgaccggccgctgggcgcagcccgatgacctcgtcaccggcctgatcttcctcgccacgggcatgggcatcgccttgagcggactgggcgtggccgaagtcacctcctgtgtactgatgtacccggtcgcctcaatggacaagccgttctccgcgcctcaaggccgcgccatggcccaaggcttcttcccgttcgtctacatgcttggcagcctgctgctcatgctgcccactggcatcgtggcgctggtcatgctgctgacaggagccgaaggcgtcatgtggctggcgattattccggtcgcgctggccaatggcatcggcattctggcactcgggacatggctgggcggtaagctgatggatgcgcgaatgctctcgattgtggcaacactcgactcgttcgcctcattgcagaaatgattgccttggcataaggagcacgatggtatctacagcggtatcacgccgtcagcgacgtgaagcgcaacggcggacccaacgatcgcatcgccgaacactgaccgtcatcatttccgcactgaccaccatcgccctgttcgcggggtactgcgccgccgacatcaccgacgtggcccccggattgttgacgttaaaacctgtcaccgcacctgtttttgccgatccggccaccgccaaatcaggcggcaccatcgccggtgccctgaacgcgaacaaggccattgattccacggccgcttctgcactggtcaacgaattgctgtccgcgcaaggcgtgggaaacgatacgtcggtgatcattgaagacgcccaaggcaccgtcgctgccgaacatgagtcgaacactccacgcgagcctgcatccacactgaaaacgctgaccgcgctcgccgcctcatccaccctgaacatggcatccaccttggatacccaagtgttcctgacccaatccgatgacggcaccaatacgttgaccctcaaaggcaatggcgacatgctgctgtctgcaggcgattccgacgcaaaccataccaacggacgtgccggtctgaacaccttggccaaggccaccgtggccgcgctcgcccagcgaggcatcacttccgtcaatctcgagtacgacgacaccctattcggcgactcacgcattcccgcaggtctgtcggaaggcggcgcggtcttaagcgactacaccgtctacttcacgccggtctcatcaatggcgattgatggaggccgccaatacaccgccgatacgcctgcgccggccgaccctgatgattcggccggatacccggaactgtcccagcacaccgccagcgacgtggccacgaaattcgccgaactgctccaatcgaacggtgtggccgttaccggagacgtgacggcaaacaccgctccatccggcgaaacgcctttggcctcggtgagttcggcaacactgtccgaaatcatggcatacacgttgcggcattcggacaatacgctggccgaggagttcggtagactcaccgccttggcgaaatcagcgacaaacagtcctgaaggcggcacggaagcggtcaaatccactctgaacgatctcggtctcgacacatccggtctgaccatggccgattgctccggcctgtctcccggctcccggctcaccgtacgcacgctggcggccgtccaacaacgtaatctgaccaccgagagcggtgctgctggtgcggaaggtctatccatcgcggggttggtgggcacggcgcaggatcggtatacggatgatgccgtggccggtctgctgcgcgtcaaaaccggcagcctcggcacggtcacgtcgatggccggcaatgtgtcccgcaccaatgggggagcgttgtcgtttgccgtggtggtcaacaatcctgaggattatgccgccgcgcgtagcgccatcgactcgtttatcaccaagctcgcggggctgtaaaagaggcatcaagggccatcaagggctataaaggccgtaaacgtccataaacgcacgagtgcctataaccagaaaaaaggtggtgagtacatggcatattccgcacgattgcgcaaggccgtaggcgcggtccgcgcaacgctgagtgccgtggaactatgcgatgtgcaggctcccgaattcgcgcagcatggggaccatgccgttgccgccgatgcgccgctcgtgctcgtggcctgttcaggcgggcgcgattcgatggcactggctgcggtgagccatatcgtatgcacgtccatgggcgtgcgttgcggtgccgtgattgtggatcacggcttgcaggcaggctccgaacaggtcgccagcgaggccgcggatcgttgccacgcgttgggactgggcccggtcatcatgcgcaacgcaaccgtacaggcgcgcggcgagggcctcgaagcggccgcacggcaggcccggtatgacgagctgtgcgccgcggcgcatgaatcgggtgccattgccgtgctgttggcccacactatggacgatcaggcggaaaccgtattgattggcctgctgcgcagtcgaggcgtggatgcgttggctggcatgccgcaggtcttcacacgcagtggcgcgacttttgcgcggccactgcttacccttactcgagccgaaaccaccggcatctgtgaagacttaggtgtggaatattgggatgaccccaccaatggcgatgcggtagacggcgagttgccgaacgactatccgttgcgctcgcgggtgcgtcacgacctgctgccggccatcgaacgattcgctggattcaatgtcacccgccatttcgccgaaagcgcacggttggccagaatggataaggagtatctggatcagcgatccgacgaggtgatgggggaggcggttgcggcagttgattggccggcatcgtcggcagctgtatcgaccgatgcgccacgagcctgtgtggcaggcgataccaacgattcgagccatggcatcggcctgatgatcagcgtcaaacgtattgcacgtgagccagaggcgattcggttgcgggtcatcgctcacgcgctgagccaagccggtgtgaacgccagtgctgcccagattgccgccatcgaccggctggtcgtcgattggcatgggcaaggcggcgtctcacttcccagaggttattcagccaatcgcaagaaacacgtcattcgcgtgtgccaagatggagcgcatgcgaatcgctgacgttgaggaagatattgaccacgagctggtcagcaaagaacagattgatgccaagatccacgagatggctgctctcgcgagcgaggattaccgcgataagaatccgctgctcgttgcggtgctgaaaggggccgtgaatacgctggtcgcgttcacccaggccatgagcattcctgtacagatcgacttcatgagcctgtcgagctatggctcgggcacagtgtcgagcggtgaggtcacagtcaggcaggatttgtccgccgatgttcgcggacggcacattttgattgtggaggatattgttgattcaggacgcacgctcgcgtggctggtcgcagaactgaaacgtcgtggtgccgcttccgtggaggtcttcgctttgctgagcaagccttcccgccgagaagtggacgttgatgtgaagtacgccggctatgagattccggacgagttcgtcgtcggcttcggcctcgactttgacgaacgctaccgcaacctcgattcgatcgcggtcctcaagccgtccgtctaccaaggagtgcaagcatgagcttcccgcaagggccgggtaacggcaataatccgaacccgaacaacaaccgtaacaacggcaacccgttcaccaacccgttcaaccgtggcaataacgggaacaatggcaaaggcaacaacaacgagaaccgcccgatatggcagtccccttggctgtggggtgccgtgctcgtggtcatggttgtgctgatgttccagatgttcgccggcggtggcaccaaaaccatcgatactaaagatggtttcgcgctgatcaatcagggcaaggccacctacgccgagatcacggacaacaagcaggtcgtccgccttgagctgaagaacgactacaccaagaaaaacgccgacaccggcaaggtgaccaactacggcaagaacgtgcagttctactacaccttcgcgcagggcgcacaggtggccaaggccgtggagaacggcgatctcgaaaagggctggacctcgaatatcgagcagaccagcatgatgagctacctcatcacctcgatcctgccgttcatcatcttcttcgccctgttctggttcctgatgagccgcatgggcggtgccggcggcatgctcggcatgggcggcaagaagaacagcggcaagctgcccgacggccagacccccaccaccaagttcgccgatgtggccggcgaagacgaggccgtggccgaagtcgaggagatcaaggacttcctcaaggatccgtccaagtacaaggcgctgggtgcgcgcatcccgcgcggcgtgctgctgtacggtcctcccggcacgggtaagacgttgctggcccgagccatcgcaggtgaggccggcgtgccgttctactcgatggccggctccgacttcgtcgaaatgtttgtgggtctcggtgcctcccgtgtgcgtgacctgttcgatgaggccaagaagaacgcccccgccatcatcttcatcgatgaaatcgatgctgtgggccgcaagcgtggctccggcatgggcggtggccacgacgagcgcgagcagacgctgaaccagctgctcgtcgagatggatggtttcgacaacgacaccaacctcatcatcatcgccgccaccaaccgccctgacgtgcttgaccccgctctgctgcgtccgggtcgattcgaccgtcaggtgggcgtggccgcccctgatctggaaggccgtgaggcaattctgagggtgcatgccaagggcaagccgttcgtaccggacgtcgacctgcacatggtcgccgtgcgcacgccgggcttcaccggtgccgatctggccaacgtgctcaacgaagccgcgttgctgtgcgcccgtgccggtgcccagttgatcgacaaccgcgccatcgacgaggccatcgaccgcgttcaggccggaccgaagcgcaagtccaagggcatggctctggaagagctgcgcaacaccgcataccacgagggtgggcatgcgctggtagccgccgccctgaacaacaccgacccggtgaccaaggtgacgattctgccgcgaggccgcgccctcggctacaccgccgtcatgccgacctccgaccgctactcgcagtcgcgcaaccagctgctcgaccagatggcctacgcgatgggcggtcgcaccgccgaggaaatcgtcttccacgacccgaccaccggtgcctcgaacgatatcgagaaggctacgaacatcgcccgtacgatggtgatcgaatacggcttctccgacaagctcggtgccatcaagtggggttccgacgatgaccagaccactgtgatggacggtctgcagccgcgcaagtactccgatcgcaccgccgaagtgattgatgacgaggtgctcaagctggtggagaccgcgcacaccgaggcgtggaccatcatcaacgacaaccgcgagattcttgacgagctggtccgccagctgttggtcaaggagaccctgaacgagaaggaacttgcggcgatcttcgcgccgatcaagaaggctccggttcgtccggtgtggctgtccaacgaccgtcgccccgactcggacaagccgccggtggagattcccgaaagccttaagcgctcggtcggcatgaagccggaagagtagacacgatgacgattcggcccgacctgttcatgtggtttctcacgtacgcaggccggaccgacgtcgttgtggacaatgacaagggagagatgagatgaacgaatatatagagtcttgccatcgggagaaacgcacatacgacgaggaaggcgtgcgcgaggccgtacgtctgttcctgaagtcgattggcgaggatcccgagcgcgagggactggtggaaacgcctgaccgtatcgcccgcgcgtgccgcgagctgttcgccggtctgcaggcttccccggccgatgtgctggagaagcacttcgacgtggataccgacgaactggtgctggtcaaggacatcgaactgtattcggtgtgcgagcatcacctgctgccgttccacggcgtggcccatgtgggctatattcccgccaaggacggggtgatggggctgagcaagctcgcccgactggtcgaggtgtatgctcgccggccgcaggtgcaggagcgtttgacccagcagatcgccgacgcgctggtcgagtatgcgggcgcacgtggtgtgattgtggtgaccgaatgcgagcacctgtgcatgtctatgcgcggcatcaagaagtcttccgcccgcacggtgacctctgcggtgcgcggtctgctacgcaaccccgccacccgagccgaagccatgagcctcattttggataaatagtgtctactaagctccctcatcatagggagctcacttgggacctacatagaaggggaaacataatgactgatttgcaggcgttgcatgacactacgcacaccatggtgatgggtgtgctcaacatcaccgaggattcgtcctcggacggcggcctgtggttggacccggccaaggcggcacagcacgggcgcgacatgatggccgccggcgcggacatcatcgacatcggcgccgaatccacgcgccccggcgccaagcgcgtgtctgaggccgacgaattggtccgcatcaccggtgccgtcaagacattgattccggccggtgccatattgtccatcgacaccacgcgcgcatccgtggccgccgctgcgctgagcgagggcgcccagatcatcaacgacgtttccggtggcacgctggatgccgaactgccgcatgtggtcgccgaccacgactgcctgtacatcgtgcagcattggcgcggttggctcgccggttccaagggcgcgaaccccgatcaagacacctccgtctacgagcacggtgtattgaccgacgtacacgacgaactcatgcgccaagtcgacggtgtgctggccgccggcgtaaagcctgagcgcattatcatcgacccgggcctgggcttctccaagcccggcatcgagcacaacctgccgctgctgaccggactcgagaccttccgagccaccggatatccggtgctgatcggccagtcccgcaaacgcttcatctcggcgatgcttaccgaggcgggcgctgccggtgctgatgggccgatcatggcccagcgcgatgacgtgaccgcagccttgtccgccctgtccgccgaacacggcgcatgggccgtgcgcgtacacgacgtggccaaaagccgagccgccgtcatcgccggcaacacctggcgcgaatacgcatgattcccctggctccctgttttggttgcttctaggccttggctcccctcgggcgaggggagctggcgccgaaggcgactgaggggagcatttgagcagaaagccttaccaatggacaccatcacacttaccggcgtacatgccaacggcacccacggtgtgctcgccttcgaacacgaacggccacaaaccttcgtcgtggatgtcaccctgcaccttgatctggccgcagccggtcaatccgacgatctcaacgacaccatcgattacggccgtgtggccaaggatatcgcggctgtcatcgaaggccctcatgtggacctgatcgagcgtctggcccaacgtatcgcggataagattcttgccgatgcgccggccgtcgcctccatcgacgtcaccgtgcacaagcctcacgcacccatcgtcgtggcttttgcagatgtatcggtctccatctcgcgcgtgcgtgccaccgataatggacgtactgctgaagagcatgccatccataacgcggtggtggccttgggcggcaatgtgggcgaggtggaatccaccttgcgagccgccgttcgggagattgacgcgttgcctggcacacaggtgactggtatctcaccgctttaccgcacggccgcgtggggcatggccgacggtacgccggatttcctgaacgccgtggtggagcttgaaaccacaatgggcagccacgaattgctcgccgcgttgcaaaacatcgaagcgaaccatggacgaattcgtgagaatcattgggattccaggccgttggacttggacattatcgactttgatggcatcaccagcgcggatccggatctggcattgccccatccgcgtgcttggcagcgtgcgtttgtgctggctccctgggcggcgctgaatccgaacgccaaactcgccggagcccatgaggggcctgtagccgatttgctggccgccgcaccggaccgtaacgccgtgcaactcgagagcgaagactggatgctcggcgggcatgcagtcaagcaaaaatcagcgtcggggtcggcacccgtctcacgcaaggcgattatttcgctggattccacctcgcaggatgtcgaacggctgttccgcgaaaccatcgtttccatcgacagtgttcctggcaatcaggtacagggcatctcgccgctctaccatgtcagccatttcgacggcccggacgcgatgagcgcggtcatccaaatcgaaaccaagttgccgcccgccgacctgattgccgtattgggcagcatcgaaagcgttcatgacctggcagtcgaccttgaccttgttgacatggaaggcgtgacttccgacgagcccaactgcagcattccttggccgtcggcccgtaaccatgcgtcggtattggcaccttggctggatatggacccgaatgcttctctgggcggcgacccggtggccttccttttggccatggcaccggatgccggacaggtcggattgctatcggacaactggatactgtcgaatagttgagctgatggcggaaccagttacgaacggtaggctagaaaccagacggtgacggaccagtctccggcctcgagcagccaggcacggcaatgacgaaaaaacaaatcaagatgaacggccaaagcgcgaaggccgttcgcaaacagcaaacagcaacgcaacgataaggaggccggacatgaaaacacggcgaacaccatggtggcagtatgtgatcggtgccgtgttgggcctgttggcgggtatcggtctggcctcctacggcgaaagctcgggactgtcgctgattggtgcgccttggattgtgcccggattgctggccgtactgggcgttattgtgctgatcttggccctgcaagtgcataaatacgcgaataccgaccccaagaagcgtccgcatagcttcatcaatcccactatcgcggtgtatacgctggtgttggcaaaggcactgggattggcgggcgcaacgctcgccggctggtatggcggtcagattgtgatgagcctgagccatatcgaggcggatttctatgcacacgccgtcaccgagtgcgcaatcgcggccgtggtgtgcatcgccgacatgatcatcggcattatcggcgaatggttgtgccagctaccgccgaacgaaggccccgaaaacccgaaaatcagggaagccaagcgccgtagcgacatagcccaagcctacaagcggtaggggtgactattcctacggcacgcgcaccatagcttcctgagcgatggccgccaccaagtcgccattctgcgcatacactttggcaatgccgagtccgcgtccgtgcgcggcgataggcgtatcctgcacatacaaatgccattcgttgatatcgatatcctgataccaccacatcgaatggtcgatggacgcataggaaatgcccggtgtggaaatcgacagtccggcgcggcgcagcaccggctccatcatcacctgatcgcagccaagcgccagcatcgcacgatgcatgacctgcggcacatcgacgtggccatcggccttcatccacaccatctgcttgccggaatcatgctcggcggaatccttgtccgcgcgcagcatcacggtcggcgtcacgtggcggatatcgaacggcgatttctcggcatagtaattggcgaacggcgacttctcggcgaacggctgcatgagttctttggcggaagtcaacgtttcgggatcgggcaggttttccggcatcggatcggcaaattccacaccctcttggccggtctcctggaaagaggcgatggccgtgagaatcgacccctcggcttgggtgacgttgacccgacgagcggagaacgagcggccgtcgcgaaggttctcgacgtcaaacaacaggtcttgacgaatatcgccggcggcaatgaaatagccatgtaccgaatgcggcaggcgtgaagggcccactgttttggacgcggcgatcaccgactgggcgatgacctggccaccgtagacgcggccggtggggaagtacatactctcgccattgatatatgtgtgattgcggtaagcggaaggctcgcccaacttcagcaccttcaccagatggtccaatggagttacggtggttgcctgagccatggcgttcctcgattcttgttctgctgtgttcagtattcggttatcgtattccaacctatggttggcagtctatccggtgggggttaagagttccgggagcgaaatgtaacgagactgtttggaaggtaaacggtgggttatgcggcgcattgccgctacgttgctgctgcgctgccggtgtgttgccgtaggcgactgtgggattttatgggatgcggggcgggcagccatggggcaattatggggaaagccgcccctgagggacggctttcgacgtataaagcgcgttgtggcactaatgccggcgtatctcagccgcgcacaagcttcttgtgcaggcggtgcgggcgggccgcatcctcgccgaggcgtgtcaccttgttctcctggtaggcctggaagttgccttcgaaccagtaccacttggccgggttgtcgtcgtcgccttcccacgcgaggatatgcgtggcgacacggtcgaggaaccaacggtcgtgggaaatcaccacagcgcagccagggaattcgagcagcgcgttttcgagggattccaaggtctcgacgtccagatcgttggtgggctcgtcgagcagcagcaggttgccgccctgcttcagggtcagggccaggttcagacggttgcgctcaccaccggacagcacaccagtcagcttctgctgatcggcgcccttgaagccgaagctggccacataggcgcgggtcggcacctccacaccggccacctcgatgaagtcgaggccgccggacacggcttcccacaggttcttgttcggatccaggccctcacggttctggtccacgtagctgattttgacggtgtcgccgatcttcagctcgccgctggtcagcggctccaggcccacgatggtcttgaacagcgtggacttacccacgccgttcgggccgattacgccgacgatgccgttgcgcggcagcgtgaaggacaggtcgtcgatgagcacacgctcgccgaaggccttgtggatgtggttggcttccagcacggtggaacccaggcgcgggccggccggaatctgaatctcggagaagtcgagcttcttgttgttgcgtgcctcgttttccatctggtcgtaacgctccagacgggccttgttcttggcctgacgggccttgggggaggagcgcacccagtcgagctcgttcttcagtcgcttggcgagcttggcgtccttggctccctggatctccagacgcttggccttggtctccaagtaggtggagtagttgcccttgtacgggtacaggtggccgcggtcgacctcgcaaatccattcggccacattgtccatgaagtaacgatcgtgggtgacggcgatgactgcgcccttgtactggtgcaggaactgttccagccacaggatggactcggcgtccaggtggttggtgggctcgtcgagcagcagcaggtccggggcctcaagcagcagcttgcacagggccacacggcggcgctcgccaccggagcacacgttgaccggggtgtccgggtccgggcactgcagggcgtccattgcctgctcgagctgggagtcgaggtcccagccgtcggcggcgtcgatctcggtctgcagcttgcccatctcttccatcagggcgtcgaagtcggcgtccggattggccatctcctcaccgatttcattgaatcgggcgaccttctcggcaatcgggccgaacgccatcttgatgttctcgcccacggtcttggtgtcgtccagcggcggctcttgctgcaggatgccgaccgtgaagcccggggtcaggctggcctcgccgttgctcacggtctccaggccggccatgatcttgagcagggtggacttacccatgccgttcgggcccacgacgccgatctttgcgccgggcaggaagctcagggtcacgtcatcgagaatcacgcggtcgccgtaagacttgcgggccttgatcatctgaaatacgaattctgccatgttgtgcagttactccttaaaaaggggttgaaattccgctgtttctttagtctttagtttgtgatggatacgctgtgtgcagcgcggagcacgcccccgaatcacggatcgcggtgcgccgcgtcaggcctgtgccgccctgtccgcataacgatcgaatccacgccaaaccaccgcccaccatggtatcggaagggctggaatggcgggcgtcgctatggcttggaggggtaatggatgggcctgacattgccgtggcgcgacgcgccgggcggcgcgccgtggtccagtgatgctgtagtatatcctcttgtgcttcattgaggtacagatggccccgtagctcagttggttagagcgccgccctgtcacggcggaggtcaccggttcaagtccggccggggtcgccaccaagctcctgacaaatgtcaggagcttttttgttcttttgccgtatttcgtggtgtagggcgaaatatggggttataggccaaaatgtgtgtctggtgtttagtcgtttgatggccattcgactctggcatggaagctgtttcagtcgatgccgatgccgtatcgcatggaaataccgaaggtttcgtgctggccttggggctctgctcgacacgccgatagtctgaatgacaacgtttgctattgaatgacaacgttagcgttaacagtgcttataaatggtgaaaaacgtgtgcagggtcacattggcagaacgtgcgcgagatatgacaaatcatgaaaaatacgctatgggaggtcatggcaactcgttactattttcgctgtctcgtacgccacacaagccttcaaggagtaagccatgaccacgctcgccattgatatcggaggaactaagatcgccgccgccgtctgcgatgaaaacgatagcatcatccagcgctggcgcgtccccacgccgatggatgccgacgccatcaaccagcacatcgccgaggtgtaccgcgaggctgtggccgccggacacaccgatatcgaggccatcggcatctccgccgccggcaacgtgagcgccgaccgcaagacgctcaccttctccgccaacatcccggcctggatcaactacgacctgtccgagcacgtcggcgcgctgatcgaccatgccgtgccggtcgttgtcgagaacgacgccaactgcgccggctggggcgaatacgtgcacggtgccggccagggcagctccaacatggtcgcgctgaccgtgggcaccggcctcggcggtgccatcgtgatcaacggccagctctaccgcggctccttcggcatggccgccgagctcggccacctgccgatggtcccggacggcgaccactgcggctgcggcctgcgcggctgcgccgagcgctacacctcgggcacttcgctggagaacttcgccaagtccgccgtgcgccgtcgtcctcaggacgccaagcgtcttctggaactgtgcagcggcgacatcaccaaactggaggggccgatggtgtcccaagcggctcaggaaggtgacgtacttggcctgtatgcgttcggcaagatcggcgaatggctgggccgcaccatggccgccgtttccgccgtgcttgacccggacctgttcgtgatcggcggcggcgtggtggccgtgggcgacatcctgctggagccggcccgctacaactaccagcgtttcctggaaggcagcgcctaccgcggccatgccaagatcgtcgccgccaccgccggccaggatgccggtctgatcggcgcggccaacctggctctgcgctgacgatgtcgctccggcaacgggacgttagtctaatggtgagtcatggccggtgccatggctcactgccgcgctgatagtgcggtcgatgagtttccgctgcctgaccatggaatcgaattccgggttctcagcgatttcctcgtactcgtgttcggtggtcacgccggcgatttcggcgataatctcctcataggacgtttcgacggttcgatgcacgccggtgacgtgcccctgacgtatcacgacaatgcggtcggataccgcgaacacatccggcagatcgtggcagaccatcaccacggaccggccttcggagcgcagtctcttgatatatgcgagcacttccgccgactgcatcaccgacagtgcggtggtcggttcgtccagcagaataagctgcgggtcattgagcagcgtgcgtgctatggccacggtctggcgctggccgacggataaggatgcgataggggagccgacccgaatcgccgagctcagggtcttcagcacggaacgggcacgcgagttcatcgaatcgtcatcgcgtatgccaatctgattgatctccttgccgaggaacaggttcgaggccacgtccaggttgtcgcagaactcctgcctctggaacaccgatgcgatgcccatgcggtccgcctccctgatcgagggaatggtcacctgttcgccgttgagatagatatggccgaatcccggctgcagaaatcccgcgatgaccttgatcagagtggactttcctgcgccgttatcgcccacgatggcgacgacctcctggcgttggatggacagattcaccgatttcaacgcctcgacgaagccgaacttcacacagatgtcctccagccgcagcagaggaggtgtgctcgaattcctcatggtgtgttccttcttctcactcttctcctggtaccggtcactggctgacgtcattgcgaaccgagaactcgatggcgcataatgcgccgcctagcgcgcagttgtcgttcgggtgggatgacacaagtacatcgatgggtgccacggcatcagggaacagcatgcgctgcaacgcttcattgaacggttggatgaatacgtcgccggtcatggccagcttgccgccgagcacaatgacctccggatccacgctgatgcacagatcagccgccacctgaccgatacgcacggccgtgtcggcgatgatgcgacggcaaccggggtcgccttcgttggcaaaggacaccagatcatccagcgtcatattgccgtgtgtgacgctgagcaactgcaccagcctgttttccgccacgacggtgtcaaggcagccgcggttaccgcacgaacagatggcacccagcgggtcgacctggatatggccgatttcaccggccaggccggtcacgccatgcatgatttcgccgttgatgacgatgcctgcgccaaccccgtcgttggctgagatatatacgaaattgcgtttgcctgccgccacgcccatacgggattcgccgtatgccgcgaaattcgcgtcattatcgacgtatacgggaacgttgaacgccgtgcgcaacggggccgtgatatcgacgccgtcccatccgggcagaatgccgggaatcgctatggtgtggtcgctggtggccaccggtgcggccacggccacgccgatgccgaccagctcgctggcttcggcgtcgatgctgctcagggtctcattgatgagcagcatggcgcgttccagcgttgtgtccgccttgtggcccaacggcagggggagcgtgtgctcagcgatgattgacttcgagaagtcaacgatagaaagcgtaagatgacgtcgcgcgatccaaagcccgacgccgaggccctgatgccgtgcaagggtcaccagagtggctctgcgaccgttgcgaacggtgtttttggtctccagctggtcttcgtcgacaagctgatggacgagcgtggacacggtcgcagtggacagtcctgtcacctctgccagttcgacctgtgtcatggcgccgaacttgtggatgctggccagcaagttggcgcggtttgcctcgcgaagcgaggtctgcgaaccgaaaagccttgttgccataagagttcagtgtagtcgttaccagcatgaggcacagcgaggcgcagagcgtggatttttcggcgtgtcgccttgtgatgcgcgaaaaatcgccattgcgttcattggttgaacataaacgacaggaaattcgctttcttgagtttgacaacttaactcaatacggtattctatgagatgaacctgaggttattcccaggttcgggcgaccaaggagggttcgccatcccctcgaagatgaaggagaacaaatgaagttcactaagaagatcgtcgccgtggtggcaggcgttgccatgtgcgcgggcctcgcggcctgcggtggcagccgtagcggccaggcaactggcggtgatgccaagatcgaaaagggcgccactatcggcatttcgatgccgaccaagtccgaagagcgttggaacaaggacggcaacaacctgaaggccaagctggagaaggccggatacaaggtcatcctgtccttcgccgacgataagccggcccagcagaacgctgacatcgagaacatggtcaacaacgacgccaagatcgtcgtggtcgcttccaaggacggcaccgcagtgggccccgccgttgagaaggcccgcgatgcaggcgccaaggtcatcgcctacgatcgactgatcatgaacaccgacgccgtcgactactacgccaccttccagctggagcaggtcggcgtgctcgaggccacgtggctcattgaccagctcaagcttaaggatggcgccaccggcccgttcaatatcgagctgttcaccggttccccggatgacaacaacgccaagtacttcttcaagggcgcttgggatctgctgcagccgtacttcgagaagggcgtgctcgtctccccgtcccagcacggtcagggtggcgtgaccaaggacttcaccgttgaggattggcagaagatctccgtgatgagctggaagaccgagcaggcgcagaaggacatggaatccatccttgactccacctacgcccacggcgagaagctcgacgcggtcctcactccgtacgacggcatcgcccagggtgtgatcaacgccatcgaatccaagcgtcccgacatgaagccgggcaccgactcctggccgtatatcaccggtcaggacgccatggagatcgcagttgccaacatcgccaaggataagcagggcgagaccgtgttcaaggacgtgaacaagctggctgacgccgtgtacgacatggtcgtcgagatcgccgagggcaaggaagtctccggcctgaacggcaagttcaacaacaacaacatcgacgtcccgtccaagctgcttgacccccagaacatcaccaaggacaacctccaggatctggtcacggccaactacatcacccaggatcgcttcgacgagctgactaagtagtcctcatcaggcaatccgtaaacaaacacaatgacatgcggcgcatagccgatatgcgccgcatgtccatgaacacagaactgtgacgaggagtggtgacatgtcatcaaatgacaccatcttgacgatggaaaacatcacgaagacgttcggtccggtcaaagccctcaccgatgtgaatctttccgtcgatcgcggcgagatccacgccatctgcggcgagaacggtgcaggtaaatcgaccctgatgaacgtgctttcgggtgtgtacccatacggtagctattccggcaaaatcacctttgatggcaaggaatgcaaataccatactattaatgattccgaggccgacggcatcgtaatcattcatcaggaactggcgttgagcccgttcctgtccattgcggaaaacatcttcatcggcaacgagcaggccaagggtggcgtaatcgactgggacaagacccgtgccgaggcgaagaagctgctcgatcgtgtgggacttcccgaagacccggataccaaggttatggacatcggcgtcggcaagcagcagctcgtcgaaatcgccaaggcattgtccaaggacgtgaagctgctcatcctcgatgagccgaccgctgcactgaacgatgaggattccgcccacctgcttgacctggttcgtcagctacgtgacgagcagggcgtgaccagcatcatcatcactcataaactcaacgaggtcgccgccatcgccgacaatgtcaccatcattcgagacggttcgaccgtcggtgtgatgtacgtgacgccggagacgccgctcgaccaggaagaactcatccgcaagatggtgggtcgtccgctgcacaacctgtacccgaaccacccctccaataccccgggcgaggaatacctgcgtgtcgaggattggaccgtgcatcatccgctcgacgcggagcgcgtgatcgtagaccatgcgaacatcaacgtgcatgccggcgagatcgtcggtctggcgggtctgatgggtgcgggtcgtaccgagatggccatgtccatcttcggccactcttacggttccaacatctccggcaaggtgttcgtcaagggcaaggaagtcaagatgcccaacgtgcagtccgcgattgacgcaggtctcgcctacgccaccgaggatcgtaagggcaacggtctgaacctgctgcagaacatccgagagaacgcgtccctggcctccctgaccaagatcagcaagggcggggttgtggacgacaaccttgagcgcaaggaagttgaacagtaccgcaaggacttcaacatcaagtgccatgacatcgatgtgaatgtctccaccctctccggtggtaaccagcagaaagtgctgctcgccaagtgggttatctcgcagccggacatcctcatcctcgatgagccgacccgaggcatcgacgtcggcgccaagtatgagatctacgaaatcatcgataagcttgccgatgcaggcaaggccgtcatcgtgatttcctccgagctgcccgagctcatcggtatctgtgaccgcatttacacggtgtcctacggtgtcgtcaccgacaatgttgagaagaatggatttacccaggaatacctgatgaagggtatgaccaaggaaagggaggtggcagcctgatgagcgccgcaactgcaacacctgcaaagaaagaagaaaagaccggcctgctggccacggttgccaacaatgcccgtcaatacggtattgtcggcgcactgctggtcatcgtcgtggccttcgaggtcctgaccggaggcgtgctgctgaagccgaactccttcgtgtccctgattcagcagaacgcttacgtgatcatcctggccattggtatggtgatggtcatcatcgccacccacatcgacctttcggttggttccttggtagccttcatcggtggtgtgtgtgcactgctgatggaacgcgccggagtcaactggatgctcgccatcgtcatcgctctggtcgtcggcctgatcgtcggcgtctggcagggcttctgggtcgccgtcatcggcatcccgggcttcattaccactctggccggcatgttgatcttccgtggtctcgccaccgtgatcgtcggcgaatccgtgccgattacctccctcgaattccgtggcattgcccgtaactacctgcccaacatccttggctggtggggtccgttcgatggtctgaccattgtgctcggcatcctgtgcatcgtcggctttgcctggagccagctgcgcaagcgcgcccgtgtggccaaggtcggcctggtgcccgagccgatgagcctgaccgtcctcaaaattgtgcttgccgcggtcgtcatcgccttcgtcacctacctgctggcttcctccggtaacgctgatcagggtggtaccccgatcatgctggtgatcgtcggtgtgctggtcttcatctacaacttcatcctgaccaagaccgtgttcggtcgccacgtgtacgccgttggtggcaaccgcaaggccgccatcctctccggtatcaacacccgccgcgtggacttcctgctgttcgtccacatgggcttcctgtccgcagtggccgctgtctgcatgctctcccgtctggcttccgcaactgctcaggccggtatggagttcgagatggacgccatcgccgcctgcttcatcggtggcacggccgttaccggtggtattggtaccatcccgggcgctgtgatcggtgcattcgtgatgggtgttatcaaccagggtctgtcgatcatgggtgttgacaccgccgtggtgaagaccatcaagggcctcgtgctcctgctggccgtcgccgtggacatcatgtccaagcgcaagaagagctgaccttcccctttctcctcctcgatgtgggattcgtgccggtgccgctggtgcggatcccacactgttatctgccgtcattcttgtaatcaaaggactttttccgccatgaaactcaccgcgcgctccacctcccgtatgtatgcattgacctgcttggcctgcgttatctggctctggcagtcactggtcgaggccaataacgatggctcgctgttcaattgggccactattgtcttctcgctgtgcttgctagtggtcatcggatggagtggttggaatgccgtcgccgggtggaacgccaaggagactgaggccgccacggcaggtgccaaggatgatgagggcagcactgatcggtagcgtatatacggctgttgttgccggggacatataggtcccggcaaatctgcagcgatatgtgcattgcaagccagggattccctggcttttttatgtcgaaacggaactcgacacgggcgcgcaggccgttgggtttgtctagagcctgcatatagttacttatggtaatgactattggtaactaattggaggttgggccagcgatgtgcgattcccgaaccgataccaagaccggcttgcttccggtgaatgaggtgcggagcctcctggatgtctgctggaaggccaagaccatcaccgaactgatgccggcattgccgaaaggtatgaaaccgcgctatgtccacgtgatcgacgccgtctggcatatcaacgaaccgaatgggcaagataccggcaccgcgcgcgtgggcgacgtcagcgcattcctcggcgtcactacgccgagcatcaccaagctcgtcggcgaaatggccgacctcggactcgtcgtcaaacacgccgatgccgccgatcggcgtgcggtgacgctcacgctcaccgaacgcggcttggatatccgccgtatctatgtggaggaatatcacgcgcatttgagccaactgctgggcggattgacctcggaccagtgcgaaaccacggtacgcaccttgaccgaggctctgcgactcatgcaggaagacttccaacgtcgtagtcagaatatctgaatgaatggaggagagaacaagatcgtgactcattccgcaacacagctgcctaacggcggcaagcaaccggtctccaacaaactcgtcatcgcggtcgtctcgctcgcgatcctgaccttcctcggcatcctatcggaaacgtcactgaacatcgcctactccacgccgatggaggagttctccatcggcgcctcggtggtgcagtggcttgtcaccggttatctgctcttgctgtcggtgtcgattccgagctcgccgttcatggtgcgcaaattcgccaccaaaacactgttcatcatggccatcgtgattttcaccgccggcacattactgggcgcgctcgcggtcaacttcccgatgctgctcgccgcccgactggtcatgtcgctcggtaccggcatctccctgccgcttatcaccaacatcattctggagaaggcgccacttgaacagcgtggtgcgatgctcggcatagtcggcctggccacctgtgccgcaccggccatcggcccggtattcggcggcatgctgaagaaccacttcccgcccaagttcatccttagcggcttcgccggcaccatgattatggatgtggtgttcgttgcgctgtccggcaatgtgtgggtggtggccatcgccgcgaacgatggggcggacgcggccggttcgtatacggccgcgttcccgcgcagcatgatggtgttcaccggcatggccgtgcttggcgtgattctcgccgcgctcatgttccgattctccactcgccgaccgccggaattgagagaagtcaaatagtacgcccgcagcggattggttggctttatgatggaaccgatattccatcacaggagaagcaggggaactatcatgcttgatgaaccaccagtcactccgatccgcaaggccagtgacggcctcgaactgcccgccaccggcttcggtacgtacaaggtcaacggcctagccggtgtggacgccatcaagtccgccattcatcagggctaccgactcatcgattccgccttcaactatgagaatgaaggcgtggtgggccgcgctatccgcgaatccggtgtgccgcgcgaagacatcatcgtcacgtccaagctgcccggccgccaccacgcccatgacgaggcgctgctcaccattgaggagagcgtgtgccgtatgggcctcgactacatcgatctctatctgatccactggccgaacccgagccaaggccagttcgttgaggcatgggaggcgctggtcgaagcccgtgaacgtgggctggtcaagcatatcggcgtcagcaacttcttgcccggccatattgatctgctcattcgcgatacgggcgtgaccccggccgtcaaccaagttgagctgcacccgtacttccagcagcgcgaacagctggcctacgacaacgcgcacggcatcatcaccgaggcatggagcccgctgggccgcgccaaccagatgctgcgcgacccggacctgaagcgtatcgccgccaagcacggtatttccgtggtccaggccattttgcgctggcacctccagtacggcgacgtggccatcccgaagtccttgaacccggagcgccagcgtcagaacctcgacctgaccgcttttgaactcgatgatcaggacatggccgatatcgccgcaatggacaaccccgaaggtcacaccttcggccagaacccccattggcacgaagaagcgtgattccagcatgcaacgtcctattatgacttcgcggtcgtttttgcgcacgccgtccgaagcggccgggcccggcgacgagcaggtgatcgaagacctcgtagacacgctggaggccaaccgttcacggtgcgtgggcatggccgccaacatgattggcgtaggcaaacgcatcatcgtctttgtggatgaagaccttggcgggcgcataacggtgatgctcaaccccgtgattaccgcttcggacggtgccttcgatacccaggaaggatgcctgtccctgaccggcgaacgccgcacgctgcgttatcgacgtattgaggtcaactacgagaaccgtcggttccgcgcccgccacgccaccttcgccggttggactgcgcagattatccagcatgaagtcgatcactgcaacggcatcattatctgattcatatcggtgctcattgcagcccaactcccgaggctggtcatcgcgattacgatgcgattacatcgcaaccgctatgaccagcctttttgtgcactggtggggtgggtgttctcagcggtgttggggtgccatgcgctggcaggttggcttcgctgaggggtgtgggtggtgtcatgtcgccagcggttggctggttggcttcgctggaggttctctcagcgtcggtgatgtgccaaagagtggcgggctggcttcgctaaggagcgctaccgtcggtggagaaccagtgcgtgacctgctgccgacgctaagcgttcattaagcgtcgttagcggccaaaacttggacgtgtaacgatgctgggcggttttagcgtcgttgctgtgccaagttgtggtcctctgccgacgctgccagtgcagtagcgtcggcgttgggacaggtgttgggcctttgccgactctataagcgagggaaaatcattcgccggtgcctaagtgggtctattgccatgctgaatacatctgctgagtgtagctatgcgttcgaaggcgatttcgggacctttctcagtagcaaacatgcctaatgcgcggagttatacacttcaccgtgcacttatacacgccaaacgaagcagaaatcgactgctgacagtggacgacacgccagagacgatgtggataacccagagacggtggataacagctgcgcgatcagtggataacctgcaagaaagtgcggttatccaccgacggtagccactgttatgcacattccataccctttggaatcattgggttttccacttatccaccatctcgccatgtgggcttgcgagccaccgcacgaacgtcatacagtgtgcctcacggcgggcaacgtagcccgccgtccacatcacatgaaggggaaacaccatgagcaccgcaatcactactactgccgaaaatgccggtttgccagcaatgctggacaccaaagacgtagccgagatgttcaaacgctgcaatctcgccgtctatgccgaagcgagacgcatatattatcgcgaagtgaatctgaacccatgcaaaaagtatccgaagcaggtgctgcaaaggatcgaatggtggttctgggattggtttgcctatgactgcgccgtcagcggtattggactgaccggcaatgaatccgaagatttacgtatcgaattgcagtacggtccgggcgcaggtatctcgccattcctagccttggccgaattcatgtatgacaaggacgaacgtatcggcacacgcgagatacgtgattttcgcgaacttgatgacaccaatttcgcttcgatgttctggattcgcgatgccagcgcggtcaaaggtcgtctgacagttgaggacatcattcatggtggtgtctacgaggtggcggacgtacatgccgcctcgcaatacgatggtgcgcacggcggcatgatcgtcaatcgcatcgcacatgtgagaggcgtgtggcgatcctgttccatcccgatctatgaggcacgaaggcctgatgacccgcaaatcggtgattcgctggcccgttcattccgggaaaccggatataaaccggactttgccggtctggtgcggtttttctacgggagggccaaagacaccggtctcgactgggaagatgtggaagccgcgcgccaagccggtactttggacgcgctgatcaagaaggccagcaatcggtgaaggattcgcctaacgctgctgtccaagtcggcggccgcgatcacgaatgaagagtgacgcaaccaaacagaccgcgcacacaatggcgaccgtgcggaacgaagcccgcacgccaatggccgatgccgccgcttccggcactccggtgcgcatggccgccgcggtgtgcgtgttcatgatggtgaccagcagcacagccgcagacgtcatgatcgcgaagcccagtaaggcgagcggccggccaccgatacggtcatacatcttgcctgccaccgggttcaggatgcccatggcgatgccgctcggcatcatcaccagaccggacaccagtgcattaacgccaagatcattctgcaaatatgcccatcgcgtacaggaacagctggcgggtggtgaaggtctcgatgaggaacgcggtgatcgggatcatgatgccgttggtaagcatgaatccggtggtcagccattgcacggtgctgctgggcacgtcgaactcgtgcatcaacgtgggcagggcggagatcatcagcgtttggttgaggatggccacaaacgagccgatcatcagggtgatgaccatggcggtggtgttggcgggggtggtgctgttggagttggcggggtggtggagccggcctcagcggtggccggcgaggaattgcgtgacgtcaattatcaagtctcgtttccttggctgagttgtctttcttggcttgcccatactatctgtgccttgactgcattcgaaaaccattgcaatgactagcaacacgctgagacgcggcgtattaattcaatcatttgacaaacttagttcgttcgttttattattggtcctgcaatccgtaatatcgcctactgcaaaggagcgcccaaatgggtctgtgggatgttgacaagatcgagtacgtcggccgcgccaaaggaccgaaggaagacttcgccttccattactacgatgccgacaaggtcgttgccggcaagaagatgaaggattggctgcgcttcggcgttgcttggtggcacaccttcaaccaggaactggttgatccgttcggcaccggcaccgcgcaccgcccgtactacaagtacaccgatccgatggaccaggctctggccaaggtcgactacgccttcgagctgttccagaagctgggcgtcgagtacttctgcttccacgatcgtgacatcgcccccgaaggcgacaccctgcgcgagaccaacgccaacctcgacaaggtcgttgacaagatcgacgagaatatgaagtccaccggtgtcaagctgctgtggaacacctcctccctgttcaccaacccgcgcttcgtgtccggcgccgccacttctccgttcgccgacatctacgcctacgccggtggccagctcaagaagagcttggagatcggcaagcgcctgggcgccgagaactacgtgttctggggtggccgcgaaggctacgagaacctgtggaacaccgagatgaagcgcgagaccgaccacatcgccaagttcttccacatgtgcgcagattacgccaaggaaatcggctttgaggcccagttcctgatcgagccgaagccgaaggagccgacgctgcaccagtacgacttcgatgccgccaccgccatcgagttcctgcgcaaccacgacctgaccgacgtcttcaagctgaacttggaaggcaaccacgccaacctggccggccacacctaccagcacgagatccgcgtggcccgcgagtccggcttcctcggttccctcgacgccaaccagggcgacaagctcatcggctgggatatggacgagttcccgaccgatctgtacgagaccgtcgccgtcatgtgggaagtcctgcaggccggctccatcggacctcacggtggtctgaacttcgacgccaagccgcgccgtacctccttctacgaggaggacctgttccgctcccacatcgctggcatggatgcctacgccgccggcctgctggttgccgacaagatgaaccaggacggcttcatccagaatcttcaggccgagcgctacagctcctacgactccggcatcggcaaggacatcgacgagggcaacgtcaccttggccgacctcgaagcctacagcctcgacaagccgcagtccgagctcatcgccgccaccaagtccgatcacctcgagtccgtcaaggccaccatcaacaactacatcattgatgccctggctgaggtcgagtgaccatcggtctgaccgattgaattcgctccatcgggcgtgtacacatcaattatgatgccagtgcgcccgatgggctgattcgatagtttcgccatgtgcggtgttgtgttatgcccgcatggcacctttccattccttctttctcctttctctccttccgctgaaaaaccgcctgaggcaacgtcgccaagggcggttttctggttgtggcggggctggggggtggattggggtgggggcgaacatgttcgcggaggggtgcgttgacggtgacgtgttggcgacggtgaacatatcggcggcaggagaagataagctgttctcaggggaacctcagcacaacaaaggagttacgcatgcgagatttcattttccataacccggtgaagatctacttcggcaaagggcaggcgcgccatatcgcacaggaggtggagcgtgtcgagggcgccgttctggtggtgtatggcggcggatcgattaaacgcaacggtgcctatgacgatgtgatggctgcgctggcaggaaccgggcgcaaaatcatcgagctgcccggcgttacgccgaacccgcgattggacaaagcgctggaaggcgtacgactggtcaaggagcatggcgtcggcctgattctggccgttggcggtggctcggtaatcgactgcgcgaaatttatttcgttgggttccggcatcggtgacgatgaggatttgtgggatgactacatcgaaaccggcaaaccggcacctgaagggctgattccggttggcgtggtgctcaccaccgcggcaacgggctcggaaatgggagatgcggccgtgctcaccaattgggaacgtaaccgcaagctcggctatacgtcgttcccgctgatgcccaggttctccgtgctggatccaagctacctgatgacattgcccgccgaacagacggtgtatggcttcgaggacatgttctgccacacgtgtgagcagtatttctcctatccggtggacgacaacctttccgacgaaatcgccgagggaatccaacgtcatattctgcgttcgtggcgagcgtgcttgtccgatccgaaagattatgaggctcgctccaatgcaatgtgggattccacgttggctctgaaccgcattatctcgcgcggcaaggaagaggattgggtgacgcacggcatcgagcacgcgctgtccgcatacaccgatatcgctcacggtgctggtctggctgtggtccacccgcattggatggcatacgtgtatttggtcaacgatgaggtgacggctcgctttgcccgctgggcggtcgacgtgtggggtgtgacgcccaccggcaaaaccgatcgcacggtggccgaggaaggcattgatcgctatgtcgatttcctgcgtcgcgtaggtgcgccgctgactctttctgaggccggcgtgcccgacgatcccgcctctctcgacaagtacgccgatcatgccggtgaggccggcggctcattcgtgcagattcaccgtgacgatgcccgagcgattctcgaggcatgcaaggaaccggtgtcgttctgacggttggactaatcccgtgatttgagccgccgcgtgctgtcccgcaccaccaaagacgtagaaagaaccacgcgcttctgaatcttgcgtccttcattggtatcgatgaccatgcgggctgcagtggcggccatgtcttgcaatggctggcggaccgtggtcaacgccgggcccatgtacgcggcggtctgtatatcgtcgaatccgataacggacagatcttcggggatacggattttcagttgacgggccgcctcgtaaacgcccatggcctgtaggtcattgcctgcaaagatggcggtcgggcgactttgttcgtcttcaagtaacgccatggctccttcgtaaccgcctggcgtggtgaaatcgccttcggtgatgagttcgggagaggtggggatattgcgttcggcgagggccgccgaatagccgtcaagccgggcacgtgagcagagcatttcatccggtccggtgatgatgccgatgcgcttgtggccgagttccagcagatgacgggtggcgatgacgccgcccatccagttgtccgcctgtacggagagatcatctaatgccggattgccggaagggtcgaagacgacgaaaggaatgccgtgtgattggaacatgctgcgttccttgtccgtcaagttggagaacaccagaatagcgccaatgggctggcggtcgatgatgccttcaacccaggaagagtcggggtgctgctggtcgccactttccgcaaccatgacattgatgttgtgcggcttggcctccgtgatgatgcccctgagcacctccagcgcccaaatggtctcaaaatcccgaaataccacctcgatggtgcgttgtttacgggagagggagacgcggcgaatgtagccgttgtctttcagggctttgtcaatggcctgccgggccgcctccgaaatatccgccttgccgttcagggctttggacacggtggccagtgagtagccagtctgtttggcgatgtctgcaagtttgaccttgttctcgccgttgcttttgcgctgttctgccgacgtcatcattgaccgccttcatcagagaatgttgatatcagtatattcgaaactttcgtaaagtcaatttgacgataaagaatggtatgtatagataaaaaaggttggaatttcaacgattttgatagtaaaaaagccgatataaatttcgtttgaccgtcaaactaaggctctctatgatagagatatcgaaaacataaagcgagttttcgataaagttaaagaaggttgatggaataggtgaaacggcgaggtttcactgaaaacatcattaattaccagctgttagatatgtaaccggctgatatacctttcgaaactttcgtaaatcgcggatcggtttcatgctggtcaagaacaataaggagacgataatgaagttcaagtccgtggccgccgcacttctggcggcggtaacctgtgtcagcatggccgcttgcgggagcggcggcgacacgaatgccgatggcaaggtggaaatcaccatgtggcacaactccaccactggcgacggcaaggcatactgggaatccgccgccaaggcgttcgagaaggaaaacccgaacgttaccatcaagattgaagccattcagaacgaggatatggatggcaagctgcagaccgctctgcaggacccgaattccgcccccgatatctttatggcgcgtggtggccagaagctacgtgatgtggtcgaagctgggcaagccatggacctgaccgacaagatctccgacaccgtcaagaaccagatggccactgctgaagccaccggcaccatcgatggcaagatctacagcgtgcagcagtcagtgcttcccggcggcatctggtattccaaggatctgttcgagaaggccggtattactgaaactccgaagacctgggatgagttcaagaccgtggtgcagaagctgaaggacgccggcatcacgccgattgccgtaggcggtaaggacgcctggccggccgcccactggtggtactggttcgcactgcgcgaatgctctgctgacaccttcgacaaggcccagtccgataaggacttcagcgataagtgctggacccgtaccggtgatgatgtgcaggcgctgctcgacctcgatgccttcaacgatggcttcctgaccactccggcccagcagggcgcaagctcctccgccggcctgctcgccaaccacatggcagctatggaactcatgggcggctgggagcccggcgtgatcaaggacctgactccggacaagaaggacatggccgacctcggctacttcgcattcccgaccatggacggtggcgaaggcgatccaactgccatcatgggtggttccgatggcatggccgtgggcgagtgggcgcctgaagaggctgtggacttcctcaacttcgtctccgagaaggaatggcaggagaagtacgctgaggcgttctccaccatcccggccaacaaggaagcccaggatgtggtgaccaacgaggctctgaagcaggtgctgaccgtctacaacgacgcatcctccgtgtccatgtggctcgacaccgtgttcggtcagaacatcggcaacgcactcaacgaaggcgtggtcaacatgatggccggtcaaggttccgcccaagacattgtcaagggtgttgaaaccgctgcggccaagggctgattcgctctgccccgaccgtaattcccgggccgcggcgaatgcttgcacagcaacaaccgcggcccaatttgttttcttaggaaggcctcaacaatgtcagtttcagcaggcgcgaaggtacagcgccgcacgtcgggcttaagcgacaaggttcgcaaacgtatcgaaatcaccatcctttcgcttcctgccctgatcatgttcctcggattcgtcatcctgccggtgttcatggccggctactacggattcttcaagtggaagggctatggcaagcccaccgtcaacggccagttcatcggttttgaaaactacaaggtcattctgaccgacccgaacttccagcaggcattgggacacacgctattcgtggtcgtcgcttcgctcgtcatccaggggccgctggccatcctcttcgccctgctgctcaaccagaaattcaagggccgcgcactgattcgtaccctgattttcgtgccgtacgtcgtttccgaagtcatcgttggcaccggctggagtctcatcctccagaccacaggcgcattgaacgcgctactcaagaaaataggacttggcggggcggactggatctccgatccgaaaatcgccatctggacattgatgttcatcatttcgtggaagtacatcggcttcgccgtcatcctgatgattgccggcatgcagtcgattcccgaagacctctatgaagccgcgaaggtggatggtgctggattctggcgtcagcagtggagcatcaccctgccactgctcggccccaccattcgtatctgggcattcatgtcgattatcggttctcttcagctgttcgacttggtctacatcatctggggccagtacgtgtcgtctaccgcaggaacgtccaccatggcaacctacatggtgcgcgaaggtcgactcgccaacaactatggttacggttccgccgtggccgtggtgatcttcatcatctcgctggtcattgccttgacctaccagcggttcgtacttaaccgagatctcgaaggtgcgctcaccgacgagaaggatgccaagcgtcgtgccaagcgtgcggcgaaggaagcggccaagcttgccaaggccaatggcaatgccgcagcagttgcaaatgaggtggtttcacaatgacgaccgcagtctccccgtccgtgggcaagggcaagaacaagacctatgatccgtatgcattgagaaaatccgcaaagaccccgtggggcaacccggtcgtctacttcttctcactgctgcttgtggcgctgtgcgttggcccggtgctgtacatcattatcggcggcttccgcaccaatgcgcagattacgagggacccggccggctggcccgatccatggaactttgagaattacaagacggtgttcacttcgaacatcttctggccggaactcgtcaactccctgatcgtctccattggcacaatggtgggcatcgtggtgctggccttgatggtgagcttcgtcattgcccgatacgagttcaaattcaacaaactgctgtactcgctgttcgccgccggcatgatgttccccatcaccgtggccatcaccccgttgtatctgctgctgcgcaatctgcacctgatcaactcgcatctgggcattattctgccccagatagcattcggcctgccacaggccatcatcatcctggtgccattcctcaagtccattcctaaggaactggaagaagcggcagagctggacggctgttctcgcatcggcttcttcggccgtatggtgctgccgttgagctggcccggcgtggccaccgtcggcatcctgagcttcgtgagcagctggaacgcctacatgctgccgctgttcctgctcaacgattccagcaagtacaccttgccgctcggcgtgcagatgttcagctcccagcattcggtcgataccgctcaggtactggccttcacctcgctgtcgatgattcccgcgctgatctgcttcaccattttccagaagaagatcgttggcggcctgaccggtgctgtcaagggctagtcgcagcaaccataaccgtgccgtggaaaggtacatggctctttgggccgattcctttcaacctcttcctttcctccttcccacggcacccattcttttcaatgaggagaaaaccatgaagatctccaatcccgtactccccggattcaacgcagatccctcgatgattcgcgtcggcgacacctactacatcgccaattccacatttgactggtggccgggagtccgtttgcacgaatcccgcgacatggttcactggaatctgctgcccgggcccttaaaccgcgtttcccagttggacatgaagggcaacccgtctggcggcggcatctgggcgcctgacctgtcctacgcggacggcaaattctggctcatctacacggatgtgaagatcgtcaacggcgcgttcaaggattgcgcgaactatctggtcactgccgaggacatccgcggcccgtggagcgagccaatccgtgtcaatggcgtgggcttcgacgccagcctgttccatgataccgatggacgcaagtatctggtgcagcaaacctgggacttccgtgaatatcatcatccgttcgacggcatcaccttgactgaattcgatgtcaagaccatgcaattgaagccggaaacagcccgcaccatctggcgcggcaccgatgtgaaattagtcgaagggccgcacctctacaccatcaatggctggtactacctgttttgtgcggaaggcggcacccaatacgagcatcaggagtccgtggcccgttcgcgaaccttggatgagctttcgttcgaaagcatgccgagcaatccgttcatctccaacttcgatacccccggcacctacctgcaaaagcaggggcatggagcactcgtggatacgcccggcggcgaatggtattacgcttcactgtgcggcaggccctggcggcacgagaacgagccggctcatggcgtgcgcggctggtgcacgctcggccgagagacttcgattcagaaggtcgagtgggatggcgatggctggccgtatgtggtcggcggccatgggggagagcgttatgtcgaagccccggccgacgccatcgcaactgaggcccctacggatcatagccagcatgacgagttcgaatcgagcgaactcgacctcaactggaacaccctgcgtgtgccattcaccgagaccatgggccgcgtgggcggcggctcgctgaccttgcgtggtcaagggtcgctggcaaacctgtttgaactgtcgctggtaggacgccgttggcaggcgttcgatttcaacgccgaaaccaaggtgacgttcgagccgagcaactacatgcagatggccggcctgaccaacttctacaaccacctatgctggtcgtgggtgttcgtcacttgggacgagaagcgcaacaaacgtgtaattgaagtggctcagaacgacttcgacacgtacacgtcgttcctcaaagacacagccatcgccattcctgatgacatcgaatccgtatggttgcgaaccaaagtgcgtactcgtacctacacctacgagtattcgttcgatggcaagacatggcatgagattccggtgacgctggacgccgccgtgctctccgatgatcatgtggcccaacgttatggcggattctttaccggcgcgttcgtcgggttggtggccgtggacctttccggatacggcaaagaagccattttcagccatttcgattacatggaaatatgatgacgccaggcggctttcctgataatcagggaaagtcgcctgactattcggcactggggaatgaaaggcgacacttgtggcaagcgacaatgaacattgcggcgaccgtggccgcgaatgtaccataaccgtctccaacccggtgttgcgtggcatgtacccggacccgtcctggatatgggatacgacgcgcgaggaaatcgtgctggtcaactcctcgtttgaattggtgccggggttgcccattcatacgacccgtgatcttgtgacgtggacgcgcacggcgaatgcggtggatgagacgatgtctcatcggctgctcattgatggcgtcgaggattccggcggcctgtacgcgccgaccattcgccgtatcggcgggcgatatgtgatcgtatgcaccgtggcccgcgtggatgaggtgaaggcgctcgctgcgggatgctcgcagaaggatattgataactgccgtgacgcccaaggcaatttcgtcatcgaggccgatgagttgaccggaccatggcgcggcccgtactgggtggccggggccgaaggcattgatccggacatctttgaagacggcgatggcacagtgtggtggacgcaaacgcgcccggcattacacccgcagtgggatggtcaaaccgaaatctggacgcagcccatcgccccaggcacgtggacgttgcaagaccataaaaccgtgatttggcgcggctatggcatggatgcggtatgggctgaagggccgcatttgtaccgggtgggcgattacctctacctgatgaccgccgagggcggcaccagcttcgagcacagtgagatgataatgcgcacgcacgcaccgcgcggattcgcggcggcgctcgccggttttgagaagaaccttgccgcgcaagatatctggattgagccggcgcgtgacggtgaacgaagcgtggtgggtcacgataaccggctgtttgaggcttgcaaacgcaatccgatcctcacacaccgtcatttgggagcgggggagccggtccaatgcgttgggcacgccgatctgctgctgcatccgaccgtcggctggctgctcgcgtgtcttggcatacgcgagactccgggcgaggaacccggagaaacgttcagctactgtggccgggaaacgttcgtggcaccggtcgtatggcagcacaatccggtctcgtggaagctggacggtggggagccgaataagcgtatcgatatcgtcgatcccggttggccggtcgtggctccggggcttggccggcttcccgagaagttggtcgtggacgttgacgaggatggattgccatgtgcagtgaggggtgtggattctgcggggtgtgattgcgctgctggtaataatgccgcatgccctgctgagctcatccagctcgacgatacccgcctagtcggcgttcgaggccgtgacgattaccggttcctgcgtgtcgacgggcaggaatatgccgcgttcacccggcccgaatacacgatgatgatgcatcaggattccacccatgctgtcatggtcatggcggaagcggaatccggccaattgacggccgaaatcaccgataggggagataagcggtgcattgcgcttggagcgcttggggccaacgaatggttcggattgcgcttgcatggcaatcgtttggaattccttgccgggcagcctgcacctgacagcattgatgagggaacaatgcctgatattgcactaattgcgcacgcggacgttacttatgctcgtatcatggcagattgtgatgcgcgattcctcagtaccgaatgggccggcggattcgtgggttgcctgatcggcgtaaaacggcggtaatggtctcagcccgctctacaatattgtacaatcatattgtttaatcgttaaacaaatgcaagggggcaatcgatggcgcacgatctcgaacaactcaagcaagatcacccggatgtggcgaaactgttcgccgatgactggttgcagtaccgtaagtcggagattttgccggaacttacgcgcgaggcgcagtccacgtgcgaccgcatcaatcgcatctactttgaagacaccgccgaagctgagcgactgttccgcgaactcgtgcccgaggccggcgagggcgtggacttccgcccgccaatccggcttgattacgggctgggcctgaaaatcggagaccgtacgttcatcaacatggacctgctgattgtgggcggcggcccgatctccatcggctccgattgcctgatcggcccgcgcgtgagcatctatacgccaaaccacgccatcgcccgcaagcctcgactggaaggctggcagcacaacgccgacgtgaccatcggcaacaatgtgtggctgggcggcaatgtggtgatctgccccggcgtcaccatcggagacaactcgattatcggtgcgggcgcagtcgtcacccacgacattcccgccgattccatcgctgtgggcaatccgtgccatgtgattgccgaagtcccggatgactggactcctgaagagcgggccgctgccgagggtcggtaggtttgctgctctggccaactgtcacggcgaaaccgggatacaggagagaaaggaacaatgcaatgacgcaatatcatgtttccgcgcaggcgacgaagacgaacggcgccggcagcgcggccgacccgtttctgaccatcggccaagcggcggccatcgcccgagccggcgatgaggtggttgtgcatgccggcacctatcgggaatctgtcgacccccgattcggcggagagagcgccacgaaccgcatcgtctaccgcgcggccgcgggcgaaccgcgcccggtaatcaccggctccgaacgtatcgacacatggcagcccgaaggcgatggcgtgtggaaagccgtaatcccgaacgcattcttcaacggatacaacccgtacgtggaaaccgtattcggcgattggaccgtatacccggacccaaaggtcgaggtacgccacctgggcgatgtgtatctgaatggcaaatccttctacgaagtcgcctcgctggacaaggtgcgcaacccacagcgttgggataccggccgtgacgccgccaccgattccatcgtgccgctgattgatccggatgccaccgtgaacgtgtggtgctgtgcggtcgatgatgaggccacaaccatttgggccaatttccatgaagccgacccgaatgcggaacttaccgaaatcaacgtgcgcgagacctgtttctacccgagccgcccgttcgtcaattacattacggtctccggctttgaaatggcgcaggcggcctgcccttacacgccgccgactgccgatcaggtcgggctggtgggcccgcattggtcccgcgggtgggttatcgaaaacaatcgcattcatgacgcgaaatgttcggcgatctcgctgggcaaggagatttccaccggcgacaacgaatcgacgcgcacccatcgtaagtccgggtaccaataccaaaaagaggccgtctacaaggcgctgcatgccggctgggagaaaggcgtagtcggcgggcacgtggtgcgcggcaacgtaatctacgactgcggccagaatggtgtggttggtcatatgggctgcgccttctcgctgattgaaggcaaccacatataccgcatcggcgccaagcgcgagttcttcggctgggaagtggccgccattaaaatgcacgcagccgtcgacacggtggtgcgcggcaaccgggtgcatgattcggtgctgggtatgtggctcgactggcaggcgcagggcaccgtggtggattcgaacgtgttctaccgcaacacgcgagatgtgatgaccgaggtgacccacgggccgattacgtttatgaacaacgtgtttgcctccgagttcagtttcgacgattatgcgcaaggcgcggcgttcgtcaacaatctgttcgccggtcgcattcgtcacaccgccgtcttggaccgatccacgccataccatttcccgcacgtcaccgatgtggccggcgaggcattcgtctacggtggcgatgatcggtacgtcaacaacctgttcttggctgtggacgattccgccaaaccgttgtgtaccgcggatgccgccggtgcggccggtatggcggaagctggaaccgcgttctttgacggctatccgcgctcgcttgaggagtatgaacagctgattgaagaggctggccttggcgatgaggagttgtatcgcagcgtgaagcagccggtattgctggcttcgaacgcctatgtttcgggcgcgaaggccgcttccggcgaagccgaggccgtggtgagtggtgacggctcttcgttggcattgcgcgaaaccgatgatgagctatggatgaccgtttcgttgcccgaatcgattcggtcggcaactggaccggtgatctccactgctgatcttggccaaccgcgtattgtcgaggagtatttcgagaatcctgacggttcgccgattgttgtggaccgggatatcaccggtgctgcgcgcggcgcatgctcggctcgaggcccattggcggcgtatggcgatggggaagtgctcatctggtcgaagtgacgggatcgcggtttcgactgttgcctctgcctcggcctttgtgtggcactgagtggggctgggctgccagtatttggcaggccggccccttttcgatttgcattggtaacaaatatgatatatggttaaatcattaaactaaatactgtaagtccatgcatacctacgcaacgtcaatggagatactgctatgcgcgcacatcatgttctgctgctgtcgctctgcctgttggccgcagcctacgccgtactgctattcgtttcaccagccgctgcgccgattggcgtcacgctaaccgttgttggtctggtgctggtctcgacgcgctatgcgtggcgcgccaaattcctggctctattcaacgaagcatgatttgatgaatcttcttcctctcttctccttttaagcccggccgctcgccgggctttttcttttgaccgaggtcgaagtggggaagggtgtgctatgggcactttcgtgtcgggggtgccgtgttctcgacaacggcctaccgacttggggtgtatttcgacaatatgattcggcgatgtgcctcagcggatatgtgcggccaatgaaaaagcgggataccgatgtcgatatcccgctttcagcgaataggtaaggccagagcttacttcttcctggctttcttgacgcgcttgggggtgggagccattttcttgggttcgaagaacggccacttgtgcaaagcccaggcgtgcagtgcggggatcttggcaacggcgaagccgatgaccagaccgattaccatggcccaggtctccagatcatggcctgcgaccagcaagccgatgaacactatggcaacgatgaagctcaccatctgcgaggcctttgactgcttggcggtcaccaggtcggccttcatgggaacaagccccagaaacaggccgcaaggtatgcagatgacggccaatatcgcgctgagggttattgacaatgtggttgcatccatgatgttcctttagtgctgtgggttgtggttttctttggcgtctgcggtgtcggtgtctgcggtgtcggcaacgtcgtcgtgttcgttttcttcggcttgttcggcttcggcctcggcgtccgtgctgtcggtttcgtcgtcatcagccgcgtcatccttgccgggctggcgccaccacaggattagcgcgttggccgcgcagtagatggccgcgatgccaatgcataccagaaaaatgatgttcgaagtgctgatgatcgtgccgtcgttcatcgactctttgacagactgccatatccacatcacgcaggcgacggcagtcagggcgtacagcatcatacgggagcggtcgttcataggatcatctccagacttgttcaaacgacttgattatagccgtatttgtggattgcgtgggaaacgaaaaatgccgccatgtgtgcttcagcgaggagcgcggtataacagcggctcttcgcgatgctcgccatggtggcattcatcaggaatcgttattcagttgttatctcatggatttgctggcagcgtatcagccgcgggccttggcataagcctcgtacacggcttcggtgggctcgccggtctccacgccctcgatggtgagctgccaggtcggcggttcggcctcgccggacagcacccaggcggcctgacgggcggcgccgatggccacgtattcgtcggtggtcggacgggtcacgtccatgccgaggattgagggggccagcgtgcggatggccacggacttcgcgccgccaccaatgagcaggatgcggttgatctcggcgcccagcgagcgaatcagctcgaggcagtcgcgctgggaacacagcaggccttcgacgaatgcacgagccagattctccttggtggtgttgtgcagagtcaggccagtcagcgaggcggtagcgtccgggcggttcggcgtacgctcgccgtcgaagtacggcaccagggtgatgccgccggcacccggctcggccttgaaggccagttcggccagttcgtcgtagtccacgcctagggcggcgcgaccggcgtccagaatgcgcgaaccgttgattgtgcaggcgagcggcagatagtggccggtgcagtcggcaaagccggaaatggcgccggtcaggtcgtacaccgggttttcagcgatggccgcggccacgccggaggtgccgagcgatacggacacatcgcccacggccatgccgaggcccagcgaggccatggcattgtctccgccgccggggccgatgatgcagccgccttcaacgtccttgccggcaatggcggggtcggccttgacggcggctgcctcacgcgggcccagcacggtgggcagcacaatggcgtcggcgtgggccttggcggcttcctcgccctcggcgggggccagtaccatggcgatgagatcgcggcggtactcgtcatgcgcggcatcgtagtaaatggtgccggaagcgtcggaacggtcggtgaacagggcttcgagatgagcgtcctcgccctcggccaccgggccatagccggcgatacgccagctcagccaatcgtgtggcagacagacggcggcaatcttcttggcgttctcaggctcgttctcggccacccacgccaccttggtcagcgtgtaggaggcgacgggggaggagccgacggccttgacccagcgctgcttgccgcgggcggtcacgtcgtccggttcgtcgccctcggccggagctgcaccgagcttgtcgatcagggcggcggcctgcggggcggagctgatgtcattccagagcatcgcatcgcgaatcacgttgccctgcttgtcgagaatgaccatgccatgctgctggccgccaaccgcgagggccgcgacatcgtcgagcccgccggcctgctcggcggccttggtgaaggcctcccaccagaattccgggttgaccgaggtgccatccgggtgcttggcctgcccgaaccgaacctgttcgccggtggcggcgtccgtaatgcggacctttgttgattgggttgacgtatctacgccggcaaccagtactctcgtcatgcattcctcctcgatgagggtcgcgctcaaaagtttcggcgcgccatagccaataagttagacgattaaactatactgtatcaacgttcgattgcaaacggaaacacgcgaaggtgcggtacggttcaatcgtttgacgcacaatatcatggtgtggtagacggatgtgagcgcctgtgcggcgttcgagactaggggtgcgaggaggtaggggccaatggcaaatctacgcaggatcaatcaggaggatctgcgcaaccataacctgtcggtgacgctcgacaccttgttgcgtgcgcagaaaccgatgagtcgtgccgatctggccaaggagacgggcctgaccaaggccacgctctcgctgttggcctcgatgctcattgaaagcggcgtggtgcaggaaggcgagccggtcgtttccgccacatatgggcggcccagcacgccgctggagattcgcggcggatccatcgccggcatcggcctgcagatcaacaccgatggttacggttgcctggcgctcgatctgaacggcgacactctcggtcgggagtgggtgagtgaggatatgaccggcactgatccgtacgagatcttcgccaagctcgatgcgatggccttcccgttggaaagccggctcaaacgacgcggctgcaaggtggtgggagccgggcttgcgctgccgggcatcgtcaccgacgacatgtggctgttggtggcccgcaatctgggttgggaaaacgtcaatctcacccggttcaacgtggtgcgccggctggatgtggtggccggcaatgaggcgaagatggccgccatcgctcagattccggggtatgccaccgaacgtgcgtccttcctgaatgtggtggaccgcacggactcctttatttacctgtctaccgatatcggcatcggcggcgcggtggtgcgcgacggcgaagtggtgatgggctcgcacggattcgccggcgagatcggccatctgtccgtggcgatggatgggccgttgtgcagctgcgggcgtcacgggtgccttgaggcgtttgcgggccgtcgcgctttggtcgaggctgccggcattgccgaagatggggatgccaccagcagcgaggccatcgatatgttcctccagcgttggcgcgccggggattcggatgtggccaaagtggtcgatcaggccgccgatgcgctggtttccgccatcgcttccgccgtgaatctggtggatgtcgatacggtgctgttgggcggactgtggacgcacttcggcgacgagctggccaccgtgcttgaaggccggctgcgttcggaaattctgggatacccgaatgtgaagattcgcgtgtttgtgccgccggtggcgctgcatccctcgctatatggcgcggccgaaatgggcttgcgacggttcatcgagaacccgttggggtacatgggggagaagtagcgccgggagatgctgcttgttgctggcgggtgcatggtaggggtgcatggcgcgcgtgccggcgttagcgggctcgtgctacactttggcaagttggctgttttgtgcagcgaacgtggggccgtagctcagtcggttagagcatgcgactcataatcgcccggtccagggttcaagcccctgcggccccactcttttgcgtcgtctcctgcggcggcgtagcgcgtcttcacgtccagataggcgcgtacaatcccttaggttccggttcacgtcttgccataggggcatgacgacccgggtcccccgaatccataggagacgtaaaatgcagcagggtatccatcctgattaccaccccgttgaggtgacgtgctcgtgcggcaacaccttcgtgacccgcaccgctggcaaggaagatcacatgttcgttgacgtgtgctctcagtgccacccgttctacaccggcaagcagaagattcttgacaccggtggccgcgttgctcgcttcgagaagcgctacggcaagaagagcaagtagcatacttcacgccagtccgattcgatttggcatgctccggcatacccgatcgaggactggcgttttttgtattctttgacaagttttgttgcagcattgacctgcgcaatcgaataatcgaacagaacagcaccatacagaagaaagtgtgttatggcagacgaacagttcccggcggcggcaaccgcgcttgaggagtaccagtccatcgaagaacagatggcaagccccgaagtcgtgtccaacccggacaagctgcgcaagctgggtcgtcgtcacgccgaactgggtgccatcgtgggtgcctacaaagcctggttgcaggtgaaggacgatctggcagccgctcaggagatggccggcgaggacgccgacttcgccgaggaagccaagcgtcttgaagccgaactgcccggtgtcgaggagaagctgcgcaccgcgctgatcccgcgtgacccggatgatgcgcgcgacaccatcatggagatcaaggctggcaccggcggcgaagaagccgcactgttcgccggcgacctgctgcgcatgtacacccgttacgccgagaagcgtggctggagcgtgaacgtgcaatccgagaacaccaccgagctcggcggcgtcaaggacgtgcagatcgccatccgcgccaagggcacgcccgctcccgaagacggcgtgtgggcttcgatgaagtacgagggcggcgtacaccgtgtgcagcgcatccccgtcaccgaatcgcagggccgtatccagacttccgccgccggcgtcatcgtgttccccgaggccgacgaggatgacgacgagatcgagatcgatccgaaagacctgaaaatcgacatcttcatgagctccggccccggcggccagtccgtgaacaccacgtattccgccgtgcgcatgacccacctgcccaccggaatcacagtgaacatgcaggatgagaagtcgcagattcagaaccgtgccgccgcgttgcgcgtgctgaagtcccgcctgctggccatgaagcatgagcaggaggccgccgaggccgccgacatgcgtcactcgcaggtacgttcgcttgatcgctccgagcgaatccgcacatacaacttcccggaaaaccgtatcgtcgaccatcgcacgaattacaaggcttacaaccttgacgccgtgctcgacggcgacctgcaggccgtcatcgattccgacatccaagccgacgaagccgaccgtctggccaatcagaaatgactttgccggatggctcacctcagcctcgctttgcgagccagctcccctcagggaggggagctgtcagcgaagctgactgaggggagcctaatgtccgatcaacggagaccgccagtgcttattaccgacatcatcaaccaagcctcttcgcaattgcgcgaagcgggtattgagacgcctgagcatgatgccaagttgctccttgccgaggcggcaggcgttgaactgcgcgacgttgacagggctctgcttatgggggaggaacttggcacaaccggacagcttgccatcttccgtgccatgctcgaccgccgtgccaagcgcgagccgctgcaatacatcaccgggcatgctcctttccgctaccttgacctgaaggtcggtcccggagtgttcattcctcgtccggaaaccgaaaccgtggtgcaggccggccttgactggctgacaaaaaacggcatgatccatccttgtgtggtcgatttgtgcgccggctccggcgcgattgggctgtccgttgtcagcgaggtgcccggcagccaggtgtgggcggtggagctgtcgccgaacaccgccgaatggacgcgaaggaatctgtcggaaaccgcgaaaaagtacccatccattgcctcgaattaccatctggaaatcgcggatgccacgtccttcgccacattggcccaattggacggcaccgtcgatatcgtcatcaccaatcccccctacgtgccgcagaccgatattcccgagcagccggaagtgcgtgattgggatccggaattggctttgtatggcggctcgatggacggtacgttgattcccgagcgcattatcgagcgggcctgccgtcttctcaagcctgggggcgcgcttgtcatggaacatgacgtgacccagggggatcgtctcgtggcctttgccagggccaccggattcgctgccgcatcgaccggccaggactggacgggtcgcgaccgctacctgtttgcagtgtcctaagccgcacgcatcccacatttccttgggattgcattctcgtttccgtaattgcgctgtctcataataagaacaatttattgcgggttcaaagctggtctggttataacagtccgcgacaaacatcgaatgagagagacgtgaatgacggtcacaagccgtgtgatgtagttctgtggtatgcgaattatgtgagtggaacgtctcacgcgcacatcccgcgcgttggttgacagatgaacgatgttgaaatatcccaaggaagaaggaagaggatgaacgtgaagttctccactaagttcgttgcggccagcgcggccgctgttatggcgttgtccctcgcgggctgctccggcggcagcatggatgattcctccagctccagtgccaaggcctccggcgactccatcaccatcggcaccgtgaccaccaactccggtaccgccgccgcttacggcgaggccgaggtcaagggcttcgagctggcggtctccgagatcaacgccaagggcggcatcaacggcaagaaggtcaagctcgagtccatggacgacaagggcgacgccaccgaagcctccaacgcctacaacaagctcgccggcgacaacaacgtgctcgccgtggccggcccgaccatttccgccaccaccgcagccgtggccccgctggccgaccagtccaagctggtcaccatcgccccggccgccacttccgactccatcgaaaccggcaattacctgttccgcacctgcttcaaggactcctaccagggtgaggtggctgcacgcttcgccgccgagaacctgaaggtcaagaaggtggccgtgctctacggcaccggcgatccgtactcctccggcgtgggcgaggccttcgccaaggccgccgaaaagctcggcctcgaagtggtggacaaggaaagctcctcctccgccgacgacaccgagtactccgcccagctgcagaagatccaggcttccggcgccgagctgctctacgctccgtactactactccgtggctggcccgtacatcatcccgcaggcccgctccgtgggtttcgagggctacgtgatgggacccgacggatacgatggcctcaagctcaccggtgacaagtcccagtacaacaagacctactacaccacccactactctgccgacgacaacaccaacaccaaggtgcaggacttcatcaagtcctacaagtccaagaacaacgccgagccgaacacgttcgccgctctgggctacgacaccatctacatgatcaagcaggccatcgagaaggccggtaagaacgccacccgtgaggatgtgcgcaacgccgtggccagcatgaccttcgacggtgtgaccggcaagttcaccatggacaagtccggctcgccgaccaagtccgtgatcgtgctggaaatgaaggacggcaagccggtgtacaacaccaccgtgcagcccaagtgaattccatgaattcccaccgcataatcacgatgtcctagcgtgactttcgcatgaacaggagagcgaccggttttgccggtcctctccctttcgtgttttcacgggctcggatgcataaggacagccgtcgatatgcggatatcgccaggcgcgggcgtatcgcgccatcaatcgcaagacatacgaatatctctacgcgcgcagcggtagagaaccacaacattgatagaaagggggagctatgaccgatcagatcatcatgttcatcagccagctgttcaacggtctgaaaatcggcagcgtgtacgcgctggtggcattgggctacaccatggtctacggcatcatccgactgatcaacttcgcccacggcgatttcatcatggtcggagcctacgtgctcatgctcaccattccggccatcgtggccatgggactgcccgcctgggtggcggtcattcccgccatcctggtatgcgtggccgtcggcgtgatcgtcgaaaaggccgcctataagccggtgcgtgaaaagggcaactccatgaccgccctgatcaccgccatcgccatgtcgttgctgctggagaacggctcacaggccatcttcggcgccgacttccagaccgtcccgaccatcttccacctgccgtccatcgcgttcggcaagctcaagctgccgggagacaccctgctgaccatcgtcatcggcctggtcatcatggtgggcctgcagctgttcgtcaaattcaccaagcagggcaaggccatgcgcgccgtctccgaagacaaggaggccgccgtgctcatgggtatcaacgtgaactccaccatcgccctgacattcgccatcggctccggtctggccgcggtcgcctcgctgatgtactgcgccgcctacccgcaggtctcgcctatgatgggcgccatgctgggcctgaaggcgttcgtcgccgccgtgctcggcggcattggttccatcccgggcgccatgatcggtggtctggccatcggtctgatcgaaagcctgaccaaggcgtatatcggcaccatcacggcgggcatcatcacctcggcgttctccgacgccatcgtgttcgccatcctgatcatcgtgctgctcgtcaaaccgtccggcattatgggcaagaacgaaggggagaaggtctgatcagatgaagaagacaatgctttccaccaaacagtcctatcttgtgtgcttcatcggcatcctcgccgcgttcggcatcgtgatggcgctgtgcgaatccggcttggccgactcctacatcaagggcatcatgatgaccgcgtgcatcgccatcatcatgaccacctccctgaacctcaccatcggcgtgctcggccagctgacgctgggatgctgcggtttcgaggccatcggcgcctacgtggccgcactgacctccaaatacatggtcgccgccggcattgccatcgaccccaccgcccgcttcctgctcaccacgctgatcggcggcgtggtggcctgcgtgttcggcatcctgatcggcattcctgccctgcgactgcacggcgactacctggccatcatcacgctgggcttcggtgagatcatccgcgtgatcatccagaacctcaaggtagccggcggcatgggcctcgacaagggcgccgccggacaggcgctgatcggcatcgaacgcaccgccaacctgtacgtcgtgttctggatcatggtggtcaccgtggtcgtactcttcatgttcggccgctcccgttacggccgtgcggtcaaggccatccgcgacgacgagatcgccgccggcgcctccggactcaacaccacgtacctcaaggtgctcgtcttcgcgatctccgcgttcttcgcgggcatcgccggcggtatcttcgcccagtacatcggctcgctcaaccccaccatggccggttggctcaactccatcaactacgtgatcatggtggtgttcggcggcatgggttcgctcaccggctcgatcgtctccgccatcggcctgaccatcctgcccgagctgctgcgcgccttcgccgactaccgtatgctcgcctactcggtggtgctggtgctcgtcatgatcttccgcccgcagggcatcttcggatcctgggagttctcactgccgcgtctggtcaaccgcatgctgttccgcggcgccgccggcaagggcgcgaaacccgcggccagcgccaagcagcatgaccagtccgacgacaagaccgtgaaggaggcctcacgatgagcgacgcaacccagcccatcctcaaagccgaacatctcggcatcaccttcggtggtctgaaagccgtgtccaacttcaacatgaccatcaacaagggcgaactcattggcctgatcggccccaacggcgccggcaagaccacggtgttcaacctgctgaccggcgtgtacaagcccaccgaaggcgagttctggctggacggaacccggatgaacggcaagaagacctatcaggtcgtgcgtgccggcatcgcccgaaccttccagaacatccgcctgttcaagcagctcaccgtcgaggagaacgtgctcgtcgccttcgatgagtcgttcacctaccacatgggcagcgccatcttccgcaccccgggcttctggaagcaggagaacgagatgcacgagaaggccatcgacctgctgcgcatcttcaacctcgagggactggccaccacccaggcggccaacctgccgtacggccagcagcgcaagctcgagatcgcacgcgccctggccaccggcatgaaactgctgctgctcgacgagccggccgccggcatgaaccccaccgaaaccgaggatctgctgcactgcatcaacacgatccgcgaccgtttcggtatcgccatcctgctcatcgaacatgacatgagcctggtgatgagcgtatgccagcgcatccaggtgctggactatggccgcaccatcgcatccggcacgccggaggagatcgccaacaacccgcaggtcatctccgcctacttgggcagcgacaacaacgatgacgcggacggcgattccaccaccaaggcggaaccggagccaagcattgccaagacactgacggaaggagcgcgctgatgctggaaatcaaggatctatgcgtttcctatggcgcgatcgacgcggtcaagggcattagcctcaaggtgaacgacggcgagatcgtctccctgatcggagccaacggcgccggcaagaccaccaccctgcacaccatcaccggtctggtgcctgccaaatccggcagcattacctatgatggccacgatctgctcaaaacgcatgcgaacaagatcgtcacgctgggcatggcccatgtgccggaaggccgccacgtgttcacccgcatgagcgtgcaggagaacctagagatgggcgcgttcagtctcaaagaccagtccagtctgggtaaggatcttgagatggtgttcgactacttcccgcgtttgaaggaacgtcgccgccagctggccggcacgctttccggcggtgagcagcagatggtggccatgggccgcgccctgatgagccatccgaagaccatcctcatggatgagccgtcgatgggtctgtccccgctgctggtcaaggagatcttcgacatcatcgtcacgctgcgcaagcgtggcatcaccgtgctgctcgtggagcagaacgcgaagatggccctgtccatcgcggatcgcgcctacgtgctcgagaccggcaagatcaccatggagggcaaggcctccgacctgctgcacgacgagaaggtgcgcaaggcgtacctcggcgcgtgacgtctcacattactatgctcccgctggcgggagctacctcacgaagtgaggctgagggtggttatcggagatttccggcaaccaccctcagtcagctccgctgacagctcgccagcgggagcattcatatatcactgcgcgtaatactgtagcgcggaagcatccttatccgtaatctcgcgaatcggacgggccggattacccacggccacggtgtgcggcggaatatcgcgcgtcaccaccgagccggcaccgatcacgcaaccctcgccgatcgtcacgccgccgattaccgtcacattgccgccaaaccagcagttcgagccgatgacaatcggcttgccatactcgcagtcgtatgcggaaccatcaggtgcctgcctcacgttacgatcctgccaacgcaacggatgcatcggtggcagcagcgaaacgttcgggccgaacagcacgtcgtcgccaatcgtcaccgggcaacaatccagcacagtgaagttgaagttggcgaacacgcgctctccgatggtgatgttgcagccatagtcgaagaaaatcggccccatcacgtcaaggccggcaccgtggccgggcagcagctcatcgagaatcgcggcacgggcggcatgatcggtacgcgacgcggcgttgaagcgcgcgcacaggtcgccggccttctcgcgcagggcattcaattcagggtctaccgaattgtacagtttgccggcgagcatctcctcgcgctcgctggcgcgcggcatacgcagttcgacgggaggcatggtggtggattcagcattgatttcgctcattgaacactcctgtaatttcgcgaaagagcatggatggactcattgtatctacggtctgtgcgtgtggggcgaatcggaaaacggcagtacggcaaacgagcgatgatgaactatgcaagtcggggcgcaatggtgcaatggtagattgtgaatacacaagcgaacggaggtggcgtgagcgtggaaggcggaacaacgctgaaagtcacggatgaatcgctggcacaggcggcgcgtgtcatccgggatggtggattggtcgtcattccaacggatacggtatatggagtggcgtgcgatccgcgtaataaggccgctatcgaccgtatctaccggctcaagcgtcgcccgcgctataaggcgttgcaggtactgctcgcatccaccgaccagcttgatgagctcggtctcgacctgccgtccccgctgaatcgtttgtcggcggcgtttctgcctggcgcgttctcgccgattgccgtagcccggcccgactgcacgttggagactttggccgacaccgccgatggtcgccccggcacgcaaggcatccgcatccccaattcggcgctgtgcctcgcgattctcaaggcgactggcccgctggccgcgtccagcgccaaccgttccggcgacgaaagcgcgcagaccgtccaggaggcggttgacgcgttcggcagcgaagtcgacctgtatctggacggcggtcccacccaaggccatgtctccagcaccgtcgtcaaagccgatccgtacgcgcgcgacggcatcgagatcctgcgtgaaggcgtcatcgcccaaaacgtgattcgcaaggccctccacctcaacggcggtggactcggcgcatgagaatctacctactgattgccgccatcgccggtggcgtcacctggctggtgactccgctgattcgccacgtcgccatcgaaatcggtgcggttggcgaggtgcgtgcccgagacgtgcacaccattcccacgccgcgcatgggtggccttggcatgctgatcggttttgccgtggctaccgtattcgccagtcggctgccttttctctcgggattgttcaacggcaattaccagatgtgggtgattcttgccggcggcatcatgatcagtctgctgggcatggccgatgacctgtgggatctcgattggatgctgaaacttgccggtcagctgctgatttccgtattcgtggcttggggcggattgcagatcatctcactgcctttgggcggttcgctgattaccgcctcgccgagtctgtccatggcgatcaccgcattcctgattgtcgcctcgattaacgcggtcaatttcgttgatggcctcgatggcctggcggccggtatcgtggcgattggtggcatagcgttcgccgcctattcgtatatcatcgcccggtcttccccgagttatgcttcgttggccacgctgatcgacgtgatgatggtgggtatctgcgtgggcttcctgctgcataattggcatcccgccaaactgtttatgggtgattccggttcgatgctgcttggctatctcatcacctgcgcttcgattgtgatgaccggacgtcttgacccggcctcgattcatgccagcatctatctgccggtgttcatgccaattctgctgccgattctggtgttgttcctgcctgtgctcgacatgtgtctggcgattgtgcggcgtttggccaaaggccagtcgcccatgcatccggaccgtatgcacctgcaccatcgcatgctgaagatcgggcattcggtgcgtggcgccgtgctgatcctgtggggatgggccgcgctgatcgcattcggttcgctgacgattctgttcttcaaagcgcagcatgtggccgtgggcatgcccatcgccgtggtggtgctgaccatagccacgatgtacccctatctgcggcatcgtattcccgagatccaagccgagaacctgacgctcgaatccgcacgcaagaacgcgcagcatgctacggttaagtcgcagtctgcagtaggggagagccgggattcgattggctctcaggcagcggattcgatgactgattcgcctgcggattcgcgggactcgcaggcgggtgaggtgcaggacccggcagcggataagtgagcgctcacaagcgtgtgtcgtgaaggtcagcgcgtgttcatatagtgtttgtatggctacaaacctcgatgaattgaacgcccaatcggcgtatgctccccttcctccgattttcgccaagctcggccttgcttatgacgatgtgttgctgctgccgaacgagacggatgtcattccctccgaagtggacaccagcactcatctgactcgcaagatcgtgatgaaggccccggtcctctccgctgccatggataccgtgaccgagtccgagatggccatcgccatggctcgtaacggtggtatcggtgtgctgcaccgcaatctgtccatcgacgaccaggccgctcaggtcgatgtggtcaagcgttccgagtccggtatgatcaccgacccgctgaccgtcaaccccgaggtcactctggccgacctcgacaagctgtgcggcaagttccacatctccggtctgccggttgtggacaaggaaaacaagctcgtcggcatcatcaccaaccgtgatatgcgcttcatcgcctccgaggattacgacaccctgaaggttaaggatgtcatgaccaaggagaacctggtcactggcccgtccaacatttccaaggacgacgctcaccgtctgctcgcccagcacaaggttgagaagctgccgctcgttgacgaggaaggccacctgaccggcctgatcaccgtcaaggacttcgtcaagaccgagcagtacccggacgccaccaaggatgagcagggtcgtctgcgcgtggccgccggcgtcggcttcctcggcgacgcctggcagcgtgcctccgctctgatggaggctggcgtggacgtgctcgtggtcgacaccgccaacggtgaggctcgtctggcactcgacatgatttcccgcctgaagcacgactccgccttcgacggcgtgcagatcatcggcggcaacgtcggcacccgctccggtgctcaggccatgattgaggctggcgcggacgccgtcaaggtcggtattggccccggctccatctgcaccacccgtatcgttgccggtgtcggtgtcccgcagctcaccgccgtgtacgaggccgcccaggcctgccgtgccgctggcgtgccctgcatcgccgacggtggcatccactactccggtgacatcgccaaggccctcgtggccggcgcctcctccgtgatgctcggcggcacgctcgccggctgtgaggaagccccgggcgagaaggtgctcctgcacggcaagcagtacaagctgtaccgtggcatgggctccctcggcgccatggccccgcgcggcaagaagtcctactccaaggaccgctacttccaggccgacgtgacctccagcgataaggtcgtgccggaaggcgtggaaggcgaagtgccgtatcgcggcccgctgaacgccgtgctctaccagatgctcggtggcctgcaccagtccatgttctacatcggtgcccacaacatcgccgagatgccggagcgtggcaagttcatccgcatcaccgacgccggtctgcgcgaatcgcacccgcacgatatcgtgatgaccgccgaagccccgaactactccggcttccacaacaactgatctgactgccgaggtgctttgacatactgaggtgagcggaggagccttccgcttgttcggagggttcctcctttgcgttttcgcgtcgttgccgtattaccaagttgttgctgcagcaccgggcgcctcatcatacggtgaccacgacacgccgaggttcttaaaacaagtaattatatacctgcgtaattcatgatgccttagcgtgggcggcattcgatgccatgtaatcagttcaacgagggaggacaacgatgtcgaagctgattcgattcatcgacaacaggaaccagtccctgggggatgtgcttcgtcaggtcgcggccgacccggcatataaagatttgtccatcgtcaccggctattgggacatgattggtacctcgaggctgattgacctcatcaagaattaccgttccgtcaggattctgattggtgccgaacccttttccaggcgcaatctcggcctgacgaacctgtacaaggactttcccgatgcggacatctccgaggatctgcgcaagttgggggagcttcccgacgatgaggtggcccgctatcgtgaaacggcacgtatcctagcggttatgattcaggagggacgcctgcaggtgcgcatctgccgcaagccgttcatccatgcaaaggagtatgtgttcggttcctacgacactgcgggtgccatcggcatcatcggatcctctaacttcactggaaggggattgtccgacatcaccactggtggcaatgccgagctgaactatctggaggaccaggaaggcatcgtcatccatccggcccccactgaaggacagcaatacggccacctatcatggtttgacatgatgtggaacctgccggaggtccaggaatggacgggtgacttccaggagattttgagcagttctccggtaggcaacaaaacctatggcccatatgacgcatacatcaaggcattgatgcgcctgttccccgacgagatggacccatcgttggaggacgggagcgacgatgacgacgatggcgaggacgtgttgtattcataccagaaacgcaatgcgggcatactcatcaacaagctcaacaggatgggtacggtgatactcgcggactccgtcggcctgggcaagacagtcaccgcaggtgctgtcatcaatcatttcaggaagaacggccggcggaacatcgccatcctgcctccggccaagctgaaggatcaatggaagtccgatctgcaggaatttttcggccttgacgaatccagctatagcttggtgtcgcagcaggatatccaggccatccgacggttgggggacgcctaccgcaggtcgtatcccgccgatctgatcgtcattgacgaggcacacaacctccgcaacaaacgttccgaacggttcaacgccattctgaagttagtcggggataatcccaaggccaaggtgttgctgctgacggccactcccatcaacaacgggttcagggatttggtcagcgagctggagcttggcttgggcggtcgcatgcattccggaattatggtgtcgtatcaggatcctggtggcgcatatgtgccatcccaggatttctttgagttccttgaggaactcgacggcaagaagaaggttgccgagagcaagggaaagtcatttgactgggaagcgtatcgtcagccactgtcccagggcatcagccggttcgtggtccgctcgacccgccagggagttcaggaagaggcggagctgatggcgaatgggaatggtccggtgatgcgctttccggacaacgtgttcgtcacaatcgattatgcgtttcccccgcgggccgtgcagaaggttgaatccaccatcgaccgtcatgccgccgtgttcgagggcatcgatccacttgccgtagatgatgacgagctgtccgccgagacgcaacggttgcgacaccctctggatatcatctcgcaggacgtggggagattccaaggattgagggagccatcgtcactggtgcgggatgtgttctccctggtatcgctgctgggattccctatgtaccgagctgagctgtattcttggcagtacaggaacatgggcgtgaaagaaatcggattgctggaccttccctccgatgatctcatgcggttgcgctccgccatgacgatccacaacatcctgcagaccctctggctgaagcgtctcgaatcctcgctgcaggcgctacggctgtccgtggaacgctaccggtaccgtctgaacaggttcgccgaatgcttggggaagggatacgttatcgagtcgtccgcgttgtcgttgctggaaaatgacgaggaggaacagtcgcggttgtcgttctgggacgaaccggtgaaggatttcgaggaggagctcaagggtcggggcatatcttatgccaaggcggacgaggacgcctttgatatgcgtggcctacttcgtgacgtggagcgtgaccaacgcatcacggatgttatcctcgatgtgttgaaatcatgcatcgagggagagctggatgccaagcttgatgcctttgctgaggagttcgccaaggcccttcatgatggacgattcggtgggaaggtactggtcttcagcgcttacgccgacaccatcgattatctgcggatggctttgccggtgcgactgaaagacatcgttcccgatttcgacagaaaggcggccttcctgaccgcatcctcctccgacctgaacaatatcgtgggacgcttctctccggtgtccaagaagcgtgtgctttccggacccgaggaggaattggactacctgttctcgacggatgtgctgtcggaggggcagaacctgcaggacgcggccatcctcatcaactatgacctccattggaatccagttcgcatggtgcagcgcaacggacgcatcaaccggctgggctcccggttcgaccaagtgctcatcggcaacatggctcccgccaaggatttggactattacttggggctcatcgatcgcttgcagggcaagatcgacaccatcaagaactcgatcggcaccgaccaaggcgtgctgactgtcgaggacgagaaccccattgaatacatccaggacctgtacagcggtgacgatgccagaattcaggaggtgatggataccgtcgaggcggacaacgacatgctgtcgtggaggaacacccatgtgtatgcgctgcgggagttcctgcagcatgcgacgcagaaagacctcgaccgcatcaacgcgatgccaaggggcaagtggaactatctgccatccgattcgcaactgaagaaatcggtggtgatgatgtgtgagcaggccggtggcataggcaacgggatgaactaccggttcatccgtgtggagaccagggcacggctcttggccgaaccgattacgagcgaggaagccttgggtctgctgagaaccaaccccgaggacaatgcgagaaaaccggacaatgctcagctggaccggtccgtcatggagaagttggcaatctccatggctgggatgcgtgcggcctccaaggcctcggggaagttcacgccaagaaaaaacgagatggaaccgctggcgttgctgcagaagcagttgggtgtcaaacagctgcggaaagcactggcccccgtgcaaagcctggtacaggccaagcagcggtacgatgcactgatgagccggctgcggaaggaagcccagatgtccggaggatttgcctcgctggaaatcagtgaacagctgctgtccgattggagttccttccttagggacatcgaccaggatggcgacaaagatggcggcaaatggcgccccgtcatggccggcatgtctgtcgatctatgatggcgtggccacggggagcgcgtcggtatacaatccttaaagctttgggcgcatagtcggaaggaatggcatgattacgttcactggtctgcagcaggcccttgacgagtatggcgagcgcacgtccaccgacacggaggacgttgaccgcaagattgcggccatgcgcgtggcgatgcaggtgctcgccatccttcgtggcatcggagccgatgacatcgacgccgaaatcgaggaggctttgctccgtccggtgcccgtggacaggcacggggaatggttcgtcacccatccacagatgctgcgcacagctttcgtctgtgatctggccgatgagaacgagctgttccaagctacgttcagcgcgttgaggggaaccgccacgaaggcacgcatcagcgcatgcgtggcgatgtcccctcgttgggaggacggtgagctctttgaggacgagccggtcggggtgagtttttttgccccagccaatgttccctccattgtcatggtggtgtccagagcgggcaacttgcgtaccatggagctgcgcggtgaattgtcgaacacgcagaagcgcatcctggacaagctgcatggggtactggccggaggcgagccggatgggtccgtcgaggaatcggacaaggcgcgtgcgcatgcggcgatgtgggatgcgctcaacgtcgccgaggtcaaccagcgcttctatgctggtatcgccgcacggttcaacgaattggtcaaggcgcttgttgccgccggacatgacgagggtgacgcgaagatgttcgccagccgtttgatcggacgcattctcttcgtctggttcctcaaccagaaggaattcattaatccagatgagcattatttggagattggggacctggactctacggagtattacgaacaaaagttgaagcgtctgttcttcgcaactttgaatacggcgaagaatcgtcgcggagaagacggagataagcttacgccattcctgaatggtggtctgttcgaagagcaatgtactgatttcccggatgagtcgattccatttccggaggggttctttgccggtctgtatacacattttggccaatatgattttactaccgacgagtccactccggattacgagcaagtggccatcgacccggagatgctagggcgtatcttcgagtcgctgcttgctgagcaaatggatgacaccggcaagacggcccgtaatgccagaggcgcgttctacactccgcgtgagattgtgacatacatgtgccgtgaagccttgcgccaatacctgtatcgtacacttggcagcggcaatggtatccatcaaggtattgataagttgctggatactcccgatggcaagtgggaaagtgacagcgatccccgcaggtctttgtggaactcgaataccgccacgatgttgccacaggccatcgcggcacttgagagggtccgagtgttggacccggcctgcggttcaggcgcattccccatgggaatgctgcagttgttgatgaggtgccgtgtccggctgatggggaaggcggctactgttgacgcctatcagcagaagttggagattttgcagaacaacgtgttcggtgccgatattgagccgatggcggtggagattgcccgtttgcgtgtttggttgtccatgattgtggaacgagaatcgattggacaagtcgagccgctgccgaatttggactttaagtttgtctgtgctgattccttggtgccattggccaacgaggatgtatctggtactgatcaggtcagaggcatgacgattgctgacgtgtcgttgaagaaagggattctggatcagggggccttcgatttagccgacgagagtgaattacttgaacagctgaagaagattcgttcacgctactttgccgccaccgattctgagcgtaagagcgagctaatgcatcagtttgaagagatttcaaaccagttgggcggcggtgtatcctcttcaagaggtcggcaaattgccgattttcatcctcattcgtccactatatccgagaccggtcatgcaccgttctttgacccagattttatgttcggcaccgatgcattcgatgtgattataggcaacccgccatatgtgcagttgcagaagatgaagaaccaacgtgttgcatacgaatcattgggataccaatcatacaacaaaaccggtgacttatacgagttgttctatgagcgcggattggaactgttgtccaagtatggagtactgaattacattacatcgaacaagtggatgcgtaaccggtacggcaaggagctgcgcgagtacctatcccggaatgcggaggtgatttcgctcatcgatttgggcgcaggtcgcttcagcagcgccaccgttgatacgaacatcgtgttactcgccaagggtcgctcggacaaggtgtttcaggccgtgaagtatgcggacgactcgttggcggacattgcggcatatgtcgcggagcgtgcaacaacgataccgttcaagtttgttgatggtaacactgcgtcagatgttggcaagaaggtgccggacggtggaccatgggtcattctcactgacatagagcgtgatatcaaggccaaaatggaagaggttggcactccgcttaagcagcttgatgtacgtatttaccgtggtgttctaaccggcctcaacgatgccttcatcatcgataaagcaaaacgtgatgagttaattgccgctgaccccaagagcgccgagatcatccgtcccgtgctacgcggtcgcgacattaaacgctatcactatgaattcgcggatcagtacatgattgcaacccacaatggttacaagtatgatgacactgtttttccccgcgtggatgtagaaaaatatccggctgtcaaggaatggctgagttcgttcgagcctaagctctccgaacgtgccgatcaaggagacaccccatataatctacgtaagtgcgcctatatgggcgatttttcgcaaccgaagatcatgtggggagagatttccgacaaggcgaagttcgcattcgacaaagagggactatttgtagctcctaattctgtgttcatgttgcttggcagttccttgccggaattgacggcatatttgaattctgatttagctgagtatgccttctccactatgggaaccactaccggaatgggaacggttcgatggcagaagcagaaggtggaacttattcctgttcctcaatttaatccacaggtatgcgaggatctcaaatcattgatgaagcaaattagctcgttgtcaagttctactcagaagtggaaggattgccgtcaagcaatcaataattgcatatattcgtcgacgggattagtcgacaaagaacgtaatttcattagacagcagataaggtgattgcccaagcaagcgttgtcggaacgcaccgacaacgccaccactgccgttgctgcttattgcagtatcctaatttctcggttattgatcccataaaggtcgcagactatgtcgtttatctgttcctcgtattcggggacctcttcgcgttgtccactttgtattgcttgagccagcgaggcaactcgagttcgctccttctccggcacgttctgcggaattggtatctgctccacaaagactggcttgtactccatatagccaccactgcgagtaacaccgacctgatgtacgtaccaatctgctgctttagaatttaggacacctagcaggaaccagtcatcagtggcgatgaacggagaaggcgcgcaaacaatagcatcgtccttcaccatggcgtattgggctcgcaggcataagttaccccacactatcttcggttgcgaaaaatcgcccctttgcctgcggcatctgtgacactggtaattgtgatttacggttatgttcgggtgagtagtgacaagcaaacactggagaatcaacgatttgaaattgagcgtttcacctgtgtcgaaggactgaaagtagatgaatgggtggaggagaccatcagcggcactaaagctctagacaaacgaaaactgggtccactattggatagagtaggagaaggtgatcttatcgtctgttcagagctttcgcgtttggggcgtagcctgttcatgattatggacgtgcttggggaatgtatgaacagaggatgccgggtgtggactatcaaggatggttaccgtttgggtgatgatatccagagcaaggtattagcgtttgcattcggactgtcagctgagattgagcgcaacttaattagtcagcgaaccaaagaggccttggcacgacgtcgagcagagggtgtgcgattagggcgaccagtgggaagcttatcagcaacagtaaagctgtcaggctatgaggcagacattcatgccatgctggagcaaggctgtaccaaggctgacattgcccgtaaataccacgttcaccgttctaccgttggtaggttcattaataaccatatgtctgatttatgactacaatttcgcggaatgctgcatctcaaggacttttaaatctttgaaattgcaacattccgcgggattgaccactcgttgatcacttcacgcgcttgatgccgagaacggcaacggcggcgatgatggccatcgcgatggtggtcgggaacacgaagttgtaggagcccagaatcgtgacgatgctggaggtaattgccacgccaatggcctggccggcgcaggtggcgatgttcatgaatccgaggtccttgcctgcggtctccttgttcggcagcacatccacgttcagcgcctggtcaacggacagatacatgccgtagccgaaggaagcgataccgccgaagaggtacatgcccatcgcggtcgggaaaatccatggcatggccagacccacggcgaatacggcgcaggcgaccatgatcggggccttgcggcggccgagggcgtcggcgatcgggccggagatcagagaggcaaccatcgaggcgatcatcgtgagcacggaaatgacctgaatggtggcggcggcttgggtcttggactggccgatgtggtcttgcgggatatacagctgataactgaagatcatctggtaggcaacgatgagacaggtgcggcagatgaaggcgcggtagaaatcgccgcaatccttcagcggcggggtaagggactcaacaacgaccttccacagcggtttgccggcatccttgtgcatgttcttggaagagggttcacgcggggcgataaccacggcaagcacgccggcgagcagtgcgcacaggccggtgcacacgaagccgacttccatgttggtgatgaagagggagccgatcagcgtgccgatgccctggccgatcacaccgccgccgccgatggccgcggagatcgtggcgcgggattcctcttcaacacggtcggaaatcagcgcgtagatcggaacctgcaccatgttgagtccggtgagggcgagcacatagcagatgccaataatcagagcgctggacgggcggctcagcgaccagaagcagatgccatacacgaaagcgccggtgaagatccaaggcgtgcggcggccccacttgctggcggtgcggtcggacagagcgccgacgaacaaggcgatgaaaatggaggcgacggagcctgcggagttgatggcgccgagcacggcggtggagttttcgatgcccagatcgcgcagacgctgcggaaccaggatggacatcgtgccgtagaaggcgatgccggataggacggcgaaggccgtgaaggccgcggtatagcgccacttgttggttttggaggacgggctcggggccacgcttgcagttgtcatgattgcagctttcccttcgttgagggattacatggagaggattacggattactcggatttcatgtgggtgcgtgcgggggccctctgtgtggaagggccccgcacgaggcggtcatcagcggagctgaatccaagcggacgtgtcttgcggaagcaggccgtcctcggtgagcgagccggaagtccagagcaccttgccggcgggcagcgcggccggatcggcgccgaagttggtgatcgaggcccagccattggcgcgcttgtaggcgatggtacttccagtgaatccgttggcaccgtcaggtttgccagaagaacggtcctcgggtaaccaagcgaggctcaaatcggtggtttgcagctcgtggcgcagcgcgagagcgcggcggtacaggttgagcatggaatccgggtcagcgctttccacatcaacggcgaaatccttgtaccacttgggctgcggcagatgcggctcggcggcaggggtaccgtcggcgcgagtcgcgggggagaagccgaaggagccgtcggtgccaaactcatcggacgggtcggcaagattcggcgcatccgcgctgttccacggcagcggcacgcggcagccgtcgcggcccttggtggacgcggcctgcgaggtgcggtggccggacgggtcttccacacgatcccacggaatatccgccacctcgaacaggcctagctcttcaccctgatagacgtaggcggaaccgggcagcgccatctccataagcacggcggcgcgggcacgcttggtgccgagctccttgtccagcgggcaggtggtgccatctcgcagcacccagtccttggcgagctggtggtattcgctggtcggcacctgcggcagaccgtagcgggtggcgtggcggaccacatcgtggttgctcatcacccatgtggcggaggagccggagtgttcgacgctggcgataccctcttcgatggcctggtgcatggcgtcgcgaatccagtccttcttggcgaactcgaagttgaagatctgtcccagatcgtcgggactggcgtacaggtactggcggttgggttgcacccacgcctcggccacggcgaacgccggaggattgtactcgttgaagaccttgcgccactcgtggtagatctcatgcacttcgtcgcggtcgattaccgggtgcgtgccgtcatccggctggtcggacgtgcaccacaccacgtagtcgtcgaggtcgtcgcggtcgagatccttggccaaaccgtgggccacgtccacgcggaaaccatcggcaccgtggtcgagccagaagtgcagcgtggtgaggaagtcgtcgcgtacctcgcggttgttccagttccagtcgggctgctccttggtgaacatgtgcaggtaccactggccgtcgggcacgcgggtccaggccgggccgccgaagtggctctcccagttggtgggcggctggtcgccgttcgggcctttgccgtcgcggaagatgtagcggtcgcgttcgggggagccgggggtgtctgtttccacggtgtcccgggcattgcgagggcttgataaagtcaaccctgagactcgcgccaaagtggaggcggctgccgaacgcctgcatttctcgttctcgaaaacggcattctcgctggccagcggcaaatccatgcgtgtggccgtgcttatgcccaacgaaatcagcagctggttcaacgcgcatacctttgaaggtatttacgaggtgctttcgcgcgagggatatgacgtggtgccctatgtgatgtggggcgacgctgaccttgaacggtttttccataccctgcccggcacgcagaacatcgatgccgtgttcatcgtctcgttcgtgttggacgtcgccaaacaacgtgtgctgtcctctctgacggtaccggtcgtcggcatcaataccccctctactgatgggtttgacgcctcggtgcggattgatgacatcgccgcaatgcgtggtgtggtacggctgctgcgctcgttcggccatgaaagcgtggcatacgtggagcagccgatgcagccttcccctttcgtatgcagcgactcggtgcgcatggaaggtttcctcagagcagttgacgatcagaggtacgacgacgggcatgtgctggtgattccttctgcggaacaggcgacgatgggcaatgaggctgccgccgtctctgatatcgcggcgcaacttatcggttccgatacacaacccaccggtatctgtgtggagaatgaccgatgcgaggtgctgctgctcaaggaactgcgccggttggggtggcgtatccccgaagaggtttccttggtcggctttgatggtgaaccgctgagcgatgtggccgatttgaccacggtgcgtcaggacccattgagtggcgggcggctggctgcaaacaaggcaatggctcttatgcggggcgagacgctggacgagcctcatacggttatgcctacttcgctgctgatgcgtgccaccactgcgcgccttggccggtgagctgatagggcgcgtggaacatcggctgcgagtctgaggtctgatgactgggtgtttgcgggggcggtttccgggctgcgggcaatttgtagtggctgcgctgtagtctgaactgttctgcaaacgcgaaggcatgcgcatgtcaggcaatggcatgcaagaaaatgcaaggaaaagaggcataccatggtcgacagccatgacgcggaaacatacagcgcgaagggctcgcgcctgatctggatcgattgcgagatgaccggactcgacatcttcggcggcgacgaactggttgaagtctccgtggttcccaccgattttgatttgaacgtactggacaagggcgtggattacgttatcaagccttccgagaaggcagtaaaccatatgaatgatttcgtgcgtgccatgcacacccgttccgggctcatcaacgaatggaagaccggcctgagtcttgccgaggccgagcagaaggtcaccgagtacgtgctgcgcttcacgccggaaggcgtgcgcccgctgctggccggcaacaccatcggctccgacaagaagttcctcgaccactacatgccaggcctcatgagccacctgcactaccgcagcgtggacgtgagcaccctgaaggagctcgcccgccgctggtacccggccgtctacgagaaccgtccgccgaagaacggcggccaccgtgccctcgccgacatcatcgagtctttggacgagctgcgctactaccgcaaggccttcatggctccggcacccggcccggacgatgccgcctccaaggccatcgtcgccgacatcgtggccaccagcattctcaataagtagtccgccgtacttggctcccctcacagaggggagcttagagaggttgatatgcgccaaaccgaagccttggacattctgaacgccggcgcgaacgtgttcctgaccggtgcgcccggtgccggcaagacttatgtcttgaacgagttcatccgtcaggctcgggccgatggcgccagcgtggctgtcaccgcgtctaccggcatcgcctccacacatatcaatggccagactatccactcgtggagcggcgtcggcgtggccaccgccttgagcccgagtctgctcaaactcatcagatcccggcgcaaacgcaagattcaggctacggacatcctcgtcatcgacgaggtctccatgctgcacgcatggttgttcgacatggtcgatcaggtctgccgcgaagtgcgccgcgacccgcgcccgttcggcggcatccaggtcgtgctgtccggcgacttcttccaactgccgccggtttcggtgtccgggcgcaaccgcgacctcatcgcccccacgcccgaatttatctccagccgagaacggtatgcccgtgccgggctcaatccggaaggcttcatcaccgaatcgctggtgtggcccgaacttaacccggtgatttgctatctgaccgaacagcaccgtcaggacaccggcgaactgctgaccgtgctcaccgacattcgcgaaggcgacgtgacccagtccgaccgtgatgtgctcgtcacccgtctgggcaaactgcccgagcccggccaggtcgccgttcacctgttcccggtgaaccggcaggccgacaatctcaacgacatgcgcctgaaccaaataatgcttgaaccgcatgagttccatgccgaaaccgctggccccgccaacctggtcgaccgactcaaaaagaacatgctggctcccgaacgactggtgctcaaagagggcgcggccgtcatggccctgcgcaacgacaccgatcgtcagtacgtcaacggctcgctcggcaccgtgcgcggcttcgcgcaggaaaacaagggcggctggccgatcgtggaattcgaaaacggcaacatcgtcaccatgaaacaggccacatgggaaatgatggacggcgacaccgtgctcgcctccgtctctcaagtgccactgcgttgcgcgtggggcatcaccatccacaaatcgcaaggcatgacgctcgaccgtgcggtcatggacctgaagcgcaccttcgcgccgggaatgggatatgtggcgctgtcacgagtcgaatcgctgggcggactgtatttggctggcgtcaacgaacgcatgttcctcgtctcgcccgatgccgtggtactcgacggcgacttgcgcgaagcctcggccgcggcctccgaccagttggccgacgaaggcgcaaacgcgttcaaacccgccgagccggacgaattcgccgccaatcccaatgacgacttcgcccaagctgccttgttctgatggtcgatgtatcgaatgactactaattggagcgtttctgcgtttcaaggggctgattttgggttttcgggacatctatctccgtttcaaggggctgatgcccaagtagacaacgatcaaaaatggcggaatgacgttggcatgaagccgattctacttccgatttagcggatgaccagccccttgaaacgcaagtagatgtccccaaaaggcgaaatcagcccctcgaaacgcaagtagacgccgctggcatgccttcgttgaagaattgggcgactaccatggaataagaggtggtagttatgatgctatccgagatatttcgtgaaaacaatgaggttcgcggggccgcccgagctggtgctggcgcaatacgcccgccagcggtggccggtttgttctaccccgcctaccgcacagcgctcaagcaactcattaaccatcagctggattacggccgagagcttctgaaacagttggaacccacgcttccagcgggggttccgaaggccgtaatcgtgcctcacgccggttatgtctattccggtacgacagcagcgcttgcttatgccttgctcgaacgagggcgggggagcgtgagtcgtgcggtaatcgtggggccgactcaccgtgtggccgtgcgaggcgttgcttgctctaccgcagcggcgtttgaaacgccgctgggcacggtgccgatagatgttgttgctgagcgtaaagatttaggcttggaatcggcttccgatgagccgcttcgttccggtacacatgctcgtccggggcaccggctcccgcaatgattgtcaatgaccccacacatgcgcaggagcatgccgtggaagtacaaattccgttcctgcaaaccgtgcttggtccagacctcactattgtgccgttgaatgcgggcgacgccacgccgcaagaggtgggcgatgtgttgcgtgctttgtggggcggaccggaagcgggcgactgcgcggctgcatcggttcgctggtcgcctaccgttcgctcggcaaggacatagctgcacatgcggtggacgccgccacccgtgacccacgtttcaacccggtcaccgctgcggaatacccgttactcaatatggagatatccgtcttaggcgagcccgagccgattaccgtgaactcccgtgatgtcgatttgcgcagcaccggttcgaagaccgagagcttggtacctactcagtccgggcctggaactgatgcgttcaaacgggacgacgaaaacgacgaacgcccggtacgatcacgcatggaactagaggctgcactgcgccccggcagggacggtctgattctcgccgaccgtcgtggccgcagcgccacattcctgccacaagtgtgggatgagctgcccgattcgcatgacttcgcctctcatctgctcgccaaggctggcatccgcccgtcctacgactggaccgatggcgaaatcgactgccaacgctacgaggtgacggcctatgccgagcactaacacagcaactgttttctcacccaccggtgtgagcctccatagttcttcgcctactgcccctactgctcctcccgctggcgggagatggcgcgaagcgccggagggtggtcatcgagaatcagagggtggtcatcgggaatcgcacggttatacggtagccacgcatggccgcaatcccgccataggacgctggcaaacgcaattccacgacggtaccaaccgcgctcgctgcgaactatgcccgcgccgctgcgtcctcaagcccggccaacgcggcttttgcttcgtccgctcaaaccacgacggactcatcgtctccgacacctacggccgcagctccggcttcgccgtggacccagtggaaaagaagccgctcaaccacttccaccccggttccagtgtgctgagtttcggcacggctggctgcaattccggttgccgattctgccaaaactgggatattgccaaagcccgcagcttcgaccggctcggcatggaagccagtccggagaaaatcgcgcaggtcgcggccgaccggggcatcgattcggcggcgttcacctataacgatccgatcgtgttcgccgaatatgccatcgacacggccgaagcctgccgagcgctcggcatccatcccatcgccgtgactgccggatacatgagcgccgaagcccggcccgacttctacgcggccatggacgccgccaacatcgacctcaaaggcttcaccgaagagttctattggaaagtgaccggcactcatctggccgatgtgctcgagaccatcgactatgcggtcaacgaggcacgcacaccagaaggcgaacacgtgtgggtggagctcaccacgctactcatccctggattcaacgatgacgacgcccagctgcatgctgaatgtacatggatacgcgagcacttgggtccggacgtgccgctgcacttctccgcattccaccccagttaccgcatgatggacgtaccgcccaccccgcacgagactctgacccgcgcccgagacatcgccctcgaagagggactcaattatgtgtacacaggcaacgtgcatgatcgtgaaggcgataccacgtattgcccaaaccctgaatgccgggccaagctcgtggaacgcgattggtatcgaatcattgccaatcgtttatctgccggatacggtggcaatgggcactgccccgtatgcaggactgctatcgccggacgttggtaatctgcctcaggtcgcccgcgcgattcaccgcagatcgccaatacgcgcggcaatcgtcctcatcgatttgaggctcgcctcatagcgcgcggctgccacaatcagaatgatgccgcccaaagcaagccacaatgccggccagctacgcagcatcgggcgtacttgcggcaaacgcacacccacaatcagcgcggccgctccggacaggccggcgataagatccaccggggcatacggttgcgggttggtccatgcaagaccgaggagtattacgccggcaagaatggtggcgcatgtctcaataacctgtgatgcggtcagccgtcccgacgaacgcccgaatcgctcttgcgcgactgatggttggttcggctgggccattgccggattcgggtaggggcagggagaagcataggcccggcccggctgttacggttgatacgggcaggccgcttgttccgggaccgacataggcgattgcgcaaacggtggcatggccattggctgttgcgataccgcttgttgtggaactgccgttgggaattgcgggggctgcagcagaaaattgcggggcccatgctggggccggttgatacaccggctgctccgaggattccggctgattcccctgttgctcggtcggttgcgtcatcgtgcccttctacccttctagccgtcattgttgcacgagtgagtccgaatgccaagatgaaggtcggaatagtgcgaatagcaggcgggcttgtcggttcacgcgaatatcgtggaacacatgacttccaatacccttcgtatgtcaaccatgttcctgcgcaccctgcgcgaggaccccgctgatgccgatgtcgattcggccaagctgctgcagcgcgccggctatatccgcaaggccgcacctggtatctggacctggctgccgctcggtctgcgcgtgctgaacaagatcgaggccatcatccgcgaggagatcaacggcatcggcgcccaggaagtgcacttcccggccctgctgccgcgcgaaccctacgaggccacccatcgctgggaggagtacggcgataacatcttccgtttgaaggatcgccacgaggccgattacctgctggcccccacccacgaggagatgttcacccttctggtcaaggacatgtactcctcttacaaggacctgcccgtcaccctgtaccagatccagaccaagtaccgcgacgagttccgtccgcgcgccggcctgatccgtggtcgtgaattcgtcatgaaggacgcctattccttcaccatcgatgaagaaggcatgcgcaaggcctactacgacgagcgcggcgcctacgagcgtatcttccagcgtctcgacctgaagtacgtacctgtgttcgccatgtccggcccgatgggcggctccgcatccgaggagttcctggctccgatgccgatcggcgaagataccttcgcgctggcaccttccggcaaggcatggaatgttgaggccttgagcactccggagctgccggaaatcgatgcttccaccactcccgccgcttccaaggaagccaccccggatgccaagaccatcgataacatgatcgagcgtgccaacgccgaccacccgcgtactgatggccgtgaatggcaggcttccgacatcctcaagaacgtggtgatcaccgtcaagcaccctgaggatgaagagcatgacgagccgtggcgtgaagtgattgtcgtcggcgtgcccggcgaccgtacggtggatatgaagcgactggaagcccagttcgcgcccgccgaacttgaggaagccactgaggaagacctgaagcagcaccccgaactggtgcccggttacatcggaccgatggtgcttggcccgcaggccgaggctgctggcgtgaagaacccggttcgctacctgatcgacgcgcacgtggtcaagggttccgcttggttcactggtgccgatgagaacgaggtcgactactacaacctggtgtacggccgtgacttcaaggtcgacggcgtggtggaagccgttgaggttcgccacggcgacatgagcccggatggttccggtccgttgagcttcgagcgtggtgtggaaatcggccaggtgttccagctgggtctcaagtactccaaggcactggacctgaaggtgctcgaccagaacggcaaggccgtgccggtgtggatgggctgctatggcatcggtgtttcccgcgtgctggcctgcatcgccgaaacacaccacgacgaagccggcttggcttggccgtccgtgattgccccggctgccgtgcacgtggtggccaccggcaaggacgccgtggcgtttgaaggtgccgagaagctggtcgccgagcttgaagccaagggccttgaggttatttacgatgaccgcaagaaggtgtctccgggcgtcaagttcaaggatgccgagctgatcggcgtgccgctggtcgccgtggtcggccgcgattacgtcaacgacggcaccatcgaactgcgcgaccgcaacggcgaaaacaaggtcgccgtgcccgccgccgaagccgccgacgcgctcgccgagcgcttcgccgccctcagttgagtcccacttactcagcctcggcgttaatcgcatcaagcgccattctgcccagtcgcagaatggcgctttgctgtggataaccgaaacttatccacattcttaaaaattcaactgcgtcacagtatccacatttgccagttgcccttgtgcacttcaaacgtcatgcctcacagtggaggtaccgctggggcgtgcaagccggcaatgaagccggagacaggctccggcggtccacatccaaacaacaggccagcaggccgaggaaaggaccgatcatggcaaatcaacaagcagcagtgaccgtcaccggctttgtggccggtgatccgacactaggcggaaccgagagcttccgcgtgctgacattccgtatgggcagcacgcgcagtcgactcaacccgactaccagacaatgggaggattacggaaccgcatgggtgggcgtcaaagcgttccgtgctttggccgtgaacgccgccagttcggttcgccgcggtgaccgcatcattgtggtcggctcactcatcaccgagcagtggaccaatgagcaaggcgaaccgcgcagtagaaccgttctcgaagccaccaacattgggcatgacctgaccttcggcaccacgtcgctgatcaagccacagcgtgccggtaatgggaacggaggcaatggtggcaacggtaacggcaatgccaacggtgccgtcgaaggtatggatggcggaaacgggcaacgagcatcgtcgccgtacgttaggccaacgcaatatggcgcgggcggtgccgcatccggtgtgggtattgacccgtatgcgacctcgtcggaatctggccccgtcgaatttggggtcacctccgattccggccaatcgccgtcgccatcaaccgagtccgcggccgtggccgatgccgtcatgtcgcaaccggacgccgacaccaatcaaccacagcccgtggcccaacaaacctacgtcgacggtttcgccgaatcttccaatcccagtgattccgaattctgagtgccaaccatacatcatgaaaaaccgctgtgttcgcctgtaatcgaggcaaacacagcggttttcctttacataacggggattaccaaatacgcacacggtccttgggcgcgagccacatggcgtcgccttcggtcacgccaaaggcatcgtagaagaggtccacgttgctggcgatgccgttggtgcggaattcggccggagaatgcgggtcgatctgcaggtactgttcggccagctcgtcgcggttcttggtgcgccagatggaggcgtagctcaggaagaagcgctgcaggccggtgaatccgtccatttcgggggcggtatcgagcagtgccttgatggcggcgggggagccgtcttcttcggtgtcggacttacctgccgccttgccgagcgcgaatgcatacgccttgagcgcgatgttcacgccgcccaaatcgccgatattctcgccgatggtcagcgcgccgttcacatgtggtgccttatccggctcgtcagcgtacttctcggccagctgcagcggcacaaagctgttgtactgggcgatcaatgcgccggtacgggcctcgaagttcttgcgatcctcgtcggtccaccagttgttgagcttgccgtcgccgtcgtactgcgaaccctgatcgtcgaagccatggccgatctcgtggccgatcactgcgccgatgccgccgtagttcgccgcatcctcggccttcgggtcgaagaacgggggctgcagaatcgcggcagggaacacgatgacgttcatgcttggctcgtagtaggcgttcaccgtctgcggattcatcagccattcgtccttgtcgaccgacttgccgaccttggccagctgatagccggtctcgtacaggttcgcggccttggcgttctcggcgggtagcgcatccgcggagacactcagcgccgaataatcgcgccagtggttggtgtagccgatcttcggcgtgaacttggagatcttctccagagccttggccttggtgtcttcgcccagccaatcggaattggtgatggacacgcggtaggcgtcaatcagattggcgaccagctcttccatgcggcgcttcgagctttcggggaagtgcaggcgcacgtattcgcggcccacatcttcaccacaaatgccgttgaccaggctcaccgcgcgcttccaacgatcgcgctgcttcttggcaccggagagcaccttgccgtagaagtcaaagttggtggtgtcgaagtcgcgagacagggaggaggcgaagcccagaatcatgtgaacacgggcccacagcttaaggtcggccagatcggcctcggcccagaacgcatcaagaccagtgaggaagctcggctcgtgcacaatgacgcgcgcgaacacagacttgaaatcgatcggctgagccttggcggcctcggtggcgtcataggcggtctgccaggcgtcgatccaagaactgagatcgaagttcttcagcgtggcggccaaatcggcgtaatcagtggggttgtaggtcttcaccgagtcgcgcgtggccacattgtcccaatggttggcggcgatcttcgtttccacaccaaggaagtggcgggccatatcaagcgcggcttcgctgggaaccgtggcgggagcgttgctctcgtcatcgccggtgttggacggcagctcatcgccaccgttggactcggcggcgggcgcgtatccggcgttcaccagctgggtggcgaccatcgccacgtatgcttcgcgcacgggagcatagtggtcttcgcgatagtaggcctcatccggcaagcacaggccggcctgctcaaggtgggcgatattgcggtccgggtcgccgggatcgccgtaaacggccaagccgaacaggtcggggccgccggctgggttgatggtgccgagcacgcgcgtgagagcggccttgtcgatggcggaatcgatgaggtcaagctcgtcgcggattgggtcaagaccggcggcctctatggcgtcggtgttgaggaatgagcggtacagggcctcagacttgacagccgggcagtcgtcggcgtcgaggatgtcgcgtacttggttttcggcgtcttcggcaagcttgtcgaaggagccgtagcgcgaacgatcgtcgggtaggcggtaggtgtcgatccatgggccattcacgtagcggaacaggtcattggtcggcttgatgacggaggagaacgatgccgggtcgatgcccgacgtcagcgtttcggtttcgttggtcatggccctaagcctaatcacggcgggggagaagcgctgatggtgcagatattgcgttatgggcattgcgctgtcagtgaactagacagattgcctaattgtggtgatggttcaaattagacaacttgtctatcatagtatgtggaatctgaacatggaccttgagctaaggagttacgatgagcaatccgaacgaggaccagtggaatggccagacgggccagcccaaccagagccagccgaaccagccgaatccggcgggtcaaccgggccaaccgcagtatggtgcgtatgacagcaatcatggcggccaatatcctccgcaaggtgcgccgggagcgcaagacactcagaatcagcatgcgcagaacggccagccacaaggcgaaccgaaccagaacccgtactacggcccgtacgcctacaatccgaactatggcccgaacggccagccggcatgggggccggacggtcggcggtatcaggcggacggccaatcgaatagccaagcggacgggcagccgaatggtccatggggcgatcaaagtcaacccggctggcagcagaccaactggtatgtcggcaatttcagtccattccgcctgatcgaggaatggctgccggaaaaagccaagaccaagattcgcatcatttacggcgtggtgggcgtggccgccatcgccttgggcgctgcgctgttgctggtgccgaacaagacgctggctttggccgcattgttgctcggcgtgtatttcgtgatttccggcgtggtgcgcatcgtcagcgctctcgtggagccgggtctgccgggcggctggcgtgtgctggacgtgttcgtcggcattctgctgacctttggcggcgtggtggttgtgcgcaactacggcatgaccggtcagacgctggcattactcattactttgatggtcggtttcggatggattatggaaggcgtgctgtcgctggttgaatcgtggcgtatcccgcattccggctgggccatcgcctatgccatcatctcgattatcgccggcttcgtggtgctgatgagcccgctgagctccgccgtattcatgattatcttcggcggatgcgccatggtggtgatggggattacttcagtgattcgcgcgttcactttcggcaagcgtcgcaagtaatctcacgcttcatgcaaccagtccccagacaatcaatccaaagcgcccgtgcaggctatgtgctgccgggcgctttttctcggccttggctattaatgggctgcgagtggatttcaggtaggcttctggcggttgacctcgggctggtctagagttgagaacaagtctcaacaaggtagaaagaatctcatgatcgaactgaaaacccctcgtgaaatcgaggaaatgaagccggctggtcgttttgtcggcggcattctgaaggaactgcaggagaccaccaaagttggtaccaacctgctcgaaatcgacgagttcgtccacaagaagatcgtggaccgcaagggcgccgaatcctgctatgttgactacgctcctgacttcggcaccggcccgttcgcccactacatctgcacctccgtcaacgacgccgtgctgcacggcgtgccgtacgactacagcctgaaggacggcgacctcgtctccctcgatctcgccatctctgtggacggctgggtggccgattccgccgtcagcttcgtggtcggcaaagacccggaccccgaagacctgcgcatcatcaagtgcactgaggaagcgctcgccgccgccatcgacgtggccaagcccggcaaccgtctcggcgacatctccaacaccatcggcgacgtcgcgcgcgaatacggctacccgatcaacctcgagttcggcggtcacggcgtgggccacatcatgcacggcgacccgcacgtgccgaacgacggccgcgcccaccacggctacaagctgcgcgaaggcctggtcatcgccatcgaaccgtggttcctcaagaccaccgacgagatcttccaggatccgaaggacggctggaccctgcgtgcctccgacggctcgcgcggcgcccactccgagcacaccatcgccatcaccgagaacggcccgatcgtcttcaccgatcgcaccaacctctgatcggcgtttggcgtatggtaggtgcctgattggcctgtgatgggcgatcagcgtctcattagccgtccgtctgttcgcggttttcccgcgaattcgagacgtaacaagccgaagtgcgtttgctttgatagcatgagcgcacttcggctttcgtgtatcgaccggcattcgccagcggtaacacagaagacatagagtaccgaacactagtgttcgcgaacgcgtgaacgttaatgtttggggtaagtggttcatgaagaggaaggtgcgcgaatggcaacggcacaacttgatgtcgattcgaacaagttcaacctgcccgtggttaaggctagtgcagggccggatggcatcgtcgtttccaaactgcgcaacgatggctgggtaacgcttgatcccggattcctcaccaccgcgcagtgcgaatcgaaaatcacctacatcgacggcaagcattcgattttgcgctactgcggttaccccatcgagcaactgtgcgagaactccgattttctggaggtggcgtggctgctgcgccacggcgagctgccgagcagggctgagtatgagcagttctgtgcggacatcaatcacaagacgatggttggcgaagacttccgtaccttcatgggttcgttcccgcgctccgctcacccgatgagcgtgcttgcctccgccatcaatgcgctggccacgttctacccggacaccaccgatatttctgacaacgaccagcttgatgaggccgccaagatcatcatggccaaggcccgtacgattgtgtcgtacatcttccgccgtcgtcgcgatgagccgatgctgtaccccgattacgcgcgcggctatgtggacgacttcctgcgcatgtgcttcgctgtgccgtacgagccgtttgaatccgacccgctgtatgtgcatgctttgggtcgtttgttgattattcatgccgaccatgagcagaactgctcgacctcggtggtgcgtatcgccggttccgcccacgccaacctgtattcggcggtggccgctggcgtcaatgcgctgtctggtccgttgcatggtggtgcgaatgaggccgtactgcgccaattgaaggcgattcgtgattccggcaagtctgtggccgagttcgtgcgtgatgccaaggagaatggccagaagatttccggccttggccaccgtgtatacaagtcgtatgatccgcgcgcggcgattgccaggaagtatctggaaaagatcatggagcgcgaagatacgcagaagctgccgtctgacgagcgcgcgctgttcgccgtggccaccgagcttgaagatattgcgctgaatgacgaatatttcgtatcgcgcaacctgtatccgaacgtcgacttctacacgggcttgatttatcgggcgatcggcttcgatccggccatgttcaccacgctgttcgcgctgggccgcattcccggttggattgcgcagtaccgtgagatgttggccgacccgaataccaagatcggccgcccacgccaggtctacaccggtccggtcgagcgcgatttcgtgccgatggacgagcggtgattgttggtttgagaaagcgcttcgctggagattccagtgaggcgctttctatatgtacagcgcaaaccagctatgctgcgacggctgcataagaactagcagggctagttctgaaattgaaataatgtgtgcggtatcgaggcgcaccgagggaaggcgtacgaaggtacgtcgaccgaggggcaacgaagataacgctccattatttcaatttcagttcttgtgcagcttggcgttgagctcaattcccaccttgcggtagcgggcttcgatgcggccgttcaccgagttgcggataaacagaatgttgtctttgccggagagctcagcacccttgaccacttccagcggttcgccagcggcggccttggccttgtcccagatggtgatcttagtgccggcggtgatgtacagaccggcttcgacggtgcagttatcgcccagagagatgccgataccggcgttggcgccgagcagcgagtgctcgccgatggaattgcgcagcttgccgccaccggacaaggtgcccatgatggaggcaccgccaccgatgtcggaaccgtcgcccacgaccacgccttgcgaaacacggccttcgaccatggagacgccgagcgtgccggcattgaagttcacgaatccggcgtgcatcacggtggtgccggaagacaagtaagcgccgaggcgcacgcggtcggcgtcgccgaggcgcacgccggtgggcactacgtaatcgatcatgcgcgggaacttatccacaccgaacacgttgacagtggcggcaggagctgcggcaggcagtccggcctgggaggcgaaagcgagagcggcttcggtggaggcgcgttcgacgtcggccttgcgcagcgtgaagtcttcaacggcgaaggggccgtagttggtccacaccacattggcgagctgggcgaagatgccgtcgaggttcagcgtgttcggcttggccatgcgcatgctcatcaaatggagcttcaggtaagcgtccgcggcattactgatcggctcgtccaactggctgacgacgaataccggcacgcggcgaatgccacgggcgtcggcctcatcgtgagccaaagtaccgaaattgtggttcgggcgatcggactcggccggtgcctcaccgagattcagttcggggtaccagacgtccagggtggtgccggcggcgtctacgctggccagaccccagccccatgcggtacgctcttcgctcatagttgctccttattgttgtacgcgctagtgcacgcttgtggacgcgcgatgcgattaatgattcccaccttagccttatgtgcgcctaggtgagggacgatgcccgcgaaatggcttgaaatcgtatttcccggtaaaaaattaccgagtgtgattggcgatgggatgataggttctccggtgaaattcgctggtgaacaactcgacaaggaggtgtgcgatgtgatgttgcatcattcgggagcataggctgtggccatgcgacgcccggcatcatagagtttgcgcttgagcgaatcgggctcaagaatcactacgcggccatcccaggaatactgcaatgcccaccagaacacagcgcgttcgggagcatcgacgatgacttcgaactgtgtgccgtccggtgaatgtttgatttgagggtcgtcgaaccattcgaacacgttgttgagcatggattcgtctcgtacggccatgcggatgcgaatcggggcatcggctacggggtatggacggtggcgcatgaagttcactgcgtcaaaatcagctggtgctggtttttccagtggcactgtgccgttcctgcctttggcgctgacgttggcgattcggttgaccacgaaaatgcggaggttgtcttcgccatgcaggtggcagatgaggtaatagcgtccgttcttgtacaccatctggtaagggtcggcggtgtaggtaattcggcctgcacccgtacggcttttatgcggtatcaaggtgccatccggtccgtaatcacggtattggaaggttacgccgtggccttcttcgatggcttgattcagctggtcgatagtggataggaactcaccgttgatatgcgtgtaggtggccacatggtccaggtagcctactgcctgcccggcggcgcctgcgagctcgcggattttaccgatgaggtcgtccatggtgtcgaggctgatgcgagatagggtaagactgtctagtagcagtcgcatttcggcagtggacaggaatgcatcaagataccagccgggttgtggattcttgcattcgatgccggcaaggtcgctttcggtgagatgcccgatatgtctgccgagaaattccgtggaggtcagctttttgagctggtttcgtatggtcttctcggtcggcagctcgcttggatcttccagctggtgtttacgggcaagctcatcgagtatttgccgcacggtcaggccatgcccaaagtaactgtgacgccacagcacctcgaagatttcgagggtggtgttccctgcataggatttgcgttgcgccggcttgtctgcatccatacattaaggctaccgcgcgcttcgtctaggatggaaacgttgggttgaaatacattcgctggaaaggaggctcgcccatgagcaaagggtatggtgtgtttggccatgttcccgataatgcggatgacgatggcctcctgccttatgaggatgatgattccggcgtttcctggggccatgcgttgcgtcgtcgcaatccttggaaaagaggagacgacgaagatgccgattacgacgacggtcggtatgacatagatgacactgatgacactaatgggggcaggggcatctatgccggtaaaagcggcggagtaggcggcatttctggtgagacgggtggaatacttggtagctcaggcgcggccggcagcagagacgtaacgtttggtggaacggacagtttgtccgccgccgatgcggtgatgccctatcgtttcaggcaaggacgttccgtatggttcgacgatgaggacgaaggccatttcgccgggtctgcgaagcgtgccgaagcccatgccgtccctatccttgcgttacgcaacgatgtggaatcgtcatcgtcgaatgccgtgctcgctcgtgcccgtagcattgcgcgcaaagcggccaccatggttatcaatccggtatacagcgaaaatcatcgaaccgggtatgccgagcttgacggtattctacgtggcaccaccagcccatcgagtaggtatcgtaccagcgtgcaattcgacctcgatacgggagaagccgtcggtggcaagtgctcatgcccggcttacggccgtggctatggcatgtgcaagcacatgattgcgctcgccttcatattctgcgatgatccgcagcgttttgaaggctaccgtgccggggccgcacgaccgtctcggacgctgattgactatatggagcacgccgataggcaagacgctcaagccaaaattcgtcgtcgcaatgcggttatgcgtcggtttgatgccacgcaagggaaaaacggtgcaaatgctcggcgtacaaaaagcggatacggctctcgtgccggcacccgaggcggcgggtatcagggtgacagcgagactgtgggcttggggcaggtgcagcttgtcccgatattgagtttcatcgacggcgtgtggagcgtggagttcaagatcggctcggcttccaatgggtccagctatgtgctgaaatcgattccgcaatttgtgcttgccatggcgaacggcgactatgcggattatgggcagaagcttgcctttattcatacgccggatatgctcgatgatgattcgcgccccctgctggacgtccttgatgatgcgatggccgtgcgtcgtgcggccgagcagcaggacaggtattacgggcatatcgccatcgaccgtcatctgacgctttcagcaccggaagtggcccggttgctgtccgtacgtgagggcagaggcgtacagctcgtgctgaacacatggttctccgggcagcctgcatcggtgccagttgatggtggcgagccagattttctcatgcgcattgcgcggcgtgatttcaatacgtatggtccggatgccggatacctgcttaccggagtgccagcggtggaaaccgtgattgacggcggcaagaatgtatggctgttgctcgcctccactaatccggccggtgcggtatccgccatggtggcgggctctcagcgtaaaagcgcagcaggatgccgattcgtccgttgcccgaaacgattgattccgttgcgaggactattgggagacctgtttgaacccgatggcgagggacaggtcattgccggcgatgacatcgccctattcgcacgcacgctattgcctcagctggttggtgccggactgttggaggccagtgagattcctcgcgagctggctgaattaagtcctacggaatgcagcctccagttttatctggatcgtgatgagcatggtgtgcaatgcgaggtcaaggcacgctacggcgatgccattgtcccgttgctacccgatggcccgacggtgcatgctgagggcgagcgttccatccccttgtctcggggcgtgattgggcgtgatttcgacgctgagcatcttgcgattgatgtagtgcgtgaattctttaccatgcctgaccagcgcaagcgcgttgcggccgccactcatcagacggtgaatgggttccgaacgccggccgcgcgaaaggccaccaaaaaattcgtgtctgatgcggccactatcgatcgcgatgacaccacgcagatcgttcgtctctttgacgagggattgccggcactaaaggaagtgggggaggtcttcaccacaccggcttttgaccggctgatcgcgcccaagccaccaagcgtcaaagtcggattgtccatcaaaggcaacttggtggagatatcacccctcgctgatgaagtgccgccggacgaagtgggtgccttgctatcttcgtaccgtcggcgtcaacgattccatcagttgaaggacggcacgcttgtcaaactcagcggcgcgaatctcagcacgttggaccgattggccagcgacctcgatctgagcgagcagcagctcaactccggactgatcgagttgccgggcggtcgagcattcctactggatggtgagctgccggatgacggctccgatgtagtcaaggacgcttcgttcaccgaatacatcgacgatctcaagatcatcgaccctaagtcgtatgaagtgccggatagtctcaagcatattctgcgcccttatcaggtcgaaggctttcaatggctgaacacgttgtgcgacaagggttttggcggcattctggccgatgagatgggcttgggtaaatccgtgcagcttatcgcgttgctcctgtctcgatatcagcggaataccggcgagatgggcgacggcagccttggcccatcgctgatcgtgtgcccggcgtccttggtgtacaactggggtgccgaattcaccaagttcgccccgagcttcaatgccgtggtggtggccggtaccaaagccgagcgccgtaccgccatcggccgtgcgttccgggcggatgaacccaccgtgctcatcacctcatacgacctgctgcgccgagatgtcgatgattacaccgccaatgagcaacgtttcaatgtcatggcattggatgaagcccagtacatcaagaatcacaccacgaaaatagccaaagcggtcaaggccgtggccgccgaccatcgtttcgccttgactggcacgccgatcgaaaaccgactctccgaactatggagcattttcgacttcctgatgccggggctgctcggctcatataagcgattccatgagcgttatgagttgcccatctccaatgcccgggccgcggatggcagcacggctgaaggtcgggccgccgcacaagtcaatcctgaggccgctcgggtatctcgccaattgcagtcgttggtgggcgtgttcatcaagcgcaggctgaagtcccaggtgttgaccgatttgccggacaagctagagaccacgctgaccgtgcggcttgccggcgaacagcgcaaactgtatgcggctcacgagcagcggctcagaatgcagctcgaacacagcgaagaagccgatttcaacacgtcgaagattcgcatcctcgccgagttgaccaagttgcgccagatctgctgcgatccgaggctgctgtacgccgatgccaaggatcaatcggccaagcttgccgccatcaccgaactggtggaaacctgtgtgaacgaaggcaagaaggcgctgatcttctcccagttcaccagcttccttgatctgatcgccgaacgtttcgacgcgcaaggcctgcgctactacaccatcaccggctccacgcccaagaagaagcgtctcgaactcgtcgaccagttcaatgcggacgatacgcctgccttcctgatttccctgaaggccggcaacaccggactgaacctgaccggtgccagcgtggtcatccacgccgacccatggtggaacgccgccgcacaggatcaggccaccgaccgagcacatcgtatcggccagaccgaagacgtcaacgtgtatcaggtggtggccaaggacaccatcgaagaacgtatcttggagcttcagcatactaagagcgagctcgcccgccagttcaccgacgcttccttgcttgccgacgaagccggcaccggcgccagcgccctcaccgaagcccccgcctccatcgccaccctcaccaaggacgatctcctcaatctgctggggtgacagagcttctttgtgcactccccatcccgattaagaacatgtgtattcatgggtttgcggatgtgtaggtgaatggtgaaagtgtttttcgatatttttatatcgatattcgatatattatgatggtggcatacggtgcagtgcaggttcatccattgatattgatattggattaaggagcatagccatgaacgctggtatcgcattcatttctcgtaaatctcgcaaaacagacgtcgcttggcgctatgccattgccgtggtgcttgtcgtgtgttgtattgggctcgcatatgtggagattgttgtggcgccgtggtttatcaatgaggtggtgtctatgtttccggagaccacgttgcttaaagaaccgtccatgttctgggaatgggcgattctgctcgccgttcaggcgactttgctgtgcacggcggccaaattggtggtaccggagcgtctgttggctcaagcagctggactgctggatatgattcgtatcgtcgcgcttatcgtcgtgttttcggtaaccactaccggtaacatcacaatctgcctcatgaatttcggaactccgggctttgtatatggcgtggccctatgcagcctcgctgcgatcatcgccatcatcgtgctgctgaaacggcggcgctacagcacctgctccatgccgatgtaatatggagtgagtcccatgcgttcgtagaaggcttgggctttggggttgcaggcccagacgttgagcgttacgttgtggcagccggattgacgggcgaagtcgagcacgtagcgatacaaggtggagcctacatggtggccgcgggaccgctcgtcaacgcatagatcatcgatgtacagggttttgatatcggtcaggatattgctgttgaggtgctgctggaacacgcagaatgcgtagccaagcacttggtcggtggcgggggagtcggcgttatgttcggcgtcattgccgtcattggcagatggcgcaaccgccacgaacacaggggtctgatcgttggccagaatcgccttcaattcctcgtccgtgtatttcttgacaccgcctttgaacagatccggtcggccggcatgatgcacttcgagcacctgccgcagcagttcgtcgatctggggaatatcggccgccgtggccctacgaatcgtcatgtcatccattgaactcagtctaatcgggcagtctcgaccggcagatgattgttgcccgcgataagagacacggacgggcaagatgggtgatcgttcgttcaggctctcattctcgccgcaacgtcacggtagtctggagtgcgtgaatcgcaagaaacagccagtggagaagtatgagcggggtacccgttcgtacacgatgtcgcatattcgtggcaaagacaccaaaattgaggtactggtacgcagctacctgtttcgcaaggggttgcgattccgcaagaacgacaagcgttaccccggacacccggatgtagtactgccgaaataccacgccatcgtgtttgtcaacggctgtttctggcacatgcatgaaggatgttccaaacattcgatgccgaaatcgaacgtggaattctggcaggcgaaactactgcgcaatcacaatcgagacatcgcgcagcgagccgaactggaggccgctggctggcgtgtaattaccgtatgggagtgcgaattaacgaaagccgtgcgcgacgaacgcctcgtacggctgtatgagcagattgttgaaggagatgcagattcagcggaataatttcagctcccctctggaggggagctgaaatcaggattcaaacgggaacttcaggccccaacggtcacgaatcgcatccatcagctccatgatgcggatggtgtcggcgtgcggcatcgcctcgcattcgatcttgccgtccagcagcgcgttggccgcatcggccacctcatactcataaccggtcaactgcggcggcaccgcaatgctgcgcacgggcttgtgggcgttgtcatagatgtcgatggactcgggattgttgatattggtgaccaccagataaccctcggtgccccacacatagccgccgcggtcggaggaaaccagcatcgaactggtggacacggccatcgtgccgtcgctgtaatacaacgtggtggaattctgcgcatccacaccggtttcggcgggcaccatcgacgtatcgaaatgatcaagtgtacggccatggtcggcgccgaccgccatatccaggaagttcagcggatacacgcccacatcgagcagcgcgccaccggcacaggccggatcggtcatacgtgccttgccggacaccggatagcacaggttggcgctcgccgctttcacctcgccgatctcgccggactcgataacttcgttgatgagcttgcggctgggcatgtagcgcgtccagatggcctccgtgcacagcatgccggtttcctcggccacggccagcgcctcacgtgcctgcccggcgttcgcggtgaacgacttctccaccagcacgttcttgccggctttcatacacaggatcgcctgttcggcgtgcagactgtgcggggtggcgatatacaccagatccacatccgggtccgccaccaactcctcatacgatccataagccttgtcaaaatgccattggtcggcaaaagcctgcgcgcgcgtaatatcacgggccgctaccgcatacgggtgaatccatgaggaatacagtgaatcttcagccatctgggtcagggtgccggccatggtgtgagctatgcggcccgcacccagaatcgcgacgttgattttttcgccgctggcctcgaactcggcgcgcttgccattgaatcgactcattattcctccttgaatgcgggttggtgcactcaatcgacctacagtgattatagaagaagaaaccttgtcccgtgaggcggatagaaccgaaatatggaaaacgaagcagcgcagcagccccaatctccggccgcgtctccagtcatgtcccgccgagcgcgtgaggccaatcccttccgtgccatggtattcggcgaacaagcagacaagatgatcgcccaaggtaccagcgtcatcaaattaagccttggcgagcccgatttcggcgcgccgcccgccgtacgcgacgccatgcgcgaacagtacgacggccgggccctgccgtacaccgccgccatgggcctacctgaactgcgtcaggccatcgccgacttctaccgcgagcgtcatgaccttgacatcgaccccaagcgtatctgcgtgaccgccggcggttcggccgctctgctgttggccaccgcgctgaccgtggaccccggtgacgatgtgattgtggccgacccctcctacccatgcaaccgcgaacttgtgcggtcgtttgaaggccgggtcatcgatgtgccgacctcggccgccacccgcttccacctgaccgccgacctgtgcagccagtactggacgagcaagaccaaggccgtaatgatcacgtcgccgtccaaccccaccggcaccaccatcgacttcaacgtattggacgaggtgtgcaagttggccgccagccgcggcgcatggcgcatcgtggacgaaacctaccttgatttggctgaccgggagccggacggtaccgaagtcaagtccgtactggcctgcgaccccgatgccatcgtatgcaacagcttctccaagttcttcggcatgaccggctggcgcctcggctgggcgattctgccggacgagcccactgtgctggaagcggttgacgatctggccaccaactactacctgtgcgcccacacgcccacgcaacatgcggcgctcgcctgcttcacgccggaaagcttggcggaatgcgaagctcgtcgtcaggaattgctggcccgtcgccgcattgtgattgacgggctcaagcgcatcggtttgccggttgaggtggagccgaatggcgcgttctacgcctacttcgacatctcccgcactggtctggatgcctggacgttctgcgaacgcgcgctggatgaagcccatgtggctctgactcctggccgcgacttcggcgcggccacggcggatacgcatgtgcgcctgagctatgccgcctcacgtgaggccctgaccgaggggctggaacgtctcggaacgttcgtcgaatcgctgtgaacggcgcggcagccggtgtgattgttgtacagtagtcgagtttgtgtgatgttcggctggcctcacggtgttggttgccggccgaacgactcgccatggtggcgcacggctggctgattgcgatggtcggcccgttgttcggccatcacgggttaggtaaggtcaggaataggaatcatggtcaatctgcgttcgcataccacgcgacttggtgtgcttgatatcggttcgaacactatccacatgcttatcgtcgacgccgcccccggcgctcgccctgaccccgaggccagcaccaaatccacagtgcgcctgatgaagtatttaaaggacgacggctcaatcaagaagtccggcatcgaggcgattctggaagccgtgtcccagtgcatgcggctggccgaggaatacgaaatcacccagctgctggttatggccacctccgccctgcgcgaggcgccgaacggcaacaaagtgattcacaagatcgaggaactgattggtcagggcgtcactgtgctgtctggcacggatgaggctcgcctgaccttcctggccgcccgccgttggtatggttgggatgccggccgactgctggtgctggacatcggcggcggttcgctcgaagtggcgatgggctccgacgaagagccgaccgtagcgctttccgccccggctggcgcgggccgcgtcaccactgaatttctgccttccggcatggccacgcccgacgagttggaagacgtgcgtaagaacgtgcgcaagattctggagccgatggtcaaggttttcccgcaatccaagcacccgaatcatgcagttggcacctccaagaccttccgctcgctggctcgcctgtgcggtgcggtgatgcgtgcgccgggccgcgaagattcatggattatgactcgtgagcagttggaagactggattcctcgtttggcggcgatcgcgcctgagcagcgcgtggctttgcccggcatcacgcctgaacgcacgatgcagattgtgggcggcggcgtggtggccgacgagatcatgaaggccctgaatattcaggaagtcgagatctgcccgtgggcgctgcgtgaaggcgcgattttgcgctggctcgaccaattcggccgcacccgcctcggtttctagtcctattgaggggaatcacccaaccgccacggtagccaacaatgccgcatgatcagagccctcgactttgaccaccttgcattgtccggccttcatgccctgatcaagcaccacgtggtcaataccggcgaacattggcacagccgcacggttcgtgggccatgagaacgtaaacccatgtccggattcacgtgcggcatccacgaaccggtcgccaagaaaatcacggaatggcgtgtgatcgtaagtggcgttgaaatcgcccatgaaaatataccgtgtatccgtatgctcgcgcatcagacccaactcatccagcgatcgcttccactgccgccagtagccgggtacgggagcggtggtgtgcacggatacgaatcgaatctgctggccacccatatccaccgtgccgccgggcatgaatgaggcgctggaattcacgtcatcgtcggtcggatcggcaagtggcgtggccgaccagaggccgttaccgaatacgccgtcagacgatgagacctgcgcatacggcagataatgctcaataccagcctcattgagttttttgacgaaatcctcggtggtctcctgcaaagcaagcacttcgacgcgctgatcgcgaaccagctcgacgatggcttgcgggtcggcctgccccttatacacattgaaggtcatgacgcgcgcgtaggcatcgctggtgttgggggaggctgcggccacggcgttctgcgcggcttgggggagtggatcggtcgagtagaagaacggatattgccaatagccattgcatgcgattgcggcgatggcgattagtgcggcaaggatacgccgcgacacgatggccaacagcagggcaatcaagccaagcaacgtgaaccatggcgttgccgataccacaatcggcgcaaatggcagttcctgtaaatcggcaggcagcgcgcgggcggcagcgccggcaagggcaagaagcgcgaacatcgtggcgagaaaaccaagcagacgatgccgtttgtgtggcttcacggcagacttggatactgggcgtgccgtggctctggcagagcgtggcttggcagcggcgcgagctcgtacgcttgcgcctgtggtagtactccgtgcctttgccatgctgccctttcctccggcttgtttactgttactttgcttttcgtgcgatttgccactgtaccgtgtacggcttgtctttcagtgtcttttcgccgtgcgcaagagcagttcgcaccaaactggcacgaaagaccgggccatgacctgatgtcgggttcctccatgtggcttgctcaggttgccggatggcttgcgcaagctgccacgcgaacatgatgcgactgggcgtgtggccgtgtacaatgaaacgtcgttgcccgagtagctcagtggatagagcaccgctctcctaaagcgggtgtcgtcggttcgaatccgatctcgggcacttggcttcggaaacatgacggtatctcagcctctattcatcggtgatgagccatgggcattaggcatgtgtaaacgtataggttccactatccatcatcccgtcgtgtgaaactatgcaaagacatgtggggcttcacggttgtcgtgagggtccatggctatcgaatacacggaagagaagcggtttactgttgagcaggttgaggcgctgttcaagtcggtaggttgggaatcggcgcagtggccggaacggttgttcaaggcattgcagcattcggatacggtgatcagcgcatgggatggcggccatttggtcggcttggttcgcgtgctcgacgataccgaaatggtggcctatatgcattgggtgctggtagatccggcatatcacgggcagcatatcggcagccatctcgttgaactggtcaaggctaagtatcgcgactacttcttgctggaagtcatgcctgaggaaagcaaaaacgcaccgttctaccagaagcatggcttccacctgatggacgatggccgcgccatgcaaatcgtcaatcgcggctgacgggctggcagtgcggacggcgcaagagcggcggcatgcgccaatcgtgggcaacgtacgtagtcgttgacggttatcccgtagcaatgttcacaatacgaccccttgtccatacagtgaaaataacggctgacgttcgacgttgctgcgctatgactagagaccatgagtgaagacaaacagtatgacttctatgtggccggtccgttctttgatcctgaacaaacggcaagtatggaacgtttggaaaagatattggaagaccatggcaaggtactgttcaagccgcggtttgtcagccagatcgaagaagtaggccctgaaggatgctttgcggacgatatccatggcattaatgctgctaaagccgtggtcgccaatcttatggacgaggacccgggcacgatgttcgaaatcggatatgcgcatgcgctgggaatcccggtgtacggctatttcgaaaaccttacgccaatggatcgtgtcaatctgatgattgcgcaagcggtcgaactggtgttcgtcggtcctgatgatgtggcgaaatacttggaaaccggcgagcatacggaagtcgattacatccagttctaaacagctctaacaggttctctgcaagcagggttggcggcgttctcgtacatagtcatgtacgggaacgccgcagtggtatagggatattccaacaagcggcataatggggtcgtgggaaaaccagtcggatacaagtgaagtgtctgaatttcgtaaggagtgccgttatgagtaaccacaatcccatgaatattgccaccgactttgccaaggccacgggaggaaccgctcgcaaagttgttgctttgaccgataaaggtccgttgaatggctttaagaaattcctgtcgcgcggatcgatgattgatatggcggtaggtgtggtgatgggctctgccgttaccgctgtggtcaattccatcgtcgacaatctcatcagtccattaatcggcatgattggcggcgtaccggatctttccggactgctgaccatcacgttcaacaactcgactgtttcatttggtgcgattcttaacgcgctgattaacttcctgcttgttggcgtggcggtgtatttctgcgtgattttgccgattaataagcttcgtgatctcactgctgcccaggatgaggctgacgctgaagaacaggggcctagcgttgaagagcagactctcgccacgctgcaggagattcgcgacgagctgaaaaaggccaataactccgccgagtaatctgctgaatgtacggtgcgacagatttacctggtttgcccgaaataacggattgccggggccatttggtctggacaatccgttgtttcgcgcgtgttttgtagcatccgtggagttacatggggagtatgactgaaaacatcgctgataaggccataaacgatactcgtatcgtcaagcagttcaccaatcccgtcaaggagccgattgacagcgacatcaacctgttcgatctgctcgataaccgcgccaagcgcgatcccgaaggtgccatgatcgaatacaagggcgatgatggcacttggcacccgtacagcgcccaagtattccgtgacatggtcatcgacttggccaagggcctggtcggacttggtgtcaacaagggcgattcagtcgccatcgtctcgcgcacccgctgggaatggaccgcgctggatatggcgatcatgtccatcggcgcgctcaccgtgccggtgtacgagaccaactccgccagccaggtcagctggattttcaacgattccaaagtcacgctcgccatcgccgaagatgacgggcagcgtgacaagatcgaatccgtgcgcgatgaggtgcccaccctgcgcaacgtgttcgtaatcgaggccggcggtctgaacgccatcaagacctacggcgaaagcgtcaccgacgccgaattctgggaatacaaggaagcctcccacggcgacgaccgcgccaccatcgtctacacatccggctctacaggcaccccgaagggcgtggaactgacccaccgcaacttcgccttcctggtgctttccgcgctgcagtacatgcctcgtgccggcgcatggcccaaccgccgtctgctgctgttcctgcccctgagccatgtgttcgcccgattcctggaattcttcagttttggcggcacgatttcgctggccttgagctccaatatgaagacgatggtcaaggacttcgagaccttcggccccacgctgctgcttgccgtgccgcgtgtgtacgagaaggtctacaatgccgcctcccagcgcgccggcaccggattcgctggcaagatgttcatgcgcgccgccgagaacgcgcgcgaatggtccaaggccgagcagaagggtgagcagctgccgattaccggacgcatcgcccacgccttctacgagcaggtggtgtacaagaagattcgcacgattttcggtccgaacgccgacttcgccatcaccggcggcgctccgatggactccgagctttcccacttcttcaacggcatcggcatgccggtgctggaaggctacggcatgaccgaaacctgcggcccggtgtgtgtgagcttgccagaggacaaccgcatcggcaccatcggcatgccgatgtgcggtatcaccgccggcattgccgaggacggcgagctggtggtcaaaggaccgctggtgtgcaagggctaccacaacaaccctggggtcactgcccagcagatcactgatggctggctgcacaccggcgatctgggcgatatctccgaagatggcttcatctccatcaccggccgtaagaaagacctcatcatcaccgctggtggcaagaatgtgtcgccgggtctgcttgaggcttccgtgatgacctcgcctgtggtcaaccagtgcttggttattggtgataagaagccgttcgtggccgctctggtcacgctggatctggcggatgccaacaattggctggaatcccagggcgccaaaccggaacccgatctggcctcgctggccaagaacgccatcgttcacgctgaggtggagcgtgcggtgaacgccgccaacgagggcgtttcccgcgccgagtcgattcgtaagttcgagattctgccagacgaattcaccgaggccaacggcatgctgaccccgagcctgaagacccgtcgcgcgcaaatcgttgagcactatcgcgagctcattgacgacgtgatctacgtgccgttgaagaagtagctatcaactccctctgatccaaaaaataagctctctctgacgagggaactgtcagccgcaggctgactgggagagaccgcggctagcccgcgaaacaacaaggccgggtgcgacttgcacccggcctcagcttattcagtccaaaatcgccgaaacataatcggcggcggcctgatccagctccgcatcgccgatggtggcggtgccctgcaccaggaacggctcagcatagttcatgccgaccttgtacgccacgacctcaaacgggcttagcagctcctccatggtgtggctgtactcgccgtccttgcggtacttggcggcgtcggaaccagtggtgaccaccagtttgagctccttgcccttcaacgcatgggctccggcgtaggcccagccggcggtgatgacctcgtcttcccattccttgagtagcgcgggggaggagtaccagtagaacgggaactgaaggattacgcggtcggcagcctccagcagctcgtgctctgtgtcggcgttgacggagaagttcgggtattcggcgtattcgtcgcgcacgatgatgtcgtcctcgccctgtgcggcgagttcggcaagcagacgggcgttcactcgcgagccgtccttcaggtgcggatggaatacaagaatcagcgttgacatgggatttcccttctataactgctaccaatgtggcctaatcaccactatcgtatgccgggaagcagaactcagtccagtccggactcgggtgcgagccgcgggatgccgcgccgggaggcaactcagtcgaggttggactgcgtgcctgcggtggcttcgttggcggcttgctcggcttgtgcttggtcgagcttggcacggacgtcgttgagcagaccctgggcgcgcttggccaaggcctcgccgatctcccattgacgcatcgactggtcaagattgaggccgccggtttccagtgcctggacagcctgaatcagcttgtcgcgcgcctcctcatatggcatctgggcgatgagctcgcgttccttgtccgtcagggacgtggcgggggtgttcttgtcggtgggtgtggcgttttcggtcatgatgttctccttatatatacggtatatatgcgtggctgcgtatggcgtgtcacgcggttgcggatgtggtggttgcggtaatgacacccttcttcaaggtgacggtgatgccatccccagggcttacctgcgaagcatcgtctagtacgtggccatcggcggactgcaccaccgcatagcctcggttcaacgtggattgcgggctgagtgcggtcagtgaggcgtgagctcgctcgacggtgagctgggcatcgtccacgatgcgtcgcagcccgatatcgagccgttgcaacgagtcgtcaattaagcgctgatgaggctcaagcatggtgtgcggctgtgtcaggctcgggcggttcgcatatccctcgataagtcgaatctcgttctccacgcgcgaacggacccgcagtcgcatacggtcgatggcaccttcgatgagctgcgactgctcacgcacatccggcaccacgcgcttggccgcatcggtaggggtggaggcgcgcagatcggcgaccagatccagcaatgtccagtcatcctcatgcccgatggaggagattaatggtgtagtgcaggcatacgccgcacgaaccacacgctcatccgagaaaccgatgagatcctcaaacgagccgccgccacgggccacgatgatcacatccacgctcgggtcggcatcgagttgtgcaatggcctgaaccacctcggccgggcattgctcgccctgaacatgcacatggaccaccttgaaggttacggaaggccaacgaaggttcacattggtgatcacatcgccttccgcacgtgcctgaggtgcgcaaatcaggccaatagtcttcggaaactccgggagaggcagtttgtgatcggcatcgaacaggccctcgcccttaagctgcttgcgcaattcgtcgatcatggccttgaggctgccaccggctccgaccttgagaatcgtgtccccgcgcaacgacagcgaagtgcgcttcatccacaggttcggtttgccgtgaatcaccacgcggtcgccctgaacgaactggctggctgcggccgcgaacctgccgaagccattgacttccatggcgatatcctcgaagtcgtcgcgcagcgtgatgtaggccgagccggcgcgacgggtattgatctgcgtgatctggccggtgacccacgcggacggccatcgttccacggcaccgtagaacttctggctcagcacgcttaccggccacggattttgcgcggtggtttcagcggcgcgtgcaggcagctgatcgatagggcgaggctcattcggcagattgatggcgccccaatcgggcgcgaaagtgccttgacccggctcaaagccagacgaggccagtgaagcggcggtcggtggacggccggtagatgagtagcccattgcagtagtcatgcactccactataagtgcgttggttgatgacggtaaaaatttaccgtcgcctgaaaacggtgtgatgatgaatgcaagaaccgtacgaagcgatgtatcagccgatgatggagatggtctggtgcatcagaagaaaggagtcattatggcgaagaaacgggtgctatgaagaggagtgagatatgcgttgcactgacgattgagagtcgtcagtgagctcgctgtgcgacacgcgagcagaaaacagttacgctaatcacacacttgtggttttggcgaaaaatagccgaaaaaccctataaatagttcgacacgccactgttgagcactagatataggggtggggatgccgtattcttctagaggttcaagaaaacgatatcaatgtaatttcgtgtggcccacgtcgagtgcggccaaaatgcggaactcaggagagtgttcgccttataggaaaggggtgcccgatgggcgcacaggtgctggaggaaaccgtcaccgataacgagaccaaggtggccgccaaggcctccaccgtgctcgttgagaagcgtgatggtcgtgtggtcgacttcgaccccatcaacatcatctctgcggtcaagtctgctttcggcgacctgaacaaggaagtcggccccgaagaagatgccatgatccgtggtttcgccaaccaagtcgaaggcgaaatcaaggggcgttacaccggccccgccaaaatcgaggacatccagaacctcgtagagcacgccctcattgacgcccacctgtacgatgtggctcgcgcctacaccaattaccgtctcgacaaggacattcagcgtgccaaggccactgatgtcaacgaggccgttgctcgcttcattaatcatgacccgaccctgattcacgagaacgcgaacaaggattccaacgtctactccacccagcgtgatctgctggccggtgccgtgtccaaggccgccgcgttcaacatgctgccgccggcggtgtccaacgcccacatgaagggcgacattcacttccacgatgccgactattcgccgttcactgcccagtccaactgctccttgccgaacttctgggacatgttggccaatggcttcactcttggcaacgctccgatggcttccccgaagtccatcgccattgcggccacccagattacccagatcatgaaggacgtggcctccagccagtatggtggccagaccgccaaccgtgccgacgagcatcttgcccagtatgccaagaaggattacgagaagttccttgaggaagctcgtgagaccatccccgacggcatgccggttgaattcgcccgtcgtcaggtcgagagcgccaagaagaacgagcccgccaagctgcatttcggttcccgtgaaccgctgccgatggacaccccgttccacaccgacgttgacgaacttgagcaagagcgtgaaatcctcgccaagattcgtacccgcaaggccatctatgatgccatgcagaccatggaataccagatcaactccaaccgtgtgtccaacggccagaccccgttcgtgactgtcggctttggtctcggcaccgactggttctctcgtgaagtgcagcgcgcaatcctgctgaaccgtattcgcggcctcggcaaggaacaccacaccgccatcttcccgaagctcgtctttactgtgaagcacggcgtgaacgccgacccgggtgacccgaactacgatctgaagcagcttgccctcgagtccgccaccaagcgcatgtacccggatgtggtgttctacgagaacatcgtcaagatcacaggctccttcaaggctccgatgggttgccgctccttcctgcagggttggatcaacccggagaccggcaaggatgaagaagacggccgtatgaacctcggcgtggtcaccgtcaacgtgccgcgtatcgccatcgaatcccacggtgacaaggctcgcttctggaagctgttcgacgagcgtatggaagtcgcccatcaggccctccagttccgcatcatgcgctgcaaggaagccaccccggtcaacgccccgaccctgttccgctttggtgcgtttggtcgtcttggtgccaacgacaacgtggaccagctgttcaagaacgagcgtgccaccgtgtcgctcggctacatcggccttgccgagaccactgcggtcttctatggcaagaactggattcgcgaccacggctgggatccggaaggcaaggagttcgcgctgtccatcgtcaagcgcatgaacgagctgtgcaagcagtggagcaaagcggagggttaccactattccgtgtactccactccggctgaatccctgaccgaccgcttcaaccgcatggaccgtgaaaagttcggccgtatcgaaggcgtgactgatcacgacttctacaccaactccttccactacccggtgtggttgcagcccactccgatggagaagctcagctacgagaaggacttcccgtactacgcttccggcggcttcatcaactactgcgagtacccgtgcctgcaggacaacccgaaggcgctcgaagccgtgtgggattacgcctacaacatcggcatcggctacctgggtaccaacaccccgatcgaccactgcttcgtgtgcggcttccagggtgacttcgagccgaccgaggaaggcttcaagtgcccggagtgcggtaactccaacccggacaagtgcaacgtcaccaagcgcacctgcggctatctcggcagcccggtccagcgcccgatggtgcacggccgtcacgaggaaattgcccaccgagtcaagcacatgagcggcgaaaccggtcgtgtgacgctggatgacggaaccactcgcgagtggttcgaagagaccaagtagggtttatacttgctcccgctgacgggagctgtagagcgtaagcgagactgagggcggtcatcctttatggtgttgaccaccctcagtccgtctgatgacggacagctcccgccagcgggagctaatgctttccgtaaggagggaatcatgccggagctgcatacgaccaagcccgaacccaagcgccatgactttgcggccggcgagaccgggcgtggcccctccgtaccctccaacggtcttgccaacgatccgaaagccggtcaatgggatggccggcgcatgtccaagcggatgatcgccgactacaaaaccttcattgtcaccgacggagaaggcgtgcgcaactccctttacgtctccggttgccccttccactgcgtcgactgcttcaacgcctccatctgggatttccaagccggccacgaatacacgcaaaaacttgaagacaaaatcatcgaagatctgaaagccccatgggtgcaaggcattacgttccttggtggcgagccattcctcaacactcccgtgctggtgccgctcgcacaacgtatccgccaggaattcggtcataccaaagatatctggtcgtggaccggctacacatgggaagaactcatgcgccccggagaaaccccagacaagcttgaattgctacatctcatcgacattctcgtcgacggccgctacctcagagaccagaaggactcgctgctgcaattccgcggctccagaaaccagcgcatcctcgatgtgcccaagtctctggaagccggcgaaccggtcatctgggccaagctccacgatcaagaacgagatatccccgaaatctatttgaaagaccgcgaagccggcgaaggccaacaggcctcgtagtagcagttctggaatgccgcactcagcaatatcgttggaactgttgggaaaaggccttcccgtgagcgaaatcgcctcgcctcgtgccatgttgggcaggtggtcggactaatattccataagaagtagccgggcgaagccgtccgcagggtatctgccagccgtcccgaaacggttcatgatgcctcaaagcgtgcactcccggaagtcggaattaagaggaacacatggttgacatcgccactgacgcgagcgtaaagcccgcttcacacccgaagcccctgcgtgtgggattggacatcggttccaccaccgtcaaggccgtggtgcttgatcagtccgattccctgggagacaccctcttctccgattaccgacgccaccacgccaacgtgcgtgccaccgtggccggcctgttggtcgacatccacaagaagcttgtggacctcggacgcggcgacgaaccgattcgcctgtctatcaccggttccggcggtctggcgcttgctgacaatctgcatgtgcctttcattcaggaggtcatcgccgaaaccgaggcaatcgacaaggaatacccgcaggccgatgtcatcatcgagctcggcggcgaggacgccaaaatcacctacctgaaacccacgcccgaacaacgcatgaacggttcgtgcgcaggtggtaccggcgcgttcattgaccagatgtccacgctgcttgacactgacgccgcaggccttaacgagatggccaagagctacgagaacctgtatccgatcgcttctcgttgtggtgtgttcgccaaaaccgatttgcagccgctcatcaacgatggtgcggccaagcccgatttggccgcctccatctttactgcagtggccacgcagaccatcgctggtctggcttccggacgcccgattcacggcaccgtcatcttcctcggcggtccattgttcttcatgtctgaactgcgcgccgcattccagcgcgcgcttgagggcaaggtcgacgaattcatcgtgccgaccgacgcccacttgtacgtggcctacggttcggcattgcaggccgacgtagactccgacgatcagggcaattatttcgaggcccacacgtgcgacgatatcctgaagcgtctggacgagctgaagaacctgccttccaacacgcctaccatgccgccgctgtttcccaccgaggccgatcgcgaggacttcaacaagcgccaccacaaggaacacatccacatcggcacccttgaaggcgcgcacggcccgcacttcctgggcatcgacgctggttccaccactattaaggccacactcgtcaacgacgaccgtgaaatcgtctggtccagctacgccaacaacgaaggcagcccgctgaccgccgccatcaacatcgtcaagaagattcagtctgagctgcccgaaggcgcgtggatcgcacgctcctgcgccaccggatacggcgaaggcctcatcaccaccggcctgcacttggacgagggcgtggtggagaccatggcccactatcgtggcgctgaaatggtcagccccggcgtcaccgccgtcatcgacatcggcggccaggatatgaagtacttggccatcaccgatggcgttatcgattcaatcgccgtcaacgaggcctgctcgtccggctgtggttcgttcctgcagaccttcgccatgtccatgggcctgacgattcaggaattcacgcaaaaggctctggcttccacccatccggtggacctcggttcgcgttgcaccgtgttcatgaactcctcggtcaagcaggcgcagaaggaaggcgcctccatcgaggacatcgctgccggcctgtgctactccgtggtgcgcaacgccctgtacaaggtcatcaagctgcgcgattccggcgaactcggcgacactgtggtggtccagggcggtacgttcctcaacgacgccgtgctgcgcgccttcgagctgctcaccgaacgtcaggtcacccgcccgaacatcgccggccttatgggcgcgttcggcgccgccctgaccgcccgcatgcactacgaggacatcgcggacgacgacaacgcgcacgtcggcgcggacgggcgttccgtcgacgcggcggcggctgaggagtccgccgccggcgacgagccgaacgccgccgcgcacgccggcgaaatcgtcgtcgacggcgtgcgccacaccgtctcgtcaatcctcaccggcgaagccctcaacgaaatgtcgatgaccaccgaacgcgacgtgtgcaagctgtgccagaaccactgcaagctcaccatcaccacgttctccgacggctcccgcttcgtgaccggcaaccgttgcgaacgcggcggcgatgccaagaagaaacgctccgaccgtccgaacctgtacgactacaagtacaagcgctgcttcgcctaccgccgcctcaccgacaagaacgccacccgaggcgagattggcattccgcgcgcgctcaacatgtacgagaactacccgttctggttcacgctgctcacctcgctcggtttcaaggtgatgatctccggccgttccagccacgaactgttcgaaaccggcatcgaatcgattgcctccgagaacatctgctacccggccaagctcgtgcacggccacatcaaatggcttctcaacaagggcatgaagacgatcttctacccgtgcgtcagttacgaggacaacctcgtgcccaacacggacaaccactacaactgcccggtcgtcgccaactatccgctcgtcgtcggcgcgaacatgcccgaactgcgtgaccccgacgtgcgctacatgcacccgtacttcaacctcgccaaccacgagctcatggtcgaccgtatcgtcgaggagttcgcatgggcgagcgtcagccgcgaagaggccgaaactgctgtcaaggccgcctacgccgaagacaaggtcttcaaacacgacgtccagcaggaaggcctcaaagccctcgcctacatgaaggagcacgactgccgcggcatcgtgcttgccggacgcccctaccacatcgacccggaaatcaaccacggcatccccgaaaccatctgcgcgctcggcatggtcgtcctctccgaggattcgatctgcgaactgcagccgggggagaagctcgacctgaccgacttcctgtccgaaggcgaagaggacccgcgcaagaagaacgcgaacggattccgccacgtcgacgaccgcaaggtcaccgtcaaccgcatgccgttgcgcgtcaccaaccagtgggcctaccattcgcgcctctacgcggccgcgcacttcgtcgcctcctatccgggcctcgaactcgtgcagctcaactcgttcggctgcggcctcgacgccatcaccaccgaccaggtggccgagatcctcgccgacaaggccgacgtgtacacgctgctcaagatcgacgaggtctccaacctcggcgcggcgaagatccgcctgcgctcgctcaaggccgccgtcgaggaacgcgaggcgaacaaggcgcgcatggccaaggccgcgctcgccacgtccgacgagtccggttccgccgagtccgacgccccgcgcaacgcggctcacgccgccgcgcaggccgccgcccgcaaggcgcaggagcaggccgaatccgatctcgccaccgcgcaggccgcgctcgccgaagcgcaggccgccgtcgccgccgccgaagcgaaggttaaggccgccgacaggcccgtggacgcggccgatgccggcagcgacgccgccgcccccgcgaacgcgccgaagtccaccggattccgcaagaccggctccaaggcgcccacgccgggccgtcaggtcctgctcgacgcgacgatggccgcgaacccgaagctcaccaaggcgatgcgcgacgcgtccaagcgcgccgcgaagcgcgacatcgccgatgtgcgtctcgccgcgctcggcgacggcaccacgaacgatgccgcgaacgccaagtcgaagtccgcgaagtcgaagtccggccacaacaacgcgaccatgtcccgttacgcgcaccgtgagaagttcgtcaaggacatgaagaaggactacacgatcgtcgccccgcagatgagcccgatccacttctccctcgtcgaatcggtgatccgctccggcggctacaagttcgacatcctcaagcacgcctcgcgcgaagacgtggggactggcctcaaatacgtgaacaacgacgcctgctatccggccatcatggtcatcggacagctcatcgacgcgattctcgaaggcaaatacgatccagacaaggtgtgtctcgcgattacgcagaccggcggcatgtgccgagccaccaactacttcggcctgatccgcaaggccctgatcgacgcgggttacccgcagatcccggtcatcgcgatctccacgcagggcctggaggacaatccgggcttcaaggtgacgcccgcgctgctgcaccgcaccgtcaaggcgctgatcctcggcgacctgctcatgaagtgcctgtaccgcgtgcgcccgtacgaggtggagaagggcgcggcgaaccgcctgtacgagcagtgggacgtgatcgtgcgcgaggcgctcgaacaccacggcttctcgaagacggccgcgaagaccccgtggctcaagcgccgctacctgccgtaccccgtgctcgcccgagagatcgtgaagagcttcgacgctctgccgttgaaggacgtgccgcgcaaggtgcgcgtcggcgtggtcggcgagatcctcgtcaaataccagccggatgcgaacaaccatgtcgtcgacgtcatcgaatcgcaggattgcgaggccgtggtgcccggcatcatggagttcatgaccacgcgcccgtacatcaccgactggaacgagaagtatctcggcaccggcggcaacaagacgttgtacgcgctcatgcgttggagcctcgaccgctacaacgcgccgatcaaggcggccatcgccacctctcacggcaagttcaagcaagacgatccgatgcccgaactcgtcgagaaggctgccgaggtcacgtcgatcggcgtgcaggccggcgaaggctggctgctcaccgccgagatcctcgagcttatcgaacagggatgcccgaacgtgatctgcgcgcagccgttcgcctgcctgccgaaccatgtgaccggccgcggcatgttcggcaagatccgccgcctgcacccggaggccaacatcgtgtccatcgactacgatccgggcgcctccgaggcgaaccagctcaaccgcatcaagctgatgatcgcggccgcgaagaaggcgcacaaggcgaagttcgccgacggcgacgagccgcagggcttcactgccgccgactgacctcaaaccgacgtccaaccgacgcccggtcggcaccagaccggcgcagaccgggcaaaccggtctgcggcctacgacaaggcgggtgtcccattccgtatggaacgggacacccgccttattcgttctggtgcttttcggccggcaccggtcacacccgtcctacccgagcctgcctgccgtgaaccggtacagcgcgtcccatggcaggtcggtcacgtcgatcgcttcggcgcgctggctcacgagctcgtcgtaacgttccgaccgcatctgcgccttcacgttgccgcgcacctcgtccagcggagccttcccgtcgacgccgtcctttgtccagtcgtgctcgtcgtagtagcgtcgcacctcgtcgtcggacaggctcatgccggggttcgactcgtcgcccgtataggcgttcttcaacgcggacagttcgtagctcaggtagctgtcgatgtcgaagccggtacggccgtagacgatgccgccgtccgatttcagttccgcgttgccgctgttcacggcctccatgcgcgcgacgatgctcgcataggagtcgtcggccacctgcccgagatccacgccgatgaggtacgcggcgtgccgacgtcgcagttcgtcgatggcacggctcgcgagccaacggcacgggacctcgccgtcgtgcgccttatcccagccgtcctcggccgggtcgacgccgtacgtctgccgaaagtacagccgcgccgcgccgtgttgcgccttgagcgccgcgacgtactccttgcgttcgatgacggtgtcgccgaagacgatggtggggaacatgtcggaatcctcgcttgcattggagccggtatcggagccgatgccggcggatgcgcccgcgcccgcaggcgtgcctgcgggcgcgaaggcgccgtcgccgtgcgtgacgacggcgacggtcaatgtgacgagcaggaccgccgccaccgcgactgcggcgatggcggcggcgaaccggtgcctacgtggcatcggtcacctgcggcgacgggccgcggcggccagtccgatgccggcggccgcggtcagcgcgaccatcgcggccgcgccggccacgtcggcgccggtggcggtcagcttgccgccggtggtcgcgccgtcgctgccggaaccggtggaaccgttgccggaaccggaaccgttgccggaaccggaaccgttgcccgtgccggaaccgttgccggaaccgtcacccggcttggtgtcggggccggggtcggggtccgggtcgggcgtcggatcgggatcggggttcggatccggtttcgggttcgggtccggatcgaccggcttcttctccaatccgtcgatggcgtcacgcagtgcgttctgcgcggtctcgacctgttcggcggtggcggcatcgtcgtccagcacggtctgcgcggcgtcgcgcgcggcgacgagcgcggcccacgactcatccgtgtagtccgactcggccaatcccagagcctcctcgaccgtggccttcagcgtggacttgtccaccggaacgggttcggggcccggcgtggaggcggccatgtaggcgatgaccggggagatgtgcgcggacggcttgttcatgccggacacggacgtcgcggtgacgcggatccaatcgcccgcctcgaccgcgatctcgcccttgtcggcgacgcagttggcgaactcctcggaacgctgcttggagacggtcaggtcggcgaagcacaccaccttgtcgtcgtgcatgagacgaagcgtcaacgccttgccgttgctgccgtcctggcgcaggtacggctcgtcctcgcggatggacaccttcaccgtgccggccttcggcgccttccacgccatggcggagccaccagcggacgcgggcgaatcgctgatcaggccatggatggcggagcggtcggtgggcaggctgtggttcgcgtagtccacgcccggaccgtagtaggtctcgtacatccagttcggatacgtcgcgtcgaagtcggcgatatccgaccacacgccgtcggcctcggtctgacgctgcccgtaccagatcggaccctgcacgcgcacctggaagtcgttcacccaatcccacgtggtcttcgacttcaccacgtagtcgtcggacacggtggaacctttcgcggagaagcggagcacgtcgttctcggcgagttctgcgccggcctccaaccgcacgccgtcacggtacacgcccttatcggcgccggacggttcggccgtcaccttggcgagcagctgcgcgacggtcatcggactgtcggcggagaacggcgcgtagacgacgttcacaccgtcgacagtcgcggtctccaactcggacgagccgagcgcggcgggcgcggtcacctcgaagcgggcggtggaggagacgctggcgccgtcgtcggcgaacgtcaccgtgacgggcacggtgacggtgccgccgaccctgctgttcagcgtgaccgtgccgttcgccatgtcgacactcgcgccggccggcgcgttcgcgccgagcgcgaacgtcgtgccttccggcacagacgcggccgcgccgtccgccttcagcgtgaacttcggcgtgcgcttcaggtccgtgccggcgtcgccgcgcacggtcgggtacagcacgttgagacgctgcgcgtgcgattgcgcgacacggaacgtgacggtcgtctcgtcgctcgaaccgtccgcgtacgtgacgacgacggtgcgggtgacggtcgcgccgtactgtccggcggcgggcgtgaaggtgacggcgccggtggacgcgtcgatgacgggcgaggcctcgccctcatcgccgccgtccttgaaggcgaacgcgacgccgtccggcgcgtcggcctcgccgccgtccgcggtgaacgcggcggcgacggccgactgcgtgccgacgacggcgtccgtcgcggcgtacgagacgtcgtagcgcacgttctgcttcggcgcggcgggcgccttgtcctcatatgtgatgaccgggctgatgtgcagcgacggcgccttgactccggtctcggcgtcggcgacgatgcggatccagtcgccttcctgcacgtcgatcgaaccgtgctcggcgaggcactgcgcgaactgttcggaggacttctgatagacggacaggtcgtcggccgaacagagcgtctcgtcgttgcgcatcagcgacaatgtgaccttcttgccggcgttgtccgcgttctgacgcaggtacggttcagcgatcttgtcggcgaacgtcttgagcgacagcatgacggtgccggactccggcgccttccatgccatggccgtgggcaggccgtcgccgggcttgtcgatcagcaggccgtgcgtctgcttgcggtcgccggagagttcggcgagggtgccgttgacgccgacaccgtagtactggtcgtacacggtgttcggccacgagccgtcgtatgcggagatggtggtccactcgccgccggcggacgtgcggcgctgcgccttccagtcgaagtcggcgacgccttgctcgtagtccgcgacccaatcccacgtgatgcgctggcggatcgtgtactcgtcggtctcgtccgtgccttcggcggagaagcgcaggatgtcgccatcgcggaccggttcggagtcggcgagcttcgtctcgtcgtccttggcgttccggtcggagcctgggagcagggagagcaggcggtcgagcatgttcggttcggactcggcggacctggcgtcggcggacttgccggacttggcgtcggcgactcggtacacggccttgtccacgcccttgtcggcggacacgttggagagcagttccttgacggtcaccgggttcttgtcggtgaaggtcacgtggatgaccttggtcttgtcaccggtcccggaatcggtttcggttccggtctcgtacttggaggaggccatcgtgacggacaccacgtcgctttccacggcgcccagatcgggcctgcccttgactgcgttgccgaggaagtcgttctccaccgcgtagtcgttgaggtcggagacgaccttgccggcgttgatcgccttcgagcccgcgaccggacggtagccgtcgaacgcggctttctcgccggtgcgcgcatgctcggcgccgctcttgagggcggatgtcggagccgaaccggcgcccgcaagcactgcggacacgtcgtcggcctcgatggcgttggcgtcggaggtgggcttgttcgcgtagttgacgtacatgttgttgtcgtacgtctggccgccgttctggctgccgcggttccaggtctccgtcttcttcgtgttggtcgcgttgatgaagatgttgttctcgaacagggactgcgagttggaacgcttagtcagcacctggctgtcggcgtccacgtagacggtgttgttgtagatgtggttgccggggccgttcgacggcaggtcgaacacgccctgacggtcgttctgcgagatattgtatcggaacgtggtgttaaccgcgtaccagttgcagatcatcagcgaggcgaagctgttgccgtacgagtagttgtactggtacagcgtgccgtcgccgtagtcggcgtcccacgcctggccgtcgccgttgccgtgctcggcgttgaggttgttgtacatctcgttgtactggaacactggatccttgcaacgccacggccagatgccggccgccacgcgtccgccgtaggagccgggctgcgtgtagtcctgcgtgttgatgtgcttcgagacgctgtcgcccacattgtgttcgatgaccgggcggtcgcagtacatcagggtgatggcgtcgccgccggcgcccttgacgtagttgttctcgatgcgcacgttggtggaaccgtacttcgcgatgagggcgtcgtcgatggagccgtcgccgtagttcgcgtcgatgtagttgaggtaggcggtgtagccgacggcgatgccccaacgatccacgtccttgacggtgctgtttctgatggtgacgtggtcgaagcgtgagacgtgctccctgagccagacgtcggtttcggcgctcgtgttctccatggggtagtgggccatgaagtagatgccgccgttggccatgtgcttgttgtagatgttgccgtccacgtcgtggatgtaaaggttgtcgagcgtcacgttgctcatcgtcgcgccgttctcggcgatgccggccacgccggtgcggtccatgcgcgaggcgctgcggtcgagttttgtgccgtcggaatcaggggtgtcggtccacttccacgtgtcgatcggatcgtagacgtccgcgtcgtcgttggtgatctccaggttggagacggtgatgtacgacacgtccttgagtagcagcgtggttgagacggtgcccttgttcttgtggttgccgacgttggcacggtagtcctgctcccactggctgcctttgacgccgttcgacgcgatgaccggcttgccttcgtcggcgtcgccgtaggcggagatcgtgatcggcgcgtcggcgttgccggcggtgtccttgatgtgcaggtactggtcgttgaattcggagccgtattccagcagcaccgaatcgcccggaccgaggtccgaggcgatgtcgttgaccttggtcagggacttccagggcgcgttttcgctggtgcccgcgttggcgtcgtcgccgtgtgccgacgacacgtagtaggtggtgcctgatgacgtggtcgtagcggtctcctttccttgcgttgctgactgcgcgaacgcagcggtcggcaacgcaagcgcgacggccacgcccattgcggccgtcgcggctatggcttgtctgccctgacgggatgtcatgccgctttccttcctttcgattgtggcgcaccggcgtgccggtggggtgccgggcgtgtccgatatgtcctcggtccgtttccggtatggccttcggcgtggtttcggtgtggaaccggagcggtcgccggtgcgcttcggtgtgcgttccggtgtgcttccgacgtgcttatggttgccggtgttttgtatgggttgttgctgttttccgtgttctgttgttttctgttgtttttcttttattccggctgttcgccgtgggttgatggtgggttgatggtgtggtccggcctctctgccggacgtttctgtaaacaaggtttacaaatcaatgagtgtatccgacatcgcgcataacggcaaagccgtacggtgtggcgcggcgttgcggaggcgtggcgtgcggtgatgggggcgtggcggcgcggtgtggtgcgacggcgcggtgcggcgttgcggcgtgatatggcggatgtccggcgacgtgccggttatcggaaaaagatatagccgattcgcgggcgcgcggcgacgcgcgtcgcgcgactcgcctacgataccgttcatggtcactcccagaatcagctatgcgcacctgctcgccgagccgaacccgaagcatgtcgagagccttctgaagttcttcgaggcggggcgctccaagcgcggcaccggtggtttaggtgtcgagattgagcatctgccggtgcatgacgccgacgacacggccgtaagctactacgagccgaacggcatcgaagcgttcctcaaacggctcgctccgtattatgacgaaagcaaggaatactgggagaacggccatctggtcggactcgcgcgcgaaggcgttgcggtgtcgctcgaaccgggcggccaggtggaggcttccatcggcgtgcttcatgagccgggcgacctcaacggcctgtacgccgacttccggtgtgaggcggacccgatcctcgaggagctgggcttccgtttcgtcaactacggataccagccgaagtcgagtttcgtcgacgtgccggtcaatccgaaaggccgctatgacgcgatgaccgacttccttggccgcgtcggccagttcggtccgtgcatgatgcgctgctccgcctccacccaggtgagcatcgactatgtcgacgagaaggattcgatcgataagatgcgcgtcggcaccgccatcgggccgattctcgcatggttcttccgcaacaccccctacttcgagggccgtctcaacccgtatccgctgctgcgccagcgcatgtgggactacctcgacttccagcgcaccaacgtgacccccggcctgttcgaccagcgtttcggctgggaggactacgcgcgtgacgtgctgtccacgccgctgatgttcgccgacctgacgcacacgcccgaagcggtggaatcggggctgagccgcaaggagctgcatcgcgccgccttccgtgagaacgctggcgaggtctacccggaccgcgagctcaacgcgtacgaaatcaaccacatcatctccacgcatttcaacgacgtgcgtctcaagaacttcatcgagttccgccactgggattcgctgccgatcgaacgcgtcgaacggctcaccgagatcatcgcgtccctgtactacgtgccgtccaaccgcatccgtctcgaaagctacttcgacgggctcaccgaggaagacgtgttcgaagccaaggcgaacatccaggcgcacggccgcgaatccaacccgtatggccagccgctcgacttctggcgtgagttcctcggcctcgagggcctgctcgacgatattcccggagatccgaagcaccccgacgtgttccagcgctgaccgggttccatgccggccgtgattcgggccggagcgtcctggcgggcgttctggcccttgtcgtaccggccgcggcctgccaggtgccgggtgtgtttggtctaggattacgaaaaccccggtcggtggtcggctggccggggtcgcgccagaactccctgttcaccatcaccgccgacacgcacgaggtgcgccacaaccccgaatactacgtgatgcgccacttctccaagtacgtgcgccccggcgcgaaggtgctcggcaccaccagccacttcaactccatggccatcgccttccgcaacccggacggcaccatcgtggtcgtgacccagaacgcgctggaggacgaacgcccgttcgagttcgccgacccggccgacgcctcccgtggcttcaaggccacgctcgccccgcgctccttcaacaccttcgtcatcgagtgaccgcacggaacccagaaaggcgaacacaaccatgaccgcgaccacaccggaaaccacagtcgaaacgctgccctacaagaaccccgacctgcccgcctccgagcgcatcgccgacctgctctcccgcatgaccctcgaagagaaggtcggccagatgatgcagctcgacgcccgcggtggcgacctcgacgagctcatcgtgaacaagcacgtcggctccatcctgcacaccagccccgaggacctgccgcgcgccgtcgaaaccgtgaacaccaagacccgtctcggcatcccactcgtcatcggcgacgactgcatccacggctactccttctggcccggcgccacgatcttcccctcccagctcggcatggcgttgagctgggacccgaaggccgtcgaagcggccggccgtgccaccgccgaagaagtctcctcgaccggcgtgcactggacgttctccccggtgctgtgcatcgcgcgcgacacccgctggggtcgcgtggacgagaccttcggcgaggaccccatgctcatcggtgagatggcctccgccatggtcaagggctatcagggcggtgcccaggccggcgagacgctgccgaaggacgcgatcctcgcctgcgccaagcacttcgccggatactccgagacccagggcggccgtgacgcctccgaagcggacctgagccaccgcaagcttgaatcctggttcctgccgccgttcgaacgcatcgccaaggagggctgcggcacgttcatgctcggctacgagtccatcgaaggcgtaccggtcacgttcaacaagtggctgctcaccgacaagctgcgcggcgcatggaagtacaacggcaccctcatcaccgactgggacaacgtgggccgttccgtatgggagcagaaggtcaagcccgactacgtgcacgccgccgccgacgcggtcaaggccggcaacgatctggtcatgaccacgccggggttctacgacggcgccatcgaggccgtgcacaccggtctgctcgacgagtcgctcatcgacgaggctgtcgcgcgcatccttgcgctcaagttccgcctcggcctgttcgaggacccgcgtctgccggacgagaagcgcatcaaggccgtcatcggctccgaggatcaccgccgcgtgaacctcgagctcgctcgcgaggccgttgccctgctgcgcaacgacggcggactgccgttcgacgcggcgccggccgaagcgatccccggctccggtgacgcgcccgcgcgcaagcgcatcgccgtggtcggcccgctcgccgacgacgcccagaaccagctcggcgactgggccggcagctccggccaagtcggctggatgcccgacggtcatccgcgcggcatgatcaccaccgtgctcgacggcttccgtgcgctcgccggcgacggatgcgaggttacctacgcccgcggtgccaacgtcatcgacctcgtgcccgacccggagggtgagttctacccggacggccagccgcacccgaagatcggagtgagcgcgcccgttgaccgggccctgctcgacgaggccgtcgccgccgcgcgcgaggccgacctcatcgtcgccgtcgtgggcgatgtggtgcagctggtcggcgagacctgttccaccgccacgcttgaactgctcggcggccagaacgcgctgctcgacgcactcgccgacgtctcccgcgagaccggcaagccgatggtcaccgtgctggtgagctccaagccacaggtgctgccgcgttccatcgtgggcgattccggcgtgctcgccggccgttgcaacgatccgaagtccggcgccggatccatcctgtgggcgccgaacccgggcatggagggcggacaggccatcgccgagatcatcctcggcgaggtgaacccgtccggcaggctcccgatcaccttcccgtgccacgcgggccagctgccggtctactacaaccagatccgcggccagcacggcaaccgctacgccgaccttacgcaggacccggcgttcgcgttcggcgagggcgaaggctacacgacgttcgcgtacggtgagccgacgatcgtcggcggggcctcgaacgcggacggcacgttcgcgcagaccgacaccgtgcacgccgagatcgccctcaccaacacggggcgccgcgcgggcaccgaggtcgtgcaggcgtacgtgggcgacgtcgtcacctcatacagctgggccgaccgcgaactcaaggcgttccgccgcgtcacgctcgaaccgggcgagaccgcgaccgtcgtgttcgacattccggtctgcgactgcaccatcgccgacgccgatgcgaaccgcatcgtcgaacccggcgagttcgagctgctcatcggccactcgtcgcgccgcgacgacctcaagcgcaccaccttcaccgtcgcgtgaatctgctctgcgtgagatgctctcgcgtgagccggtcccgtgtgaatcggtttcgtgtgggcctcatatgtttccgcccgctccggtcgtatgctggagcgggcggtgtcgtttgtgcggaacggagcaatgatgcggaatactgatgagagggccatgccggaagacgatgggcgaatcaacggagtgaacctcggcggctggctggtattggaacggtggatgacgcccggcctgttccgtgcgagcggcgaggaggacgagatctggctgcaccggtccacggacccggccgaactggagcgcctgctgcgccgtcaccgcgacacgtacatcaccgaggacgacttccgcgccatctccgcgcacgggctgaaccttgtgcgcatccccgtgccgtttttcatcttcggtgacgtgcccgggcatcccggatgcgtcgaatacctcgaccgtgcgttcgactgggcggagagggccgggcttaaggtgctcatcgacctgcacaccgtgcccgggtcgcagaacgggttcgacaatggcggcctgaccggcgtggtccgctggcatacgacgccgcggcaggttgcgttcgcactggacgtgctcgagcgtctcgcgcgacgttaccgcgaccgccctgcgttgtacggcatcgaagtgctcaacgagccggtcgaccgtctcacttatctcatgtcgccgtcgagctcccgggcgaaggatccgggggaggcgcgggggagcggccacgttccgatgcgcttcctcaaacggttctatcgggcggcataccgatggctgcgcccggtgctgggcgacgggccggtcatcgtgttccatgacggattccgcctgaaccgctggcgcggctggttcgtacgtgagggcatgcgcggcgtcatcatcgacacgcacgcgtatctcgtcatgtcggaacggcccgaggtgctgttccgcatactgccggacgcatggcttatgcgctggtaccggctgttcgcggcgtggggcgcgcgccgcatccgccgtgccgcgcgctttacgccggtcatggtgggggagtggtgcgtggcgaacgggcttgcggcgcgcatgggggagtgcggggcgcaaggtgaggtcgcgtccgttgatgcgtctggtggtgcgttcgacggatatggtgcgttcggtgacggcggtgcggatgttggagacggcgcatccggtgacgtcggttcgcgcgcgggcgacgccggggacggcgtcccgtcgcccgccgcgcgccgccgcgccgtctacctccgcgtcgccgccatgcagctcgacgcgtggaacgtctccgccggtcaggtctactggagctatcgactgcgcggcggtcgcggcgagtttgaccgtctcgcgcctcccgcgcccggtatgggtgacggggacgccgccgtgatggacgacacgcgcctcgacccttgggatctgcggcatgtctggcatgcgggatggatggggtgatggttcgggatgacggtgattgatgacgcggtggcggaggtgatgtgcgagacgcgcgatttacggaagggtcagcggtatccgtcccataagggggaggggaacagcacatcctcgcagtcgacccacatggcgttgagatcgcgaccgggagagcgcagccagcgcagctgaatgccgtccatcatcgacaggcccgcctgaagcacgtgctccacgttcgcgccgtcgggtactgaccagttgatgttgagcgcgttcgtcacgctgcggcgctcgcggtccgcgaaatagtcgtgcgccggatgctttgaatcgagggcttcgatcgcgaaaccctcgacatgcccgccaagcagatcgccctgctcgaacaggtcgccgccgcgaaccagaacgtcgtggtcgtgctgtccaacggctccgtcgtctccgtggccccgtgggccaagaacgccaagggcattctcgaatcctgtctgctcggccaggccggcggccctgcgctcgccgatgtgatcttcggccaggtcagcccgtccggcaagctcgcccagtcgattccgctggacatcagcgatgacccgagcacgctgaactggccgggcgaggaaggccacgtcgactacggcgagggcgtgttcgtcggctatcgctactacgacacctacggcaaggttgtggactacccgttcggctacggcctgagctacgccacattcgagatcgatgacgtcgccgccgccaagaccggcgcgaacaccgccaccgtgaccgccaccgtgaccaacacctccgatgtggatgccgccgaaaccgtgcaggtgtacgtggctccgggcaaggccgacgtggcccgcccgaagcacgagctcaagggcttcaccaaggtgttcctcaaggccggcgaatccaagaccgtgaccatcgacctcgacgagcgcgcgttcgcctactggtccgaaaaatacaacgactggcacgtggaggccggcgaatatgccatcgaagtgggcgtgagctcccgcgacattgccgacaccgttgccgtggccctcgatggcgacggcaagacccagccgctcaccgaatggtccacctacggcgagtgggaggccgatccgttcggcgccaagatcgtggccgccgtggccgccgccggcgaggccggcgagctgacgaagctgcccgacaacgccatgatgcgcatgttcctcaaccccatgccgatcaactcgctgcccaccctgctgggcgaaggcggcaagaagatcgcccagttcatggttgacgagtacgccaagctcgcgaagtaagggctgaagcgaggcaatcgcacggcgtaatacagctggcttccctctcctgaggggagccagctttgtttaggctcaacagttgtttggagatactacaacacgccgattgttgtatgtgcaactgttgtatatgggtctctttatcatgaattgttgcgtatacaacaatgtggggtgaaggtacaaacgcacacggccccgcatggtacggaggacaatggatcagcatattctcagcatcgaaatgcgagcggtgaccaaagccgtcgaccgctatctcggtgagagcatgccgctttccgccaaggagaccaccggcggcaacgcgcatatcatcatgttcctggctcgtaaccggaatcgtgaaatctaccagcacgccatcgaacagaaattctgcatcacccggtccaccgcctcgcgtgtgctggccctgatggagaagaagggcctgatcgcccgtgaatcggtggcgcatgatgcccgttgcaagcgtatcgtcctgaccgataaggcggacgccatcgtcgccgatctcaaagcgaacggcgaacgggtcgaacggctgctggtggagggtttctccgaaagcgagaaagcagccctacgtgactacgtcagtcgcatgcgcgcgaacatcgaccgcgcacaacatgaatttgaacatcaaacactccctcagtcacctgtggtgatggctcccgaccaagacggagcggaggttgctaacacgaaggaggagaacgaatgagcgataccgcagaggcaatcgcgcaggcgcgcaaagccgtcgaaccggacaagcccaaacatgtactgcgcacgctgggccattcgattcgtgaatacaagaaagccagcatcctggctccggtgttcgtggcggtcgaagggtttctggaaatcctgattccgaccatcatggcttcgctgatcgatgagggtatcaccggtggcagcatgccggccaccgtcaagttcggcgtgattctgctggtgtgcgcgatggtttcgctgggtgccggcttcttgtccggaaagtacgcggccgtggccggcgcgggcttcgccaagaacctgcgcaaggaccagttcgagaaggtgcagggcttcagcttcaccaacatcgaccggttctccaccggttcgatcgtgactcgactgaccaccgacgtgacgaacctgcagaacgcctacatgatgatcattcgtctgggcgtgcgtgccccgatcatggtggtcgtggcctggctgttctcgttccgtatctccccgtcgatttccatggtgttcctggcctgcatcccgattctggccatcggcctgtgcggtctggccgtgctcgtgcatccggtgttcgagcgcgtgtttcacacctacgatgcgttgaacaacgtggtcgacgagaacctgcagggcatccgcgtggtcaagtcctataaccgcgaatccttcgaggtctccaagttcggccgcatctcccagcgcatcttcaaggacttcaccaaggctgagcgcatcatgagcttcaacagcccgctgatgatgatctgcatctacggttcgatgatcctcatcgcatggatgggcgcgcagcagatcgtcgcctccggcaacaaccccgccgtgggcctgaccaccggcgacctgaccgcactggtcacctacgccatgcagatccttatggccatgatgatgctgtccatgatcttcgtcatggtgattatttctcaggcttctgccgagcgtatctgccaggtgctgcaggaggaaagcacggtgcagaacccggcacagccggtgactgacatggccgacggctccatcgaattcgaccatgtcaccttccgctactccgacagttccgaaaagcccgtgcttgacgacatcaacctgaagatccgctccggcatgaccgtcggcattgtcggcggtactggttcggcaaagtcgtctctggtacagctcgtgccgcgactgtacgacgtgagctccggttcgctgaaggtcggcggcgtggatgtacgcgactacgatctcgaggcgctgcgcgatcaggtggccatggtgttgcagaagaacgtgctgttctccggcactattgccgaaaacctcaggtggggcaacccgaacgccaccgatgaagagattcgccatgccgcgcagctcgcgcaggccgatggattcgttcaggaattccccgataagtacgacacgtacatcgagcagggcggtaccaatgtgtccggcggacagcgccagcgcctgtgcatcgcccgtgcgctgctgaagaagccgaagattctgattctcgacgattcgaccagcgccgtcgataccaagacggacaagctgatccgttccgcgttccacaacgagattccggacaccacgaagatcatcatcgcccagcgcgtggcctccgtgcaggaatccgacatgattctggtgatggattccggccgcatcatggcgtccggcacacacgacgaactgctcgtcacctgcgatgaataccgttccatctacgaatcccagaccaagaaccaggcccagcccgaagaactggctgctgccgaacaggctgctgagtcatctaccgctgagccgtccgaaaccgtgacggtgacagtgcccatgcccacggccgataccagcgcagctgataccaatgcagccgataccaaggaaggagaagcacgatgagcaacgaccagagtttcaagaaccgcaagcccgccatgggcaaagccgagcctggcaccatcaagcgcatcttcagctacatcttccagtacaagtggcgcgtcatcgccatcgtggtgtgcatcttggtcggtgccgccgcgcaggccggttccgcgctgttcctccagtcgctcatcgacacgtacatcctgccgatggtgggggagtcgaaccccgactgggccccgctgctgcgggccatcagcctgatggcgtgcctgtatgtggccggcatcgtggcgtcctggctgtggcagtggctgatcgtcaccgtcgagcagggcacgctcaagaagattcgtgacgacatgttcgcccaccagcagaagctgccgatccgctacttcgacagccacgagcacggcgacatcatgagccactacaccaacgacaccgatacgctgcgccaggccatctcgcagtcgttcccgcagatgttctcctcgattatctccgcggtcgcggcgctgctgtccatgctgtggctgtccattccattcaccgcgttcgtaatcgtgttcaccgttctgctctacttcatcgtgcgcaagatcgtgagccgctccggccgctacttcgtcaagcagcagcagtggatcggcgacgtgaacgccttcgtggaggagtccgtcaatggtcagaaggtcatcaaggtcttcaaccatgaggatgccactcagaagaccttcgatgagaagaacgaggaactctttgaggcgtccgccgaggcgaacacttggggcaatgtgaccatgccggtcgtcggcaatatgggctatctgctctacatcctgctcgccatcgtcggtgccgccgtttcgctggccggcgtcaatgacatcggtctgaccggtgtcaagccgctcaccctcggcacgctcgtctccctgctgaccttgtcccgctcgttcatcaacccgatcggccaggtctcccagcagctgaccatggtgatgatggcgctcgccggcgcctcccgcatcttcaagttgatggacgaacccatcgaggaagacaagggcaccgtgacgctcgtgaacgtggaacttgggccggacggccgcaccatgaccgaagtcgaccatgagaccggccactgggcgtggaagcgtgagatcggcgacgatggtacgaggtctctgaaggccgccgaaaagctgcgcggttccgcctgcgaggtggcgatgaaggccaaggagcaggcgatcacctcgcctgatgggcgttatacgctgctgcgcggcgacgtgcgcttcaccaacgtgaccttcggctacaacccggacaagccggtgctgcacgacatcacctggttcgccaagcccggccagaagatcgcgctcgtcggcgccaccggtgccggcaagaccactgtgaccaacctcatcaaccggttctacgatatccagcaaggtcagattctgtatgatggcatctccgtggccggcatcaagaagcctgatttgcgcaggtctttgggcattgtgttgcaggacgtgaacctgttcaccggtaccgtgatggacaacattcgttatggccgtctgaacgccactgatgaggaatgcattgaggccgcgcgtctggtcaatgcggacagcttcatccgtatgctgcccgagggatacaacacggtgcttgagggtgatggatccggcctgtcccaaggtcagcgccagctgatttccatcgcccgcgccgcggtggccgatccgcccgcgctgattctcgatgaggccacgtcttccatcgatacccgtaccgaggaagtcgtgcaggccggcatggataacctgatgaagggccgtacggtcttcgtcatcgcccatcgtctgtccaccgtacgcaactccgacgtgatcatggtgctcgaccacggcaacatcatcgagcgtggctcgcatgacgagctgatcgcgcaaaagggcgagtactatcagctctacaccggcgcggtggagctggagtagtcggtacgcctgcaaaaaccgcacctcgattatcgggttgaagtaattcttatccggtagttgggggcgcggttttctatgttgagagccgtgtgttggcgcaggattgcgaatattggcggtatttgctgcgctcattgccatttgcttctcgttccccggagtcggcatgattattgcctcgattgtattcgctgtactgtttgtgctgtggatttggaaaggcaagaatccgttcctgggtcgttctttcgtgaccaatggtgcgtatatgtccattctgctgctgcaatttgtgctgtacttcttcaactttgcttgtgtgccgatttacaacgtgattggtgagcagatctacaacgtgccgttgaccacggtttcgctgtgtctaacattggtctacattgtggccacaattgttggatgcgtttctggtccagtaatcaacagactcggacgcatgcgcacactggttatcgctatcgtgctcatgattgtcggcttcgcaggatctgccatattcattactgagaagtgtggagtattgccggccgtgaattggtgcagacctaacacgttcatttaggcgctatgcagtgtcgaatgttctcggcgcggattttacgaagtattgtcagcaaatgcatcaaggcaatggcggcggtctgggcgggactacggccacgcataacagtatcgagtactcgaatgagtcctatgacgcgaaaactcggaccgtgacgatgcatgccgttatcgactggagtgatccgtaccgattcggggattcgaccggcagttttactgcgccgggcatcaccgttgtctttgacaagtccgggaaaatccagcgcattgactccacggtctggggattcccgcctgcccgataattatcggagggcctgaaacatgcacgttctcatcagcgctgcgggtcgacgatgctgcaaccatacggcgtcatacccgcatgacgtgagttacactatgtagtaaagttatttactgaaatactgcgtattgttacgtactgaggcgtggaaggctcaactatggtcacgatgaaggaaatcgcacagaaatcaggcttctcgcaggccacggtatcccggctgctcaatggggacccgacattgtctgtcaaagaggagacgcgacgtcgcatcatcgaggtcagcgagcagcttggctacgctaccggatcacgccgtatcgcattgccacgccgtgtggccgtactcgacaacgccacccgcgaggaagaactggcggacgcctatttcgatgaactacggtccgtgctcggcgacaatgccagagcccagcacatggaactcacgtcgttttcccatatcgacgatctgattgccgacgccggtgatttcgacggcttcatctccatcggaccgtccgtactctcttcggatagactgttgaagctccatctggtattgccctatggcgtattcatcgacatcaatcctgcgcccagcctgttcgattcggtacaaccggatttaagccaaaccattttggacgcattggatatgttggtgtcctcgggcaaacgacgcatcggctatatcggcggcgccggcttcacgatgggcctgcacgaataccccgaagacggccgattaaccgcattccgcaattggaccgagcgtttggggctggatgcggaaggcctgatttacgcgcaaggcgcgttcactgtggacaccgggcgcactctaggggaggaagcggttaacgatcatcgagatgacatgccggatgcgttcatcgtggctgcggactcgattgcagtcggcgtactgcaggcgtttaccgctgcgggagtgctggtgcctcgcgataccagtgtgatcagtatcaataaccaggccatcgcccagtacacttcgccgacattgaccagttacgatatcgaccagaatgagctggccgatactgcgattacgatgcttgccgaggccatctccagtcggcgcacgctgcaccaccataccttcatctccaccaccctagtggtgcgtgacagtttcgtaccagcacgataaagaagctccctctgtgcgataaagaagctccctcgtcagagggagcttctttatcgctgttagaacagttccagattcacgtcgagcgtgtaggcgcgatcggcgggcagctggtactgctcatggacgggcgcgccccatgaatcgtctccgcccacgcccatttgcgcggccaacaggcgcaggaacgtgtgacggaccggcggcaactcgttctggtgggtcgcctcttccagcatgagcgagctgtacggcaacaggctcgccgcgaaatgttcgctgccggcctggctgatacgcatgccgtgtccttgggcgtcaagcacttcggcccaacgcaagtcttcatggttgccggtctcctgcggcaccagatacggtgcattgtcttcggccgcggtgcgctcgaaaatgccgagcttgccaccgtgcagacggtcgtgataggtttcctcggggccaaggccgtagaagcgcaggttctcgtactgcttgggaagtgtccattccaatccgaatgccggcagcgtcggcgcatcggtggcaccggcatatcgggcggtcagatgtacacgtccgctggcggcatccacctcatagcgcacggcaacttgggtttcgcccggttcggccaacgtatgacgaatgccgccaacgggcaccaacctcgttgacggcattcgtctttccaggacaccgcaatcgcggatgcatgccgtttacgcgttgaatacgtattggtcaaggcggcgcatggcctccttgacgcggctcaagggcaatgcgagattgacgcggatgctgtagggggcctggaacatgtcgccgtcctgccatgcgacgcccacatcccagccgcgtttctccaactcgggcaggctcaggccgtggcgttcgcaccactgctcgcagtcgagcagcagcatgtaggtgccttccggtttggccaaactcactccttggaaatgcttggtgatgtagtcgtaggcgtaatcgacgttgccggtgagcaccgccttcagttcgtcgagccactcatggccttcgggccggtaggcgccgatcagcgcgtgcatggaaagcacgttcatgtcgttgtagtggcatttcgagcttttggccacgatgcggtcccggagtgtgggattgtagatgatgtggtagcttcccaccagtccggcgagattgaaggtcttgctgggcgcgtagaacgccacggtcctgttgcgtgcgtcctcgctgaccgattgggtggggatgtgctggtggttccccagagtcaaatcggaccaaatctcgtcggagatcaccacgcagtcgttggcccggtacacctccatggccttctcgatctcccaacgctcccatacgcgcccgcaaggattgtggggactgcagaagacggccacatggatgtgatgctccttgagcttcctgtccatatcctcgtaatccatgcgccatacgccgcgctcgtccagcgtgagcggactgtggacgatgcggtagccgttgttttcgatgctccgggtgaacccgatataggtcgggctgtgcagcagcacgccgtcgccgggggcggcgaacgcggtcagcgcactgatcacaccgcccaggaccccgttctcgtagccgatcgcctcccgggtcaatccggtgaccccgttgcgcgtggactgccagtcgatgatggagctgtaatagtcgtcggtgggggagaagtacccgtaggcgggatgcttcgcccgttcgatgatggcctgcgggatcgtgggcacggtcgggaagttcatgtccgccacccacatggggatgacgtcgaaaccctcgcgtggcgggtccggcgcgaatcccgggtcggtgcccagtccgtcgaccgcgatcgaatccatgccatgcctgttcatgatggacgtgaaatcatacgtcattgtccgacaatcctttctcggtccgtggtggccggtcccaatctaaatcgggctcctgacggtgccgtggccgtgggcggcgatttgaccgcgtggcgtgttaggatatgcaccgttgtgaggcagtgatccgttatcagcggggagtcttcggaagaacggcggcaatcgcccagtagaaccgacgggatcggcccgagacagccgaacacaagcggtcgcgcaggctcgcggctccgagtgcaacagttcggagcggcgcaaccggtgcgataagcgaggtggtaccgcggtgcggagcgcataccagcgctcgtcatcgtcctcgtaggcaggaacggcagacatggctgttccgggcggaacacagtcggttccggctgcgaggcgattgactaatcggcccacggttcggtacgtgacattcgtgaaaccagccggcacacgtcggcgcccggcaatcgccatcaatgacgctcctgtaggaccagtgcacagtactaacaggagatttacggtgagcgaaaacgtatatcccaaggcgagcgagggcggcgagaccgcgcacgtcgcgccgaaccccagcttccccaacatggaggagaccgttctcgactactgggacaaggacgacaccttccagcagtccgttgaacgcaacccttccggcgaccacagccagaacgaattcgtgttcttcgatggcccgccgttcgccaatggcctgccgcactacggccacctgctgaccggctacgccaaggacgtgatcccgcgctaccagaccatgaagggccgcaaggtcaaccgcgtgttcggctgggacacccacggcctgcccgccgagcttgaggcgcagaaggagctcggcatcgactcggtcgaccagatcgagaagatgggcatcgacaagttcaacgacgcctgccgcgcttctgtgctgaagtacaccaacgaatggcagaactacgtgcatcgtcaggcccgttgggtggacttcgagcacggctacaagaccctgaacatcccgtacatggaatccgtgatgtgggccttcaagcagctctacgacaagggcctggcctaccagggctaccgcgtgctgccgtactgcccgaaggaccgcacgccgttgagtgcgcacgagctgcgcatggacgccgacgtgtaccaggaccgccaggacaccaccgtatccgtggccgtcaagatgcgcgatgaggacgacgcctacgccgtcttctggaccaccaccccgtggaccgtgcccaccaacttcgccatcgtggtcggcgccgacatcgactacgtcgaggtccgcccgaccgaaggcaagttcgctggcaagaagttctacctcggcaaggatttgctgccgcactatgagaaggaactcggcgagaattacgaggtcgtgcgcgaactcaagggcaacgagctggcaggccgacgctactacccggtcttcccgtacttcgcgggtgacgaggccgaatccgaaggccacgtgcccggcccgaacggctacacgatcttcaccgccgactacgtcgacaccgtcgaaggtaccggcctggttcaccaggctccctacggtgaggacgatatgaatacgctgaacgcgcacggcatcaagagcaccgacgtgctcgacgatggctgccgcttcaccgcgcagtgccctgactacgagggcgatttcgtgttcgacgccaacctgccgatcctgcgcaacctgcgcgccggcgacggcccgctcgccgagattccggaagaacgccgcgcgatcctcttccaggagaaaagctacgtgcactcctacccgcactgctggcgctgcgccaccccgctgatctacaagccggtctcctcctggttcgtgtccgtgaccaagatcaagccgcgtctactggaattgaaccagcagatcaactggatcccgggcaatgtcaaggacggtcagttcggcaagtggctcgccaacgcgcgcgactggtccatctcccgcaaccgcttctggggttccccgatcccggtgtgggtgagcgacgatccgaagtacccgcgtgtggacgtctacggttcgctcgaagagctcaaggccgacttcggcgactatccgcgcgacaaggacggcaacatcaacatgcaccgtccgtggatcgacaacctggtccgcgtcaacccggacgacccgaccggcaagtcgcacatgcaccgtatttccgatgtgctcgactgctggttcgagtccggttccatgtcgttcgcgcagttccactacccgttcgagaacaaggagaagttcgaacagcacttcccggccgactacatcgtggaatacatcggccagacccgcggctggttctacctgctgcacgtgatggcgaccgccctgttcgaccgcccggcgttcaagaacgtgatctgccacggcatcgtgctcggctccgacggccagaagatgtccaagcacctgcgcaactacccggacgtgaacggcgtgttcgacaagtacggttccgacgccatgcgctggttcctcatgtcttcgccgatcctgcgtggcggcaacctgatcgtcaccgccgaaggcattcgcgacaccgtgcgccaggtcatgctgccggtgtggagctcctactacttcttcaccctgtacgccaacgcggccaacggtggggctggcttcgacgctcgccagctgcgcgcggacgaggtcgccggtctgccggagatggaccgctacctgctggcccgtacccgtcgtctggtgctggccgccgagaagtcgctgaacgagttcgcaatctccgacgcctgcgatgcggtctccgacttcatcgacgtgctcaccaactggtatatccgcaacacccgtgaccgtttctggaatgaggacgcttccgcgttcaacacgctgtacaccgtgcttgaggcgttcatgcgcgtgcttgcgccgctggccccgatggaagccgagtccgtgtggcgtggtctgaccggtggcgagtccgtgcacctggccgattggccgttcgtggtggacgagaagaccggtgaagacaccgaactcggccgtgtgctggtcgacgatccggctctggtggacgcgatggagaaggtgcgtgaggtcgtctccggcaccctgtccctgcgcaaggccgccaagatccgcgtgcgccagccgctttccaagctcaccgtggtggtcgagaacgtggacgccgtcaaggcgtacgacgatctgctgaagtccgaacttaatatcaagaatattgagttctcgactctggaggacgcctccgcccacggtctgaagattgttcacgagctgcgtgtgaatgcccgtgcggcgggtccgcgcctcggcaagcaggttcagttcgccatcaaggcgtccaagtccggcgactggcatgtcgatgctgcgtccggtgcgccggtggtctccacgccgtccggcgaccttgcgctggtcgaaggcgagtacgagctgatcaaccgcgtggaggaggagaacgccaccgaggccgccgcttcggtctccgccgctctgccgaccggtggctttgcgattctcgacacggcgcttgatgccgatttgctggccgaaggctacgcccgcgacgtgattcgttctgtgcaggacgcacgtaaggctgctgatctggacatcgcggaccgtatctcgctggtgctgaccgtgccggctgtcgatgtggccaaggtcgagcagttcaaggatctgatcgcccatgagacgctggctacctccttcgaagtgaaggaaggcgccgagctggccgttgaggtcgccaaggcgtgaggctgatgctgagctaaggctcttcaattggtctgaaacaattgcgggcatccgatatacagtgattcaatgagcactgcatatcggatgcccgcatttttcgtgcgtttatgcgtcttttcgacgcatccctattttgaaaaaatctaacttattcaagtttttcaaaatagaaggggaccggttctacctctcatggcttgtaaggtgtcgcttcaatcgttgttagctacacttatcgcgataagtgtagctaacaacggaaatggtagtgcccaagttgccggtagatgtattgcgtatgttcggccagccactcgtatcccgtctgccctgcttcatgtagtgccgatgcccgcttgggaacagcgtaagtttggggattgcttcgagttcttgaagagcaacactctttcacgtgccggtttgaatggcgagaatggcactgctcgcaatgttcattacggagatattcttattaagttcggtgattgcctcgatggcgaacgaagtgatttgccgttcattaccgacgataccgtgcttcccaaatatgctgggtcgatacttcgcgaaggtgatgtcattttcgctgacacggcagaggacgaaacggctggcaagtgtgttgagctgcggaaactacccaaagagccaactatctcggggctacatacgataccggcgcggcctcggttcccctttgggacgggctacctggggcactacctaaattccgatgcataccatagacagcttcttcccttaatgcagggaatcaaggtgatctccgtttcaaaggccgcactgcaagatacacaagtaagatttcctggcttgtcggagcaatctgccataggtgcggcgttgaatgagattgacagcctcatcacccttcatcagcgtaagcgtctgtggtttgctaaataagggtggataaggctctcatcacgatgtcaacgtctttgttttccaattcgcggatgacatgcagatatatttcctgcgttgtgttcatgcttgcgtgcccaagccgtttagagacgcttgcaattgaaacgccggcaaatagcaagagtgaagcatgggtgtgtctcaatccgtgtattgaaatcacaggtactccggcttgtttgcaatgccgggccagaataccgttgacggttgagttgtataccttgccatccacgaagataggcttgtcaccgggtaagctcttcaacagaacagacaactgcatgatgagttgccagtcaagttgtactttacgtaccgaagaagcattctttgttggaacaaagccacctccattcttgtaattccatgtcttattgacggacaaagtctggtgaacgaaatcaaaatcatcaggagtaagccccaatgcttcggagaaacgtaacccggtttttgccactagcagtatcaaccagtcccagttaggtatcggatcaagcttcaaatcagcaaggacagcatgaagttcgaactggttaagatatttcaccttcttctgtctcggctgttttcctttgatgattgcttttcttgttgggtctctctgaatcagaccttcatcaacggcatcgaggatggctcctttcagttggtgatgaaaatccattgttgtctgatgctcgtgatgctcagcgtatccgttgatgagtttctgatagctcacacgatcgaactcggaaagcttgagatcagggataagttttctcagccacgcctgtgtgagcttgtatttcttcattgtcacttcccgaatcgcgccttccttgtagacgtcgacccattgcgagtagtaatcgcagaacgacatttcttcgttgattgtgtttatgaccacacggggctcctttgccgaatagatagacgcttacgctgatgaagggtgatgaggtcgtcaagataatcaaataaacgggagatagctgcttgttcttcgacagcgggaaatgccaaaaaggtgttcatgaactcatcaacactaatgctgcggccatcgcgaatcccataagtcaccgtcgatagaccggcaatgaaatgttcggacataaaccagtgcttccagaatcgatctgaatgcgatgttggttccttcgctctaaaaaccgtgtatgcaggcgacgttatgccctcatactgcgaatgtgcgaagcccccttgaaatgacctgagatgaacaacgaagtctccgggaagcacacgcttatatccaatttcgttgctctcgtcatgcccgatatatcgaccagaatcatcgcgatatatcatgccttgattctgcgtcgctgacagaacaggcagtgtcggatggcctctatcatcaacgatttggaacacctcactggccttacgctgttcccaagcgggtgtagaattattgcatttgtattgcagtttgaaagtgtagaatgcaatgacgtactccgatctgattgagcatgatgctggtgaaacagagatacgttcgtatctggtaaacggtgatgtggtgccggttactatgcgtatccccgctaatttgcgagattctgctaaagaggccgcatctcttcgcgggatgagcttttcggcattcgtgagaacatgcatgattaatgaactagcaaagggcggcaagtgatgattgctctcactgctatgaccatacaaattattgacaacaatcctgatggcattcgaatttgtcgtgtggatggggagtcgcttgtcacggttgtggtgccccgggatatgttgagtgaggcgaaaagtcttcccgatttgccggatcgcggtgtgtattatcttcttgatgaagatcatggagttctgagccgtgcgtatgtgggacaaaccacgaaggggcttaatcggcttgatgcgcacaagactaagaaagatttttggaacaaagccatcatgttcctcgataatgatgtcaatatcgatcgtgatgttttggactctcttgagtcaacagccatagattatgtggacaaacatggctcttatgagaccgacaatgagtatactcctgctcctcgcatgaatccatacaaagagcaacaggtggaaagactgcacaataacatcctctttcgtatgcgagtgctcggatatgaccttgatcgaaaagaaaagacaccggttatggtgaacgccgtattccatacgaagaagaacggtgttcaggccactgggcgatatagccaaggtacaggtcgtttcactgttctttccggttctgaagtggatctcgtgcatccagttatcaaaaaccagggagccgtggcagctcggcggcatcttttcggaacgcagacgggcaaggcgactcttgctgatgacattgaactgtcaagcccttccgctgctgctgtatttgttcttggtggcagtcaaaacggttggaccgaatgggtcaatgaacaaggacagacccttgattacgtgtacagaaacaaggagcatatgaatgaataagcagcagcttgccgccaaaatctgggaatccgccaataaaatgcgttccaagattgaggcgaatgaatacaaggactatatcctcggctttatcttctataagttcctctcggagacggagattgctcgtctgcgtgctgaagactggggagccgaagacctcaagggcttggatgagaatgatgccgaaactgtacagtatgtacgtgatctatgtggctacttcatctcctacaacaacctgttctccacgtggattgccagccagggcgatttcaccatcgctgatgtacgtgacgcgctttccgctttcgaacgcaacattgatccggctcgtaaacgggtgttcgtcggcatcttcgacacgctgcaaaccggtctgtccaaactcggcaccgatgaaaaaagtcgtagcaaggctgtccgcgacctcatctacctcatcaaggacattccgatggacagccggcaggactacgacaccctcggcttcatctatgagtatctaattagcaacttcgcttccaacgcgggtaagaaggccggtgaattctacacgccgagcgaagtctctcagctcatgagcgaaatagtggcttggcatctcgccggccgtgaagaaatcaacatctacgaccccacgagtggctcgggctcgttgctgatccatatcggtcaggctgtggcccgtcgcaatggcaatccgaatgacatcaagtattacgcacaggaactcaaggagaatacctacaatctcacgcgtatgaatcttgtcatgcgcggcatcctgccggacaacatcgtggcccgcaacggagacacactgaaaagtgactggccgtggttcgataccgacgaaacgaaggacgagacctatgagccgctgtttgtggacgccgtggtctctaatcctccctactcccagaactgggagccgccggaagcgggcgaagatatccgtttcgaatatggcattgcgcctaagtccaaggctgattatgccttcctgctgcatgatctctatcatctgcgcgacgacggcatcatgaccatcgtattgccacatggcgtgctgttccgtggcggtgaggaaggcactattcgccggaacctggtggagaaacaccacattcaggccatcatcggcttgcccgcgaacatcttcttcggcaccggcatccccaccatcgtgatggtgctgcgcaaacatcgcgacgacgatcatgtgctcatcgtggacgcttccaaatacttcaccaaggaaggcaagaacaacaagctgcgtgcgagcgatatcaaacgcatcgtggatgcggtgacggggaatcgtgatatcgataagttcagccgtttggtgagcattgatgagattcggcagaacgattacaacctcaatattccccgatatgtggattcctctgaaagtgccgaaagttgggacgtgtattccaccatgtttggtggcattcccaagcaggatatcgatgcgctcggtaagtattggaacgtgttcccgggattgctccaacgtctctttgctgaggagaacggccattcggccaggctcgctgtgcaagatgttcgcgaggcagtgaatgctgattctggtgtgagtgcctatatccagcgatatcgtgaggtattcaccgattatcctgcctatctgcgtgatgaactggtgggtaatgccgccaatgtgagcattgccgccgaagaggagactctgacaaatgatctgctgcgtcgtttggctggtatccctctcgtagacgcctatgcggcgtatcaggtgcttgacgatagttggcaaaagactatctccatcgaccttgaaaccatacaggccgagggacatgacgccgttcgcaaagtcgatgccaatatggtcgtcaagaagaaaggcggtaaggatgtcgaagtgccggacggctgggtcgggcatattctgccgttcgatctcgtacaggggaaatttcttacctctgatcttgcggaaattgccacatttgaatctcggctgagtgagattggcggcgaaatcgctgacattcttgaaaatctggatgaggatgacaagagttcgactgatgccgtcagcgaggatggagattctttcgttgccgctgaattgaagaaagcagtgaaatcgattgggaagaatcccgagactgactttgaccgtgctcttgtgagtgcacagcggttgtttgatgaagagcgtgaagtcaaaaagaacgttaagaatctccgttcagcgcttgatgaaaagacccggaccgttattgaaggactgagcgatgaacatgctgatgacttgcttgctgccaagtgggtggaaccattgcagcgcaagcttgaggagctccctcagacggctgttgatgagttgattgcagcggtgaatgcgctgaacgacaagtattcgactacctactccgatgtgtgcgaacagatcgaacagactgaggcagaacttggcaatatgcttggtcaactaaccggcaatgagttcgacatggctggtattgccgagctgaagaccctgttgggaggtgaatgatggctgaacaggcaaaagtacccgcgattcgtttcgctggttttactgacccttgggaacagcgtaagttgggagacgttgcgtcttcatttgattacggcttgaacgctgctgcaacagaatacgatggccaaaataaatatctgcgtatcaccgacattgatgacgaaacccatgagttctcgaaaagcgatcttacgacgccgttagctgaccttgcaatgagtgcagattatttactgaaagagggcgatctgctctttgctcgcacaggcgcgagtgtaggaaaaacatatctgtacaggcaattcgatggaatggtctactttgctggattccttatccgtgcccgaatcggcgaaggcgctgaccccgaattcgcctatcaggcaaccttgaccgatgcatacaagaagtatgttgccataacctcgcagcggtccgggcagcctggtgtcaatgcgcaggaatacgcagattatcaattgatgcttccttcaaaaacggaacagcagcaaatcgggatgacattgcgatctctcgacgacctcatcacccttcatcagcgtaagtatgacaagcttgtcatctttaaaaaatcgatgcttgaaaaaatgttcccgaaagatggtgagtctgtacccgaaattcgctttgctggttttactgacccttgggaacagcgtaagttctctaatctgaccgacagggtttccatgcagtcaagcgatcctgatttgcctcaagtcgaatacgaggacatcgtttccggcgagggtacgctgaacaaagatttgcgcgacaaagaaggcggcaaaacgggaattaagttttacgccggagatgttctatacgggaagcttcgtccttatttgatgaattggctatacccgcagttcaacggtgtagctgtaggtgatttttgggtccttagggctacagagtgtgacagttcatttttgtatcggctggttcaaacggacagcttccaaaggcttgcaaatgtatcttcgggctctaagatgcctcgcgcagattggaatctgatttcacaatcgttcttcgccgtgcctgccgattacgccgagcagagagtaattgcgaagagcttagccgagctcgacgacctcatcacccttcatcagcgtaagttggaattgctgcagaatatcaagaaatccttgcttgacaagatgtttgtgtgaagggaggtagagcaatggagacattcgatatcgtgaagctcgcctcatatcgcgagaataaccggattgaagcgaaagcagcgaaaggcggtctcccacgcagcatgtgggagacctattccgccttcgccaacacctatggcggtgtcatcctgcttggtgtcaaagaacgcgaagacggcacatttgaaacagtcgggctcacaccagtggaagcggaacatcttcgccaggacttttggaacacggtcagcaaccggtccaaggtgagcgccgtgctgcccatcgaatcggaagttgaagtgctcgaagcggatggtgggatagtgctggctattcacgttccgcgcgctccgcgtgacgaacgccccgtgtatatcaataatgatctcttcgggggaacctaccgtcggcgtggcgagggcgactaccgttgcacgcggcaggagatctcagcaatgctccgggatcagggagctgagacgatggattccaaggtgctggacgatctcactgttgccgacttcaatacagacacagtgcgggcatatcgcaatcgtttccgtacggtacgtcagggcagttcttggaccgatctcgatgacgagcgttttctgcgtgctgttggcgcggcaatggtgagccgagaagacggtaagcttcatcctacgttcggcggtctgcttatgttcggcaacgactatgacatcgtgcgcgaatgtccgcattatttccttgattatcaggagactctagatccgacgattcgttggactgatcgtgtccattccggcgatggcatgtggtcaggtaacctctttgatttcttttttcgcgtgaatctcaaacttgccgagtctctgaagacccctttcaaacttaatggcatcttccgcgttgatgacactcccatgcataaggcaattcgagaggcattggccaactgtttgttcaacgctgattactatggcgtgcgtggtgtggtggtcagacgcgcacccgatagattggtgttcgaaaatccgggcgatatccgaacgggtgttgagcagatgcgtcttggcggggtgtccgatccgcgcaacggtcttgtcatgaagatgttcagcctaatcgatgtgggcgagcgagctggtacgggtgttcccgatgtgtttgccacatgggcgaatgcaggacttcctgaaccgcagattgaagagagcttcggcgaggctgatcgtacggtgctcacgcttatgttggagccggatgccaagctctatcaaaatgagcatgtattcatccgtggtgagcagataactgacgattatgagcagataaatagttcgaatgagcagatatctgacaataatgagcagttaaatggttcgaatgagcggataaccgagagacagcgagtcattcttcattttgtagagaagagccccagcgcgacatacgatgatatggcgcgtgctgcgggagtctcatcagcgactgtgcgaagggatgctgaaatactcattgggtgtggattgcttaagcgcgtcggctcgcgaaaggcaggacactgggaagttcggggagagaagaatcatgatattcgatagcgaatcggtgtttgaggaaaacgtcatcaccgtgcttaagcagcatggatggaaggacggtgtcctgcgctatccaactgagcgggatttgctcgacaattggaaaggcatactgtaccgcaacaacaacgacatagacaggcttggcaaatacccgctgacagacggggaaatggcacagataatcgagcagattgagaccctacgaaccccgctcgcgctcaattcgttcgtcaatgggcgtaccgtgtccatcacgcgtgacaacaaagaagatgtggcgcatttcggcaaggaaatcagcctctacatctatgaccgcaaggaaatcgcaggcggcaaaagcacctatcagatcgctcagcaaccggtctatcccgccaagaacaagatgttgaactcgcggcgcggcgacctcgtgcttctcatcaatggcatgccattgatccatatcgagctcaagaaaagtggcataccggtcagccaagcaaccaatcagatcgagaaatatgcgcacgaaggtgtgttcaccggtttgttccgtctagtacagatttttgtggccatgaaccccgatgacgccgtctacttcgccaatccgggcgtagacaaattcaatccaagctattacttccattgggctgactacaacaacgagcctatctgcggcgggcaaaaccccggcaaagacgaatggaagctgttcatcggcggcacttccggcaccgccggcttgctgtccattcccatggcgcatcagctcatcggcttctacaccattgctgattcagcggatgggtgtcttaaggtgctgcgcagctaccaatacatcgcggcaaacgccatttccgatgtggtgaggaaatgtgattgggaacagcggccaactaccccgggacgaccaggcggctatgtatggcacactaccggttccggaaaaaccatgaccagcttcaaatcggcacaactcatagctgattcgcatgacgccgataaagtcgtgttccttatggaccgcatcgagctaggcacccaatcactgaaggaataccgcagttttgctgacagtgagacggaagtacaaggtactgagaacaccggcgttttgcgggacaaactcaacagcaccaatgtcaacgacaccctgatcgtcacctcaatccagaagatgagcaacgtgaaagcaggggagcggggcgtcacccaggcgtggctggatcagctggctgcacgacgtatcgtttttattgtggacgaatgccatcgttccacattcggcgacatgttgcaggacatccgtcgttccttcccgaatgcgctgttcttcggcttcaccggcacacccattctggatgagaaccaaaagaagaattccaccactgccatggtattcggccgctgtttgcaccgatacagcattgccgacggcattcgcgaccataatgtgctcgggttcgacccgtacatggtgaccacgtacaaggattctgaagtcagacgtgccgtggctctcgacaaggcgaaggcggagagtgcggaagatgcgctcgccgactcggtcaaggccaaagtattccagcattacatggataagtctgaggtccccatgggtccgatggttgatggtgccgggaaccgcatcagtggcatcgaggatttcctgggacgagaccaatatggtatcgactctccgcacccgagtatggtggtctcggacattcttgaacagttcccggtgctcagccatgcgggcaaattccatgcgatgctcgctgccagttccattcctgaagctgtcaactattatcacttgttcaagcagcaggcacccaagttgcatgtgacggcgttgttcgatcccaatatcgacaacaacgaaggagcgacagacaaagaggatgcgctgaccgaaatcatcaccgattacaacgaggcgttcggcaaagaattcgtcattcctacatggccggcgatgaagaaggatatttcttcgcgactgtcgcacaagagtccgtatggtggtatagcaacgaaccgcagccagcagcttgatttgctcattgtcgtagaccagatgctcactgggttcgactcgaaatgggtgaatacgctgtatctcgataagattatcgactacgaaagcatcattcaggcgttcagtcgtacgaatcgtctgtttggcccagataagccgtttggcgtcatccgctattaccgtaagccgtacaccatgcatggtttcatcgaggcagctgtgaaactgtattcgggtgatcgaccgctcgacctgttcgtacagaaattgccagcgaatgtgaaatccatggatactcggtaccgtgagattctcgacgtattctcagacagcggagaatcggaccttatgcagctgccggagtcggtagaggctagacgtaagtttgccaaggagttcgtggaactgaatcggtaccttgaagcggcgaaagtgcagggctttgactggagcaccacggaatacaaggtcgatagcacggatactgacgatacgaatgaggacaatgatgagcatggcgagtctgaagtggtgcgtcctcaaattgacgaacgtacgtacctcattcttgcgcaacgctataaagaactgttcgatggcaatagcgatcgcggtagtgacccagatgatgatgtgaacgataatcctgaagcgccatatgaactggatggttacctcaccgaaattgataccggactcatcgataccgattacatgaatgccaacttcgataaatggctgaaggcgctcaaggagaatagcccggagttggcagagatgtctgcgcagctgcaccggtcctttgccgcgctctcgcgggatgaacaacgactcgctgaactgttcctgcatgacgtggagcgtggcgacgtggaggtcgaagccggtatgacgctacgtgattacatcacgcgctatgctgcacgcgagaagaatgagcaagtcgacaaactggtcgatcgattgggtgtcaacagatcggtggtcgaggaattccttgccaaacgtatagacgaggcgaacatcaacgagttcggacgtttcgatgcactgcgttcctcgcttgacgtgcaacgggcaaaagccttctttgagcagcatgatcacaaggcattgccggtgttcaaggtgcgtatgcgcgccaccaatatgttgaagcgtttcgtactcatgggcggattcgacatcgatgataccgacaatacggatggacaaagcgagacgaagaacgagcactagactcatatacaagaaggggtgtttccgctggcatcagcggaaacaccccttcttggactagtcgatatcactccgcagcaatcgcggccttgagctcctcgaccttgtcggtcttttcccacgggaactcaacgtctgtgcggccgaagtggccgtaagcggcggtcttcaagtagatcgggcgcttcaggtcgagttcgtcgatgatggcggcggggcgcaggtcgaagaccttgcgcacggcggcggcgatctggcctcgcgtcacaccctgctcggtgccgaaggtctccacgttgacggacaccggttcggcaacgccaatagcgtaggcgatctggatctcgactttgtgagccaagccggcagctacgatgttcttcgcaacccaacgggtggcgtacgcggcggaacgatcgaccttggacgggtccttgccggagaacgcgccaccgccgtggtgggcggcgccaccgtaggtgtcgacgatgatcttgcggccggtcagaccggcgtcggccgccgggccgcctaggatgaacgaaccggtcgggttgaccagctggcggtagttgtcatgcggcaccttggaacccagcacctcatcaagcaccgggtcaatcacgtgcttcttcagctcaacagcaagccaatcctgcgtaacctcaggatcatgctgggtggagatcagcacagtgtccagccgaacgggcttatcgttatcgtcatactcaatggttacctgggtcttgccgtccgggcgcaggtgcggcacttcgccggacttacgaacctcggtcagacggaaggcgaggcgatgtgccaagtagatcggaagcggcatcagcgtcggggtctcgtcggtggcgtagccaaacatcacgccctgatcgccggcaccctgtgcttcgtaacgctcttcgcggctggcggcggtctcctgatcgccagtcagacgggcaacgccctggttgatttcggcgctctgctcggtgatggccacgaccacgccgcaggaatcggcgtcaaggccgacttcggaggaggtgtagccgatgttgcgcagggtttcgcggaccttggactgcacgtcgcagtaccccttggacgtgacttcgccgaagatcaggaacacgccagtggcggcggaggtctccacggccacatggctggacgaatcctgggccagcaaatcatcaagaatggcgtcggagatttgatcgcagaccttgtcagggtggccttcggtcacggattcggcggaaataagccgatgttcttctgtcatatcatccctttcttcaggacttatcgccccgcgggatgcgaggcacaatgatacggtgtcaatttttacttgtcactgtggaagcgggcataaataaaggctcgtgccaaccagcgcggtggcgcgagccttgcgtcttattcgctcccgatgttgagttatagccgattgcgataactcaggcaagcgtgtcgctcaaaatcagttgtgagagaactctcacaccatcattcggcgacgaactgtccaaacaatccaaacgaattgtcggaatcgatcagttgccctcgttggcgtcgtcctcgcccaaggtctcctcaagcaggccctcgtcgatttcgcggaaggcgatggacaggggcttctcattgttctggtattcgaccagcgggccgatgttctgcagcaggccctcgttgagctgcgtgaagtaggagttgatctggcgtgcgcgcttggcggcgaaaatggccagcgcgtacttggaatcggcgtgcttcatcaggtcgtcgatcggcgggttcgcaagaccgtcgggtgtcgggtcagtaccaaaagccattgttcttatctccagacattggaaaatctatctcaaccgaagcaagtgtagccgtttggggggacttctgtcagccctataccggactctcgccagaggaatgtattccaaaaaaaactgtgagaaacgttacgtttttgaaaattccactattcgactcttgacaaatggcgtgtccctcgcaaaggcttgaatagaaccatgactgaaatgcgatctgcaaaaattatgtcagggcgcgtctttgcaggcgcccgagccctctaccgtgctgcgggcgtcagcggagacgacatgggcaagaagcccatcatcgccatcgccaactcgttcgatgagttcctgcccggccatgtccacctcaacaaggtcggccgcatcgtttccgaggctatcaaggaagccggcggcattccgcgcgagttcaacacgatggccgtggatgacggcatcgccatgggccacactggcatgctctactccctgccttcccgcgacatcatcgccgacaccgtcgaatatcagtgcaacgcgcactgcgccgacgccctcatctgcatcccgaactgcgacaaggtcgtgccgggcatgctgatggcagccctgcgcctcaacattccgaccgtgttcgtctccggtggcccgatggaggccggcaccacggtgctcgccgacggcaccgtcaagagcaccgaccttatcgacgtgatgtacgccaccgccgacgacagcgtctccgatgaggaactgctcaactatgagaagaccgtctgcccgacctgcggctcctgcgccggcatgttcaccgccaactcgatgaactgcctgaccgaggccatcggcctggccctgcccggcaacggcaccatcctcgcctcccactcctaccgcaaggacctgttcgagcgtgccgccaagcaggtcgtcaagatcgcccaccagtactacgacgattccgacgattccgtgctgccgcgctccatcgccaccaaggaagccttcgagaacgccatgaccatggatgtggccatgggcggttccaccaacaccgtgctgcacatcctcgccatggcccagtccgccgacgtggacttcactctggacgacatcgagcgtatttcccacaccgtgccgtgcatctgcaaggcctcgccgtccggcaagtgggagatttccgacgtgcaccgcgccggcggcatcaccggcatcctcggcgagctcgaccgcgccggcaagctgcacaccaacgtgcactccatcgactatccgacgctggaagccaagctggccgattgggacatcatgcgcccgacctgcaccgaggaagcccagcagatgtacaaggccgctcctggccacatcatctccccggagccgtggacccacaccaccctgttcgattcgctcgaccgtgaccgcgccaacggcgccatccacgacatcaaccacccggagattcacgaaggcggcctcgccgtgctgcgcggcaacctggcccccgacggctgcgtggtcaagaccgccggtgttccgccggagatctggaagttccgtggaccggctctggtggtcgactcccaggagcaggccatcgaggtcattctgaacgacaccctgaagcccggcatggcgcttgtgattcgttacgaaggcccgaagggtggcccgggcatgcaggaaatgctgtacccgacctccttcgtcaagggcaagggcatcggcaagcaggtcgccatgctcaccgacggtcgctactccggcggttcctccggtctggccatcggccacatggcgcctgaggctgccaataagggaccggtggcgcttatcaagaacggcgacatcatcgatatcgatatcgaagcccgttccgtgaacgtcgaactgactgacgagcagctggacgagcgtcgtcgcgagcttgaggctggcgacggctacgtggctcaccgcaaccgccacgtctcccaggcgctgaaggcgtacgccgccttcgcccgctcggccgacaagggtgcgacgcgtgacccggagctgatcaacaagctctccggtctcgactgatcgccgattgcatagctgaaaagcccggtatcttcctcgcgaagatgccgggctttttgctgtgcttccgggcgggagcgatattgcttgttatcgcacgcaggcggcgggggagaggcgcgcgcctcgggcccagtcggcggcgcgcatggccttcttgccctgcgccttgacttgggtgagttccagcggcgtgctgccggtaccaacccacacgttcttcttgctcaccttcagctcgccgggctgaagctcggccggagtgttgggattggactggtcggccggttgcgcggcgagaatatgcagggtgaggggtttggcggccggctcgtcattatcggcgattggcccctccgcaaacagttcggtccatgccccaggatgtggcgtgcaggcgcgaacctgacggtcgatggcctcggcctcgtccgtccagctgatacgagcatcttccaccgtgattttgtgcgcgtattccaggccttcggccggttgcgcggtgaatgtggcagtgccttcacccacggcggccaaggcatccacatacatgggtgcgccttcctcggccagacggtcgaggagttcgccggaggtctcacggccggtcagctcgatggtcagggaagcgacgatcgggccatcgtccaaaccctcgccgaccttgaacacgtcggcgccggtggtcgggtcgcccgcccaaatcgcacgctgggcgggagcggcgccacgccacttcggcaagttggagaaatgcaggttgtaccagcccatgggcactgcgtcgagtacgttcttaggcaggatattgccataggcgatgaccgcggcgatatccgcatgcaggttgttcagcgcttccatgaattcgggggagcggggtttgagatcgatgacgggcaacccgagctccagagccgtcgccttgaccgggctgggcgtgagcttgcggccgcggccggtaggcgcgtcggggcgggtgatgacgccgaccacatcaaaacgtggatcggcggcaaaggccttgagcgagggcaccgctacatcgggggtgccggcgaacacgagtttgagcatggtcctccttaaaacgtcgatgctcactgcacggccggaatgttcacgccattggcgatgagcagttcacgcagcttgaccggatcctggaaacgcacgccacggatgccggccgcattcgaaccgacgatgttcatggccttgtcgtcgatgaacaacgcgccatcggccttgataccgaactgattgagcgcggcctcgtagatttccttgtgcggcttgcgcagcttgacgaaaccggagacgagcttgccatcaagctgctgcagaatatcgcactgttcctcggccacgtggaaaaggctggattcccagttgctcaggccccacacgccaataccggcggccttcaggtcattgaccagcacgcgtgcgcccggcacgatgccggtcagggagtcgcggaagttcttgatgtagtagtcgaggatgtccgcccacttatcgcccctgtcacggcgcatgatggcgatggcctcgtcggtgctggtgccgccgtccatcaggtcgttgacatcgtagaagccggagatgtcgttgtcgaggaattcgtcgatggtcttctggctgtagcgggggatgagcacggccactggatcccagtaaatcagcacgttgccgaaatcgaagatcacgtcggtgatcggcttgccggcgttcgcggcggcttcgccgtccgcgaccagcacgtcgtaatccatatccggctctccgggccaacccttcatggtgtcctccttatagcgatgttcgttctgtaatcatcgtttcacgtgttggagacgattagatcagatctttgggatctactcggaagcgaagctcgccgggctcgcgggacgctacatgacgagcggtttcccggtgcagtcgggccgccagttcggctcgccgactctgtggcacacggattactgccttcacccggtcggccgtggcttcgagctccctggcatcaaccgtgtccggttgcgcgatcggcaccggtcccaacatgccgggcagctcgccgcaggccgtccaatcgccgcccagggcgccgatacgctgcatcagcgtcatcaccgcatcacggcgtccccatacgcaggcggcggccacggccggcggcataccggtctccacacgctcctcaagatccttggctgcaagaatcctcgaatcccagagcatcagcgattgggcgatggccgggtcggtttcgccgagaatcaacgcctggccgccacgggaacgcggcgcgcacaacgacaccgcacgcatccacgcggtcaatgtatccaagcgagcatccacgcccaacgcatacaagctggtccaagcgtcgagcacggccacggcacgatactcatggccagccgatccctgctcggcactgaccggacgcacgcgcggttcgaaaccgggagtggcgatgacgatcatcggctgacaagccacatcgcgcaccaggccctgcgtcttgctggacaaaactactggcacgccgcggaacaacccggccagttcagccgcagtgcctgcagcacccacgcgcaccacacgcatacgttcatgcccacagcccgggcacttccaattgatggcagcagccccacaccagcggcatcgcggtgtggaatcccggcggtcggccggtagttgcaacggtccagaacacttggcacaacgcgcctgacgatggcatttcgcacaactcagagtctcactgacgctgtcttgcggaatggacagcagcacggggccgctctccaaagccttagatagcacgcggacggccgtatgcggcacgcgcgccccgatggacgggtcggcaagacgcgcaagttcatcgcgattgagccagcgcacccaaggagtggcgtccttcagcggcgaggcgagcggatgaattgtggtggaatagccgctcactggggtctccactgtacctggaccggtgttttcccactggctttgcggggtgcgcgcattggccatggccacgaacacgccgccatgggacttggcgcgcagccgcatcacgccacgggcctgtggatatggcatcataccgtccatgttctgataggcggcatcctccagaatggcgaacagcgccgggccttcaaccggcgcatacatcaccgcacgggtgccgatcaccaccttcacctgtcccaacgccacagccagataggtgcgataccggtcggccgcgggcatggtctccgcgttaagcacggcgacgtcgcccacccagccgccggccggagcaggggcgaacggtttgagcccataattgcgcagcatatgcatcaggtcttcgacctcgcgcatggtgggcaattcaaccacggcagccttaccggcactcaacgcagtggccaccatccatgccatgttccgttgccactcctgtgcaccgggcaacgaatcaaacacaaaagattggaaacgctgaccggtaagcgcatcatgaagcacattgacatcggcgtaattggcggtcagacgacgatacccctgcgcagccccctccgaaacggtgctagcaacggcaaaggtagagccagcaagtttggtcccatcgggattggtgccacgcccggcaaaaccgccttgcgtattatccggcaatgagccgccgaccggccgacggaacgacgcggccaaccgctgctcggtctccaccttggccacgcgcggtggcacggcgaaacgcagaatattggcccgtgtgccgccataggctttggcaaccagaccgatatcctcacgcatcgaagcgggaaccagcacatcggggctcaacacccgttcgatatagcgaatcgaagagcgcggcgtatcactggtatcggtgcgtgcccaaatcacaccgctgaccctttgaccgccaaaccgcacgcgcaccagcacacccggttgtgcggcctcgctgtctttttcatcaatgaagtaatcgaatgtctgaccgaggtggagcgcctgcacatccaacacgacttgcgctatgggatgctgctcggccggcgtatgctccgcagacgcacgtttacgccgtttgcggggagccagccccacaagcgtcaactgttctgcgcctgaagtagtcatggctcaactataagtgccggagccgaggtcggtaaaattttaccggcgcagataatcgagcacgtgggttaggtcgcggtcgttgatggctttgtcggcggcgagctgggtctttggcttggcacagaacgcgagacccagaccggcggcctgaatcatcggaatatcgttggcgccatcgcccacagccacggtctggctcatcggaatacccaaacggtccgcccatgtctgcaaggcgtgtaacttcacagtcttgctcacgatttcgccgagcaccttgccggtcaagcacccatcggcaacctcaagccggttggcgatccaatagtcgatatggccttcggccgccagcatatcgaccacttcatggaagccgccggacaccacgccgatcttccaaccgtgttcatgcagcgtgtcgataagctccagcgcacccttggtgaaatgcagcttgtcatgcaccgtgtcgaacacggagatcggcaggccctccaacagggccactcgtgcgcgcagcgcatcgcagaactccagttcgccgcgcatggcgcgtgcggtcactccggcaatctcctcaccgcagccagccaccacgcccaactcgtcgataacctcttcgtcaatgagcgtggagtccacatccataaccagcaggccgggcttgctcagcgtcggcacagaaaccgcagaatcagccgggctcccaacttcgctctcggcggacttgtcaacaaaatgcacatcttcttgcgtcatgcttctgattctgggaaaaccttgggacaatgccctctatgagtttttccatggcagccgccactattcttgcaaccgaccccacacccatctgcaccaccaccgaacccggcctgatcggcaccatcaccgactggctgatcatgctgatggaaaccatcggcggtatcggcgtggccttggccatcgccctcgaatccatcttcccgcccatcccgtccgaagtcatccttccgctctccggcttcaccgccgcacgcggcaccctgagtctgccgggcgcaatcatctgggccaccatcggctccgtactgggtgcctggaccttgtacggcatctcccgctgggtgggcctgcatcgcatcaatctcgcggcagacaaaatccccggcgtcagccgcaaagacgtgagcaaagccaacgactggttcaccaaatacggcacatggtcggtgctcatcggccgcgtgattcccgtggtacgctcgctgatttcgattcccgccggattcaaccgcatgaacttcctgcacttcaccggctggaccctgctcggctcggccgtgtggaacaccatcctcgtttccgccggttacctgctcggcgaccagtggtgctcgattcaaggcgcgctcggcgtgttcgaggacgtggtcatcgcggccgtgattgtggtcatcgtatggttcgtggtgcgaaaagtgcgtactgttatacgtaacaggaaatccgccgacggcaacgaatagggtctgccgactgccataagttgccgaaaatcccggatagaagggaagcgaagaacccgcatgagcgacaccgaagatctcgccgcgctgaacgatcgcctgatggccaagaaccatgcgctcgccgaagcgctgagccgcgccggcaaggaactgaccaaggcgaagtcacagctcgcccagctcgctcagccgccgctcaccttcgccaccatggtcaaggtcgattccacccgcaccgatgaagacggcatccagcacgcgtcggccgaagtcatttccggcacccgccgcatggtggtgcctgtggcctccaacgtcaacgccgcccgcctgaccgccggggccaccgtgatgctcaacgagaagctcgtgctggtcgagcagcgcgatgctgacaccgtgggccagattcgcagtgtcaagcaggtacttgacgacggtcgactgatcgttaccgacgcctccggcaatcccgtgctcatccgccgttccggcgcgctcgcgtatgcgggcatcaatcagggcgaccgtattatcgtcgatccgtccgtccgcctcgccatcgaagcgctgcccgccgagggcgacaaggatctggtgctggaggagaccccggatgtcacgttcgccgacatcggcggcctggatagtgagatcggtcgtatcagggacgccgtccaactgccgttccagcatcgtgcgctgtttgagcgctacgatttgaagccgccaaagggcgtgctgctgtacggtccgcccggcaacggcaagacgatgattgccaaggccgtggcgaacgccctatgcgagggtggttacgattcgaatggcgacggcgcaatcagtccggccgaaacccatgtcaagggcgtgttcctgtccgtcaagggcccggaactgctcaacaaatacgtcggtgaatccgaacgactgattcgcctgattttccagcgcgcccgtgaacgcgccgcggacggcaatccggtggtcgtgttcatcgatgagatggattcgctgctacgcacccgcggctccggcgtctcctccgatgtggagaccacgattgtgccccagttcctctccgaactcgacggcgtggaatcactcgacaatgtgatggtaatcggtgcttccaaccgcgtggacatgatcgatccggctgtgttgcgaccggggcgtctcgacgtcaagattcgcgttggtcggcccaaaaccaatcaggccatcgccatcgtggaccattacctcaccgacgacctgcctctggaagatggcgtcgacgcgcacgccttgtccgccgtgctggtgcatgacatctacggaacctccgaacgccgccatctatgcgacgtgcaggaggagaacggccagtggcatgcgttgttcctggccgacgtggtctccggcgcgatgctcaagaacatcgtggaccgggccaagacccgagcggtcaaggaatccatcgaaaccggcttggacgtggcactcaccgtgccgctgctcgctgccgccgtggaagacgaataccgcgagacccgcgattccatggccgacgtggaccccgaacaatggtcgcgcatcaacggcatggacccgatccgccgcatccgcaccgccgaatagctcaagctcaaggagcactacatgaccgttaaacgagtgatgggcaccgaaaccgaatacgcggtatccctgaacaccccggaccgctacaatccggtgcaactgtccttcgacgtggtgaacggcgccgcggacagccacagcaaatccatccgctgggactaccggcaggaggacccggtcaacgacgcgcgcggcacccgtctcgaacgcgccgccgcccgcccggacatgctcaccgacgccccgcagctcaacatcaccaacgtgatcgcccccaacggcggccgcgtctatgtggaccacgcccaccccgaatactcggcgccggaaaccaccgacccgttcgaagcggtccgatacgaccacgccggagacctcatcatgcaggccgccaccgaacacgcccgcaaacagactggcactcccattgccctgcatcgcaacaatgtggatggcaagggctcctgctggggcacgcacgagaactatatgatggcccgcgcggtgccattcgacttggtcacacgcctgatgaccctccacttcgtcacccgccagatctacgccggctccggccgcgtagggattggcgagaacagcgagatcccgggctaccagctcagccagcgcgccgactacatccacgccaaagtcggcctgcaaaccaccttcgaacgcccgatcatcaatacgcgcgacgaatcccactccaccgatgcataccgccgtctgcacgtcatcgtcggcgacgccaatcgcatggaggtgccgcaggcactgaaactcggcaccacgagcatgctgctgtggctgctcgaacatgcggacgaggccggattcgacctgaacgccttcctcgacgaactcgaactgtctgacccagtcgaggccatacacaccgtttcccgcgacctgacgctgggggcaatcttgccgctggccaacggcggcgaaaccaacgcatggcttatccagctcaaactgcgccaagccgtctaccaggttgccgcactggtcgaaggtaccgacaccgccggcgaacccgcctggccggacaaatccaccacatccattatggcgatgtggcagcaggcgctcatcgactgcgcctccatccgccatgccgccgacgatgacgaacgtctggccatgaccggcgaggccagccgcatcgaatggctgctcaaatggcagctgctcgaaaaactgcgccgcaaaatcaccacaacgtccgcacccggcgtggccaacggatggaatgatccgcgactgaaggtcatcgacctgaaatgggcggcgctcgaccccgcggacagcatcttcaccaaactcgaaccccgcaccgaacgggtggtgagcgccgccgacatcgcacgcgccaccaccgaaccgccggaagacacccgcgcctggctcagggcaaaactcgtggcgcaattcggcgatgaggtggccgccgccagctggtcccgactcactgttcgcgacccgcgcgccgcagacgagggcgaggcggtcgaattctacggcaatgccggccatatggccgctaccgaccatcacctgttctccctcgacatctccgatccgctcgccttcaccaaggcgcactgcgaaaccgaactcaattcagccgaacacgccatcgatctgctgaagtcgctggccatcaacgccgaacgatagacttggtagctatggaagaaacacgcgaagagaccccacaggacctgcgcaaccttgcgctcaaagtcgccggcctgctcgaagaagccggccagcatgccctccacgaccaactcaatccgcgtaacctcgcccagccgagcaccgagaacgcggaccgtggcccccgctacaagcttgaagtggacaacaagatcatgcgcttcatgagcgccagaatcgccgacatcgcccacttcgacggcttctggaccacccgccccgccgaaagccgccctggccagcgttactggtacatcggcaagatcgacggtgtgatcaactacgtacgtcgcatgagcgaatggacggtgaccgccgccctgttcgaattcggcccggacaacgagcccaagccgatcatcggcatcgtgcacgccccggccctcggcctgacctacctggccgccaggggagcgggtgccgtgcgcatccacaaaaccgcggtcggcgagaagcgcgacaaggtcgtgccgtcgatgacctcctcgctggatggttctgtgctgagctacggcatgtccttcatccccagcgaatcgcagcgtgcgctcgacgtggcctcctcgctcgccggacgcccggccgacatcaagcgcgtgggccccgtctcgctcgacctgtgcaaagtggccgacggcacctatgacgcctacttcgagccgatgctgcacgtgtgggatatcgcgggcatcgccgccggcaccgtagtggtctgggaggcacagggcacgctgagccgttgggacggcgaacgcatccactggcgtcacgataacgatgtagtggcctccaatggactcatcatccgcgaactgcagcattacctgcagcagtatccgtggctcgactccatcaaccagcgataattttttgactcctccggatcccctcgggtgaggggagccgtcggccgaaggctgactgaggggagtttgacagcccaaaaagaagacaacatgccacaacaattcgaacaacctcaagcacagcaggccgcgacccaggaagacgacgccctcgccaccacgcaggccgccgcccaaaccgagtccaccgaccaagccgacgtgttggacgacatcctcgacgacatcgaatccgccttggaaaccaacgccgaggaatacgtcaacagcttcgtgcaaaaaggcggcgagtgatgccccaactgcgtgacagcggcacccgctccctgcacgccacggaacccgtaccatccgccgagatggacgggttctgccgtattttcggcgtcgaaaccgaatacggcgtggcggtcaccggtgccgaacgccccgtggacgccggccaggtggcgatgaccatgttccagcccatcgtctcccgttcccgctccaccaacacgtatctggccaatggctcacgtctgtatctggacgtcggatcccaccccgaatacgccaccgccgaagcgcgcgacccgcgcgaggccctggcccaggacctcgccggcgaacacgtgatgcgcaacctagccctgaaggcccagcgcaagctgcgcgaatcctacggcgcacacgccacgatccatgtgttcaaaaacaacgtcgactccgccggccacgccttcggctgccacgaaaactacctggtccgccgcttcgtgccgttggagaccatcgaacaccagctgctgccgttcctcatcacccgccagctgtacaccggtgccggccgcatgaccccggacggcttccagatcacccagcgcgcggacttcctggacgaggccgtctcctcggccaccacccgctcccgcccgatggtcaacacgcgcgacgaaccgcacgccgaccccgactccttccgccggctgcatgtgatcatcggcgactcgaaccgttcgcaatggtccacatggatgaagcttgccgtcacgcaccttgtgctgtgcgcgatcgaagacgccttccgccatggcgttccgtccggattcgagcagtatgcctttgctgatccggctgccgccaatcgcacggtcagtcgattccttgacaatccgcgcgccgaactgacgttcgaatcaggcgaatccgtgtccgcactgggtctgcagcgccggtattatgcggcggtcaaggccttcatcgaaacccatggcgatgcgctggcaagttcgctgccggccaccacgatcgacacgattatgggggagtggagccgcgttctggacgcgctggagcgtggtacatacgatgcgctcgccgaccgcgtggactgggccgccaagaagcgtctgttcgacgcgctcaaacgccgtcgcccggacgtcaccttcgcccagatggaacagcttgagctcgactaccacgacatcgccaacggtcgcctgtacggttcgctcgtagcccgcaaccagatgcgtgagctgctgacaggagacaacgtggaatacgccgtgcacaatccgccgaccgacacccgtgccgccctgcgtggccggttcgtggacgcggccctgaacgtcggggcccagttctccgccgactggacccacctgaccctgaccgctcccgaacgccgggaagccatactcctcgatcccttcgaggccgagcccaccctgggattcgagcagcttatggaagcgctgaactagtccggaataatacggttggacaacacgtcacagcaccacaacaaaaagaccccgaccatctcggtcggggtctttgtcgtcagtaatgctcgaagtaatcgctacgagcagaaggtcactcggtgacggccttcttcagcagggagccagcggagatacgaacgccgtaggaagccggaatgtcaatctgctcgccagtgcgcgggttgcggccggtgcgagcggcgcgcttgacgcgctcagcggagaacaggccggtgagcttcaggccttcgccggacttcatagcctcgacgaacacatcctggaaggcgttaacagcagcctcggcctgagccttggtcaggttggacttctgggcgatcttcgaaacgaggtcagacttgttgtatgccataaagcatccttcttgggtcaggggacaagcacttttgcttagtccatgttgtcatcaatgatactagcgcatgtttctgcgaaaacccgcgttttataagggttttcacatctatttccccgaagggggtatgaaaatagacgaatcagacaagattatgcttgtcaagccacttcatggccgccgcgcccagcggaatgcgcagccagtagaacaccacgcggtgcagcaaagtggcggaaagcgccacgccctgcggcactccgaccgccacgaacgcgaatgtcagcgccgcttccacaccgcccagaccgcctggagtgggcactgcggaacccaatgcataggccagcaggaagacgaacgtcgtttcaatcggattcgatgaatggccgaacgcttgcagggccgcccagaaagcgagcccagtggtcgcgttctggaacagcgcgcccaggcagctgactgtgagctgtcggggctgggaaagcacgtccagcagctggttgatatacgtcttggccagcggcataagacgacgggtcacccagtggcgcaacggcggaatcatcatcgcaatggacagcaccacgaccacaacgcccagcacgataaccaacgtgtttgtcgggattgcgccggagaacatgttgcggccggtgaacaggccgatgatgaccagcatggagaagtacacggcgtaatacaccacgagcgcggcgctcataattgcggtcgcctgggtgttgcgatagccggatttgcgcaggaactgcaggttgacgaacgaggggcccacgccggctggcatggatacggtggcgaagccgcctgccacctggctcatgaagacgcccatattgtcacgcttgtgccgcgccatcagggaaccgagcgaaatcgacgagccgatccagccgcagacaccgaacgcgagcgtcaccaccgccatcaacgggttggcgttggtcagcgcggtgatgatctcctcgggcttcagttgggtgaagaccacgaccacggccacgatgaccagcagcatggtgatcatcgaacgccaggagaatcgggccagcgtcaccggttcggcggattccaccgtctcctcgtcagccagcgcggtgatacgactcctcaggcccttgagcagctgcttgtcccaggattccagcgcgcgcgtgggggaggggaccgcgaccttctgaatgaacggggccaaggccgtcagagtcgtgtctccccacgcctcgcgggcggcctccaccgccggttccacgccgatcagcgcggcgaacagcactagcagctgaactttgtcgagcgcggtgttggccggaccggaagcgttgtcgccgttgagccagccggcaatcacggcggtgccgtcttcaagccgggcgagcgtgtccggcgtgatgcgccggtgcgtatagccgcgccggctcgccacggacaggtagcgcatgtaggccacggcatccgccttggtaagcgtgttcaggttggcgggcagctcgatggtgtgtgcatccagcaccagaatcgcggattcgtcggtatcggcgatgccgtagggtgcgggcgcgggcagtttgatattgtgcagacccagcagcatggcgaaatgatgctggacggcgtcacgcacggaacggtcacgtcggatggacacactggtgaaacgcacccagtcccacaactgcttcagatagccgacggtatgggtctgcgcgtcgatgacggaaacgatgaaacgacggttgtccgtggtatccagatcgtagatgcgcgagccttcggccagatcgtcgtccagcgtgacggccagtgaaccgtggccgacgccgggctcctgatgccgaatcagcgaggcggtgtccagtccgatgcctttcagggcggcgaccagatcttggccccacacgcccttgttctgcgtgccgaccacgaatcggatcagcatgcccactgtgcggccggcggccatcgacaccagcatgccggtgaccgaatgccacgacagcaccaccatcaccgcagcgatggcatacaggatattccagctccatttgaccgtggagcgggtgcggcgtggcccggcggcggtcaggaaggacgccatgccggcgtagatgtcgggcaacagcccggagccgtatgaggtggcggctgagactagtgccattggcagggtgaaatcgttcagactgctgattgccgtcgatacgacccacaccatgccgtagccggcgaacatggccagcgcggacaccgcggcctgcagccattcccgggccagtagcaattgagcgagcacgatgatcacgatgacgatggtggccagctgcgtcagcacggtggaggggaagtcagccaaccagttgatgacctgggctgcggtgtgtgcgtcggattcgacgccgcgcgtcatgccgcccagatacacggcgaacaccatgaccacggcggccatcaacagcgacagaccggcccgggtcagatcgccgaagtcgcgcgtgcggcgcggagcgatgtcgtcgatgtacggtccggaatcgttgctgtcgtcggttgccgggctgtccggtccgctgacagcaaaactggccgaccggccgtcaccagaggcgatcggccggtcggtagtggaggaggtcgccttgtccgggcgatcttccgtagtggactgctcctgttcagtagtcatgaaatggttacctgacgcctgtccttgttcggttcagtttgcggtttggtttgtgactcagcgcagtagtgtggtggatgcgatgggctcgagggactcgcatcgcacctatttcagcggtcgaaagcgacgagctggctggccacaccggtgtaggtggcgggggtcagagccttcaagcgagcggcggtttccgggtcgaaggactgctggtcgatgaactgctcgacctgttccttgttgatggtgtggccgcgcataagctccttgaccttctcgtacggcttgtccatgcccggcaggcccttgagctcgcaggcgcgcatggcggtttggatcggctcgccaagcacctcccagttctcatcaagctcacgctcgatgacgtgggtgttcgggtggatggactcaaggccgcccatgaggttggtcagggcgagcaaggagtagccgagcgcggaaccgatgttgcgctgggtggtcgaatcggtcagatcgcgctgccaacgggattccaccagcgtggcggagagggtgtcgagcagcgagcagctgatttcgaagttggcttcggcgttctcgaaacgaatcgggttgaccttgtgcggcatggtggaggaaccagtggcacccttgaccggcacctgggcgaacactccacgggagatgtacatccacacgtccacacacaggttgtgcatgatgcggttggcgtgggagacggtggagtacagctcggcctgccagtcgtggctttcgatctgcgtggtcagcgggttccaggtcaggcccatgcggttggtgacgaattcgcgggagacggcgacccagtcgacatccgggcatgcggccaggtgggcgccgaacgtgccggtcgcgccgttgatcttgcccaagtactcctggttttcgatgtgcttgagctgacggttcagacggtagacgtagacggcgagctccttgccgagcgtggtcggtgtggccggctggccgtgggtgagggagagcagcggcatatccttgaattcctcggccttgccggcgaggtggtcgatgatgcgcttgaactccggggtccacacgttttccatcgcgttcttgacgcaacgggcgatggagaggttgttgatgtcttcggacgtgcaggcgaagtgcacgagggtcttcagctcgtcgttgatgttggtcagctcggccggagccttgtcgatctgatcatcgatgtagtactccacggccttcacatcgtggtgggtgatggcctcatgagcggcgtgctgcttgatgccttcggcgccgaagtcctcgggaatggcgcgcaggaaggcctgctcttcggcagtgaacggcttgacgccgtcaacgatcggctggttgccgttgccctcaaagccgttggccagaagaatcatccattcgacttcgacacgcatgcgttcgcggttcagggcaggttcgctcatgtattcgacgagcggggcggtggccttgtgataacggccgtcgagtggggtcaatgcgattgcgggggaaatatcggtaagcttcataacctccaagggtacttccagccgtgaaccgagcggctatactgtggtgcggcgttcccgcccgagccgcacaggtcaaggaacgcccgtggttcgattactgtgtgcggcctttaaggctaggagatcaccatgcctgcaaccaccattcatactcttccgaaacgtccgattgccgtatcgtcactgaaatggcagccgttggatatcgcggtcggtgccacgctgggtgcggcctgcggcgtgatcttctggggattcaacttcgcgtacatgccgatctcttcggtattcggcgcgattctgcccggtttcgccagcatcgtgcacgccgtctggtacttctccggtacgctggcggtgctgattctgcgcaaacccggagcggcgctgtacgtgaaccttatcggcacgctggtcgaaacggtgattggtagccagttcgatttgggcttcgtgattatctcggcgctgttgcaaggtgttttcgctgagattccgttcgccttgacccgttaccgcatgttcaatctgccgatttccattgcatccggtgcgttggtcgccttggaatacggcacatatctgatgctgtttcgctacgtgggtgtgtcattcgtcagcccgcgtggcattgtgcacatgatttccgaggtcaccggcggcgtgcttatcagcggcgtgatggcctggtatctgatgctggccatcgccaaaaccggtgtgctcgaccgcctcgcatccggccgcgcactcatcgagcgacgcgcctgacactctttgcgcgccactttcccgggaatgttgcgctgatagagggggtttcgggcatgctagcgcaacaatcccgggaaagtggcgctagccgcgtctctgcggtgattgcattgtggggtagccgattgatgctaagcattgacaagttgatgtgcccgttgccgtgagaccccgagtatatcgcctatttgctgtagggcgagacccatgccatgtagttcttgtgctgcggcgcgagtttcccgcgctgcgttcgatctgcattccgcttcttccttgcgcagtcgccgagcttcatcaagatgctcctgcacggattgcggcagctttgtctctacggtgagtgcgaaatcagcatcttgtgtcatgacggtgataaggtcgcgtgccatactttcaatctctgctgttgttcttgcctgcgtgaaaccgataccgggaatctcaagaatccagtatttttcgccaggacgaacgatgacctgatatgttttcactgctgataccagcctttcccgagtttggcttctgcttccttacaaatgatgttcgcgaggttgttgtcgatttcgttatgacgtgggatggggaatcataagtccatcgagttggaatatctcatgactccctccttgcctgatactttcaaacgtgacattcttgcgttctgccgcttgcttcatcagtttgatgagccatctcctactcgtcattatattgttaactcctttcttgacaactctgtcaagtgtggtatttacttttaaccgccgaacgtgctgaactcggtggttcgctcgctaggggcaatggtcgcggactgggtcatgcggccttggtagtagcgggtttccttgagctctccgttgataacttcctggaaatgggcttcgtggcgttgcacggcgggggagccgaggtcggtggcgttctgataggcggcctgatggtatttgatccagtgcgacaactccctgccgttggtcgaaccagccacgggtgcggcgtcatatggggtcagaccggtgatgggcgttgcgccgggagtgcatgagccgtccgaatgcactgtggatggtgttgccgcgggcgcgggcgatacatgcccttgtacggtgagccagttatcggtgaccgggttggcggcaccatccagtgcggcgaccagttcatcatcgatttccacgctggtgacccacgtgcgttgcggaatcggatgattggccaccggcgatccggctgtcaccacatgctcgatggtatattcctccgcccaatccgaggcaagcgtggcggcaacgataccaccctgggaatggccgatcagcgccacgggctcatccttgccgatgcctgcctgacgcatcgcctcggcaaccatgcgagcgctgtccgctttcctgcggcgctcctgatcggcgctcatcagttccacgttctgcgcccagccaaatggtgagtcaggctgtccatcggtacccgggatggtgaccagccaggagttggttccatcagatcgttcatagcgttgaatggcgatggtcccatattcgagtccgctgttcagctcgattttgccgagccgctcttcggcgagcctgcgcagattctccattgactcggccaccgatccgcttgcgcggacaacgtcggcattcgcctgcacctcgcgcacgtccagatgattgccttggacgacgtctttcgccgggccggagaaattggcgattttccccgcagccttgttgacctcatcggtgtgcgcaatgctcttgccgataggtacgccgccaatgattccgcccgcgccgctaagcactccttcctggaacggataggtgaacgtggacatccatgccgggttcggtttgccgtcaatagtccagccggccagaaagccgcccgccgccacagcggcaacacccgccgcggcatatcccggtttggcctgtgtgccggcctgcaataattcggtaaacatgcgccgagccgtcatctccgcctgagaatacagagagtgtgcgcgaatcagcagatcggccgcgccacgcagatcatcgctcaaccgctgacatgccgttgcatggtcataacaccgattgcccagcgcggcatatggtgcagtgacatggccgggaacaacggcgctcggatcgcccgactgcaaggtgacgcacatcggcgcactatgccgatgtgactgcaactgtaatgcggccgattcccaagccgtggctatggccgcaaatcctgccgcctcgtcatcgagagccttggctatggcggcatattcttcaagagtggctggcgcatatcccactccgccgtaaacggacgattccacttgccagtaatcgtgctcgctcatgacgacccccaagccaatcggtgggtggtctccatgtcttgcgcgagactggccgaatactgtgcggtgcgactgagccgcgatcggaatagatcggcggctttaccggtccacacgatgttgctggagcggttcacggccaccgccgtctggtccgattgcgccagtgtggccgcacgctggacggacacgaggtcgcgactacgctgtaccgccgcatggcaagggcaagtgccgtaatcgaacggcgtcaccgtattgccggcaaagccgccggtgggatcgatgggtgctgggttgctggtgtaggtattcatatatccagctaaaaggacaagactcatgcttgtccagccggaacgaccaatgtggttctagcttgccgattttgggtgaagttatccccaagtgttgtgcatagtcgtaacgattatccacaaatagcctgtttggacataccttggatcagccatggcctatcgaaaattggataaatgccaaagccgacagccgaaaccgggaaacagccgcgataaagccatgacccgtgagggtgtgagaaaaaagaacaactgtgaacgactgcttaccacggcttggtagccccggtacccttgttctgcgtcgctttctgctcggattgggtggtgttcgactgggtatcggtggattgctgattggccttcatcagctcctcgacctgcttcttctgttcgtcggtcaacgcgccgccctttttggcattggatgaagaattctcggattgctgtgccgactgggcttgcccagaatcggaaccgctgttctgcgcctcggcctgtttcagggtgatcttcgtcagctcggaagaaatcgaagcattggtgtcgatggcgtccttgacttgcggcaacagaagcgtgcgcattcgcccggcctcgtcgaattgcgcgtcggtctgctgctgttgcgccttgagcgtggtgatatccgtggactcgtcctgagccgctttgatattggcgttcaatgatgcggtggcctgattgaacgtaatcgaagcggacaggtttactgccgccacgccggcaaccagcaacagcaatacggcgccacaagccaggacgatacgtgcccaaagcggacacttcgcccgcatccgagtattcgccgagccgtcgttctcgtggatttcgttactgtttctcacagcagtctccttgaggttgcgatccatgcaccgacttccatggcaagcaatatcgccaacgcaatggccaacggccataccaccggcgtggtgcgtgtgcgttccctgaccgtggtggccatgcgccactgcttcgacgacttggccgaaaccgaatccgccaaagtctgtgaagcgttcacggccacatacgtgccactgatctcgtcggcaatgtctttaaggttcttctcatccatcttggagatgccgggttcgccggtatccgggtcgaccacccagtggtccgtggtgttggaatcgccggcactgacgccatcggcgatgacgggaatcttgccgccctcggtcgagccgacgcccacggtaaacccatcattgagatactggcgcagtgacgagaacgtacgacgcgtcacattcgaggtctgttcgccgtcagtgatgaggtacagcacaatcgcatcatccgggtgcgcttcacgaatcgacttcacggtcagcagcaattgatcgatcggagcatccagactggagcccgccgacacggatgtggcttccaccgccaacgtgttggcccaattatcgatggccggcgcatccggggtcagcggcacatcaagcgtccccgaagcaccgaaccgtaacgccgcgaaactggcgtccggataagcggcggtcacatcatgcacggcctggcgtgcggcatcgatgcgggtaatggtcttctcggacccgtatgtggcgtcggccaccgccatcgacccggtggtatccaccgccacaatgacgtcggtggcattgatggcctgtgaggtggtagacgataccacgctgggagtcagtaccatcaccgcgacaatgagcagcataagcgtacgtcgtatgcaagcccacgcggtctcgtcactggaagcacggcgacgaacaaataatgcgatttcgagaatggccagtacggcgagcccggccgccagcagtccgccggcgacccagcccaaggcgggggagaaggtgaatccgttcatcgcctcaacctccatgcacatacgatccagataatgagtatcacggccagagcaagcgtccacagaccgggagcgtccaccatcgaggatttcgccttgttctccacatccgtatctctacgcgactgaatatcccgtaccagctcatctatcgacgcgccattcgattgggtgaggaagatgcctccatgcgactcgatcgcggacttcatatccgttgtggtttggtccgattcactggctttcggcccggaatacaggccgtccacggtgattttggtctgctgggtcaaatccaacgcttcggtcagcgaataggtgggcttgcccgacacgacgttgtcggtggccagcacgatggatgccgcacgctgacggtcggcattcgcatgattggcttcgccataagcgaaaccggggagcatcgccgcgcaagacaccacgccgtcgccaatcaaggaggtggcgtccttgcggttctgcgtgccttcgagccaattggcgatgtcctgatattcggcatcggacatcttatcgatgtcatcctgcgactcgacgcctttcagcgccttgctggcggaggtcaactgtttggtgaccagttcgtagtcgtcggtcagcgggaacaccgtgcgtgaggtcgagttgaagatactcaaaccgatacgttcccccttgaaatgcttgaccagttccaaataggtgtcgatgacctcgcgatcataggggagcgtggaccccgacacatccagacacaggacgatatctcggctggaagcgcgttcgtcaccggcatccacttggctggggcgagccaccagcacaatggccagcgccagcgcaagcaccagcacgctgatggcgagacggcccaaagcgcgccattgacggaacaggcgggaagcgtgctcggtattgagatcgtcgtccatcgagaatacaggggtgtcgtcggcggcgttacggcgggcgaacacgacaatcagcacgataatcgccagcgtcgccaagacgccggccagagcggcccaaggccaatgccatgccagcatcatgaacgccacctttccaccagattcgccacccactcggcggcctgctgcacgctggtcgtctgggcgattcggttgcgggcatcatcggcaaattccggtggatacaacgcgccaatggtctgcttcaatgcgtccaatccttggcgattcgcgggcgtgcgattcaggtacgccaaatcggtcagcgtactggaactaagctccttgcctgatgcggcaccggcgaaatcacgggcgatgacggacaattcgacgaaagcctcatgccggggcagtgctccggattcatgacgggccaccacatcgtcgatgcgggcacgccactcggccttggagctggcattgctatgagcgccacgcgcgcggtcgctgttccgaggtttgcgtgcggggcgagacagcatgatgatcaacgcgatcagacctaccgccagcaacaggcatgcgacgatggccaccaccaggggagtggtcaaggccaacgactccacgggcctgagatcgccgggatcagtggcgagcgggatgatggggaacatgctgtgcatcatagatcaccagccaaagtcagtccgaccagttcgggtgcagtacccagtctattgcgtgtggtgcgggccaatgcccgggacaccagggcgacgaaacgatcgaacatggattcgctggatgcggatcgaatgatatgggaaccggcacgggtgagctcctgttccaaagccgcggccatatacgcgcgatgagtatcgacctcggccgctgccttggcgttgcgcaggaatgccggcacacgccgtgcactcaagccgtcggtgggagcgtggcgggatgagacggccttgaacggattcatcgtcgccacatcgatcagcaccatcggatgggtgcgggtaatacgacggatcgtggtgatatgccgctcctccatcgcatgctcatcggtggccaatacgatcaatgcctcgcgatccttgatacggcgcgcatattccagcagcgcgtcgatattacggtgatgatcccaatcacggtcaagcgccttgtccagcgtgcgttcgaactgcgcgaacccaccgttgaacggtacgcgggtgatgctggactcatcgccgaacaccagcgaaatatcgtccgaccggcgcaacgacagtgcggcgaacatacgcagcgcattggcggcaacctgccatgcgcgttctccggaagggcatacgccagtcatctccaggcccacgtccatcagcaaccagacccgtgacgtcgacaggcgctcacgctcgaccaccatggggcggccttggcgggcgctggtcttccaatcgataagacgggattcgtcgcctggctcataggcatgcacatccatcgcatcgccgctgccgccacgacgcccggatgcgtgttcgccctccagcgcgcccaaagccttccttacggtaggcaggctcagctgagtgccaagggcctcgattttcttgcgaacggaatcggaactcacggaacaggaaccgtttcgacgatcttgtcgacgatctgatcgctgaccacgccatcggccagtgcctcgaacgtcagcataatacggtggcgcagcacctcatgagcgaacgccttgaggtcctcgggcaccacatagtcgcgcccggacagcaacgccttcgcctggccgatacgggtcaaggcgatggtggcgcgcggcgaggcacccaaacgcaccaaggatgacagtcccttgatggggcgggagccggcacctcgtgacgtggcggtgatatcgaccgcataacgcatgatcgcgtcggaaacatgcacgcggcgtgccgccttgcgcaaaaaatcaacgtcggacacggaaatgcgttcgccggtgatggtgtcgggaccgatcatgtcggagccgcggcgggtgagcatggccagcatccgagcctcttcgtcgggcgaaggataggtcatgacggccttcatcatgaaacgatccatctgggcttcgggcaggttgaacgtgccctcctcctcgatcggattctcggtggcgatcaccatgaacggcttgggcaaggcgatacgctgcccgccgatggtcgtggcaccctcggccatggcctcaagcatggcggactgggttttggcattcgaacggttgatctcgtccagcagtacgaaattggcgtgaatcggaccgatctgcgtggtgaacttctgcgacgcaaaatcgaagacctgcgtgcccaccagatcagatggcatgagatcaggagtgcactgcacgcgcttgaacgagccggatacgcaggtggcgagcgtctgggcggccgtggtcttggccaagcccggcacggattcgataagaatatgcccgccggccaccaaggtcacgataagcgattcgcgtagattatcctgacccaccagtgtctgggcgaacctcgcccgaatggcgtcggccaggatacgtgcgcgtttggcgtcatcggcacccagcggagccgacacgccgggcgcgggaacggtgaccggtcgtgcggcggtggtcggcgaaggtatgttcggttgcgtggggaacaaagtcatgccccccactgtaactactcacaatgactgttggcctgcctaaagagtccaatccaccgggtcggcacccatggtgactagggcttgattggctctggagaatggtttggagccgaagaatccgcgggaagcggacagcggactcggatgaggcgatttgataatgaaggcattggtcagcaatggctcgaggctttgcgcattacgcccccagagaatcgccaccaacggcttgggcttgccgtcggcgtccgtgcgcgcgttcaacgcacgaatcgcggcctcggtgacttcctcccagcctttgccctgatgtgaatttggccgtccgacgccgacagtcagacatctgttgagcaacatcaccccacgttccgtccacggtgtcagatcgccgttggtgggcatgggcaccccaaggtcgtcaaccaattccttataaatattgatcaggcttttcggcagcgggtgaacatttggcgccacgcagaagctcaaacccaccgggtgacccggggtcgggtaggggtcctggccgacaatcagcaccttgatggaatcgaacgggatggtgaacgcgcgcagaatattgtggcttgccggcagccacgggcgcccggcggcgttttccgcacgaagaaaatcgcccatatggtggatggtgggctccacgtcggccaaggcatgggcccaccctggctctaccagttcgctcaatggtttgatcatgactcaccactgtagtcaaacgtgcatatccggtgcatggggcgtggtgtggtggactgatgagttgtttgccgattacactcatgggtagttttgataggaagaaagggcgattatggcacgcgacacgatgacctacgaatcctatgaaccggattccttcgacaatcctccgaagggaccggtgggagttcaccgtggcgctcgttcggtaatggcccgcctctgcccgttcatcgtcgttattctggtggccgcgctgtgcggtgtcggggcctgggcatggatttccggagaatacaagaatgtagtgggaggatcgtcccagacggcgaccacgtccaagtccgattcgtccagcaaggctgagaccaagaacagcaccaaggatgattcctcgtccacttcgaccgattcgtccaaggactcgacttcggattcggcaaagtccgataccgacagtgacacgacatcctcgaatgagaatcaaaactccgatcagcagtctcagcagtccgaagccatcgcgactgtgaataaggccacgcaggtgcgtgtggtcaacgccacaggaatccaaggatatgcgggtcagcaggccgatgtgctgcagaccgccggttacaccagtgtcgaggcgaccaatccgagcggcacattgccggcttcttccgtggtgtggtatcagaatgagaccgataaggccaccgctgaggatgtggcgaccacgcttggcatttcggctgtggagcaggtgcaaggactcgccgttcccattacggtggtgttgctcaactagcgttgttgatgcgcccctgatatcggcgagaaatacatcgaaaactgtgagcgttctcacgcctatggaataattcgtaccgaaaatgtgccactgcggttgagattgttccctcgtcactgtacaatcgtcatctagtcgcgaggtagggggagcgcgatgcggttctttctacgttccctataggttttgtgtcgcgacgcccaagggaacaaaggaaagaccagatatggcacaaggtgccgtgaagttcttccttgccaagaaggggttcgggtttatccagccggacgacggcggcgaggacgttttcgtgcactacgcggaaatcaaggacgacggcagcaccaataagttcaaaatgctgtacgaaggcgatcgcgtggagtatacgcccgcttcgtccggcaaaggcacgcaggcaaaggatgttgtcaagctgtcttcgggtgaagcccgctccgagtgagcaacacgcacgcaaggatgtgcattgaaggccctgaccgtttcgacggttggggctttttcatgcccaaagcgcaatcgccgccgatggtgttggcactcggcgggcgcgagtgctaatgtctgggttagcactcggaggtcgagagtgataatcggcagctgacggctggtcgtcacgactcgacgcttgcgagtgataaccggtatacctagccatttggaggaatacgcaaccatggcaaagatcatctcttatgatgaggaagcccgtcagggcatgctggagggccttgacaagctcgccaacaccgtcaaggtcactctgggcccgaagggccgcaacgtcgtgctcgacaagacctacggcgctccgaccatcaccaacgatggcgtgtccatcgccaaggaaatcgaccttgaagacccgtacgagcgcatcggcgccgagctggtcaaggaagtcgccaagaagaccgacgacgtcgccggtgacggcaccaccactgcaaccgtgcttgctcagtccctggttcacgagggtctgaagaacgtggtcgccggctccaacccgatcgccctgcgtcgcggcatcgagaaggccaccgaggtcatcgtcaaggaactcgtcgctgccgccaaggacgtcgagaccaaggaccagatcgctgctaccgccaccatctccgccgctgaccctgaggtcggcgagaagatcgctgaggctctggacaaggtcggccaggacggcgttgtgaccgttgaagacaacaaccgcttcggcctggacctcgacttcaccgagggcatgcgttttgacaagggctacatcgccccgtacttcgtcaccaacgctgacgaccagaccgcagtgctcgaagatccgtacattctgctgacctccggcaaggtctcatcccagcaggacatcgtgcacgtggccgagctggtcatgaagaccggcaagccgctgctgatcatcgctgaggacgtcgacggcgaagcactgccgaccttgatcctgaacaacatccgtggcaccttcaagtcctgcgccgtcaaggccccgggctttggcgaccgtcgcaaggccatgctgcaggatatggccatcctgaccggtgctcaggttgtctccgacgaactgggcctgaagctcgagtccgtcgacacctccgtgctcggccacgccaagaaggtcatcgtctccaaggacgagaccaccatcgttcagggcgctggctccaaggaagacatcgacgctcgcgtggcccagatccgcgctgagatcgagaacaccgactccgattacgaccgtgagaagctgcaggagcgtctggccaagctggctggcggcgtggctgtcatcaaggtcggcgctgccaccgaggtcgaggccaaggagcgcaagcaccgcatcgaagatgccgtgcgtaacgccaaggccgccatcgaggaaggcctgctgcctggcggtggcgtggccctcgttcaggctgctgccaaggccgagaagaccgaggccgtcacctccctgaccggcgaagaggctaccggtgccgccatcgtgttccgcgccatcgaggccccgatcaagcagatcgccgagaacgccggcgtgtccggtgacgtggtcatcaacaccgtccgctccctgcctgatggcgaaggcttcaacgccgccaccgacacctacgaagacctgctggccgccggtgtgaccgacccggtcaaggtgacccgctccgctctgcagaacgccgcctccatcgctggtctgttcctgaccaccgaggccgtcgttgccaacaagccggagccgaagtctgctgccccggccgccggtgccgacatgggctactgatccgcaaacgatcgctagctgattgagctgaaaggggactccttcgggagtcccttttttgtattctggctcccctctttgaggggagccaagaaactagctggcaaacaggcgcgaagcttggatttcggcgtcagcgtacacggtggaggcttgcgtcagcgagcgttggatggactcgagtgaggcctccatctgctgttgggccgcacgccactgttcggctaccgcggtgaactgggtggccgccgaacctcgccatgcgtcctgcaaggcattgagattggtgtacatgccgcccacggcctgcctgatttgcgagatcgaagtggccactgcggccgaggatgattggattcgctcggaatctacctgatattggggcatcgttgctccttttctagagggttaatggtatgtatggcggccgattgccaataccggccgttaaggtggaggatatgtcaacaacgaatcgggaagacggaaaaacaactattgtggtcctagcttcggagccgtcctattcggccttcgggaatatggtccgaaaatggcttgtttgcgccatttgcgcccttgctgcagtagcgatgaacgcaatgtggataactgcaaatgcctatggggataactcgagcgacagctctgacagctccagcagcagcaccgacagcggcgtgaccatcaccgagaacatcacggatacggaaaatctcctgggctcccatgcggccgaagtcacggatgccatcgccaaaaccgagaaggaaaccggtgtacacgtgcatctgctgtatctttccagtttcaatagtcaacagaaaccgggagactgggcggcaaccgtgatggagtccatgaatcccaagccgaacacagtgatgcttgccgtggcctcgaatgacggcaacctggtggtcgtcgtgtccaagaactccgataagtggcttctcgataacaaaaccgtcgataagctatccgaagccgcacagcagccgttactggaaaacccgccgagctggtctggcgcggcaacggcaatgatggatcaaatcgtgaaatccaaaaaagcctccacctcatcgtccacggtgatcgtaggcataatcatcatgggtgtggtattggtggcgctggtcatcatcatcgtggtcatggtggtgattcatcggcgcaaggagatcaagaaggattccaaggccgaactccaagatgacattcaggaaacgcccagaagagcgcgacactctaggaagcatgagtaagcctattgaagcatcgattgttgttgtcgacgacgagccgtccatccgagaactgctggtcgcttccctgcacttcgccggattcgaggtaaacaccgccgcttccggttccgaagccattgaggttatcgaaaaagtgcagcctgacctcatcgtgttggacgtcatgctgcctgacatcgatggattcaccgtcacccgtcgcatccgccaggaaggcattaacgcccctgtgctgtttctcaccgctcgtgacgacacccaagacaagatcatgggcctgaccgtcggcggtgacgattacgtcaccaagccgttcagcctcgaggaagtcgtggctcgcatccgcgccattctgcgccgtacccgcgaacaggtggaagacgatccgattattcgcgtcgccgacttggaaatcaacgaggactcccacgacgtgacccgtgcagggcagccggttgacctgagccctaccgaatacaagctgctgcgctacctgatggacaacgagggccgagtactgtccaaggcacagattctcgaccatgtctggcaatacgactggggcggcgacgcagccatcgtcgaatcgtacatctcctacctgcgcaagaaagtcgacggcatcgaggtcgacgacggcgaaggcggcaagcgcaaggtgactccgctgatcgaaaccaagcgcggcatcggatacatgattcgcgaaccgaagaactaatcgcctccatccataacgtatcgcaatctcatgagtatccccgataagcagtcaggcggcgtaccgccgagcagcacgccgaacgccgccccgaacacgaatcccatgcctgcaatgtcgccgttcgccgcccatttccaagagcagcgcgagcgtaagaaaaacatgctgatgcggcatatcgaccgtatctcgttgagcagcaagctggtggcctgcaccatcgccgtgctgctcatcggcgtgtcggtgatttccttctccatccgcgcgttggtgaacaactacatgctgcagaaaaccgacacccagttaagctcgcaaagccaactggtggtcaacaatatcgatctgctgtcaaaaaatgactcatcggggccgaactcgtactttctgcagattcaatacaccgacggaaccaaagacaaagaaggcaatcctctggtcgtgaccccgctgatgccgcagatgcaggacggtatcgtatcggtgccgattctgcctacctatggcgataccaatggcatcacgctcggtcaggcattcactacgcaggcggtggccaagcagatcatcacggtgcagtccgacagtgcggacagccagaacgatccggccaacggaaactccaattcctctgacaccatcaccaaggtactggccaaccccactgccaatgccaaccatgccgccatcgtcacggcgagggcaccatggcgtattctgccggtgaccttccagcaaaacggcaaggaccgtgccgtggtgtacatcggcttgtcgctggccgaccaaatcgacaccgtcaacacactcacccgatactgcattgtggtcggcatcgccgtggtgctgctcggcggctccctgtccacgctgatcatccagcacacgatgacgccgctgaagcgcatcgagaagaccgccgcgaaaattgcagccggcgacctgagccaacgtattccttccgcgccggaaaacaccgaggtcggctctctggccgcctcgctgaattccatgctcacccgaatagaatccagtttccatgagcaggaggagaccaccgacaagatgaaacggttcgtctccgacgccagccatgagctgcgcaccccgttggccgccatccatggctatgcggagctgtataagatgcagcgcgatatgcctggtgccttggagcgtgcggacgagtccatcgaacatatcgaacggtccagccagcgcatgactgttcttgttgaggatctgctgtctttggcccgtctcgatgaggggcgcggcatcgatatgaccggcacggtgaaactctcgtcgctggtcaccgacgccgtcgacgatttgcatgcgctcgacccggaccgtgccgttcgccgcatgcagatttccctcgaaccggcgcgcgatttgaaccatcccgccgaattcagccttgccgaaggcgattggcctgaggtcgtactgcccggtgatgcctctcgactgcgccaggtggtgaccaacatcgtgggcaacatccaccgctacacgcctgccgattcgcccgctgaagccgcgctcggtgtgatgccggccgccatcgatccaagacagctcgcccgcatgcccgccagcgacgcgtcaatgcggcggttcatcgacgctgccgaagtaggtgcctcgatgcagaccggctatcgatatgccgtattgcgtttcgtggaccatggccccggcgtgccgcctgaatcgcgctcgaagattttcgaacgcttctacaccgcggacccatcccgtgcccgcgaaaagggcggtactggtttgggcatggccatcgcgcaatccgtggtcaaagcacatcacggctttatctgcgccaccggcaccgatgggggaggcctgaccttcaccgtggtgctgccgattgagcagatcgccgctcctgagcccaagcagtccaccggcaaaaccaaggacgccaaacagaagacttcttggttcagctctgagcgtaagactcaggcgactcagcccaaagcgtgaggtcaagccctgtgaggtaaactgtaccttcggtttactatttccattgaggattaaggaaggttcgcaatgcccaccggtcgagttcgttggtttgacgcagccaagggttatggcttcatcaccagtgaggaaggcaaggacgtgttcctgccggctcaggccctacccactggcgtcaccacgttgcgcaagggggccaaggtggagtattccgtggtggacggccgtcgtgggccgcaggccatggatgttcgcctgatcgcctccgctcccagcttggtcaaggccacccgcccgaaggcggatgacatggccgccatctgcgaggacctcatcaagatgcttgatgcggccggcaatacgttgcgccgtcaccgttacccatctgctgccgacagcaaaaagctggccacgttgctgcgtgcggtggcggatcaattcgatgtacaggactgatctgatctatgactgataccaccgaaaccatcgtgacaccggaccctcacgccatcgcgcgcgccgtgctgctcgaagtggccgacgagagcgatcaggtgggggatttcgttacctcatataatcttgaggatcacgtcactgacttccgcttcgccgcgaatatccgtggctacgaaggatggcaatggtcggtgacgctgtatcacgacgaggagatcgactcctggaccgtcaacgaatcctccttgatctccactgaggacgcgttgatgccgcccaagtggattccttggaaggatcgccttgagcccacggatctggctcccaccgattcgatcggtaccgatccggatgacgagcgcatcgaggaaggcgaagtcgaggaatcctcgctgcaggatgtcaacgacgccgtcgagaccttccgactgacccgccgtcacgtgctgacctcgctgggccgcgcgcaggctgccaagcgctggtatgaaggtccgcgaggccccaaagcgttgagcaccaaaaccgccgaaggcaacctgtgctccacctgtggtttcttcgtgccgctcgcgggcgagctcgaccgtatgttcggcgtgtgcgccaacaagtggagtccggatgacggccgcgtggtttccttggaccacggctgcggcgagcattccgaaatcgaacctcccgagccaagccagctgtgggtgcagtccaagcctgctttcgacgatctgcatatcgacgtggtggccaaccgtccgcgcaagcaggagccggctgcccaggacgaggccgaaggcgaaaccgacaagacaggcgagcctgccggtgatgatatcgaagcacagaagactgttgacgggaacgccgtcgatactgagcccgctgaggaggcggcaggcgacgggacctcgcaatcccagtctgccggtgatgagtccgttgcacagaacgtatctgattccgttgtggatgttgatgcagctgattccagcgacgattccaagtctgatgctgacgacgaggccaccgaagaggatatcctcaacaacaccgttgccgatgatgatgaggatgatgagatggacgacgaagaggataacgttcgtccttcagacgatgtgactcctgaactcgaaaccgtcatcgatctcattgagcagctgcgccagaacagggcggacgaggaataaactccgaattccgcgaaaagtagatggtgatggggttgcaggaataaagaattcctccctgcaagcccatcaccgaggcgtgcgttagcactccatgccgattttggtgaatcagtgcaccacggtcaccgtgcattcggcgaagttcacgatctggcgggacaccgatcccaggaagtgcgcgtccagcccggacaggccacgcgagccgaccaccagatggctggcgtaccgcgaggccgcgatcagacctttggatgcgggaatatggaaggcgtttgtgctgaccttgacgccatcgggaatccgggccttggccatcagctcagagagaatctcctcggcgcggcgctgaccgaccttcaccggtgccacggcgttctcatagcccggaataacgcccaaatccttgagctgccagcagaacatcacatgcagcggcgcgtcgtgcagtcgtgcttcttccagtgcgaaatcgaacgcacggcgggaagtctcggaaccatccacaccaaccaccaccgggcggcgagcctcctcaaccaccggctgaggctgcgtgtagtgaacgggcttgtctcccggagtcagggcgttggcaatggcctcggtcacggtctcatcctcgctgccggcgatgcgcaccacggtcaccggcacttcggcggcctcggccagcgaagcggacagggaccccatgaaccagcgggccatacggctcagcgagcggcggccgaccacgatctgctgcgaatcatggccgatctgcagcagggccgaagtgccggaggccttcaccgaggtgagcttcagattcgccggatcgaagtcgatgcctgcagcggccttgtcgacccacacacgcagctcgttggcaatatcgtggcggaccttggcccaggcctcgtcgctgtccggttcggaccccatatcccaggaatgcgtccagccaaacacggcgttgacgctctgaccggttaacgaggcctcctcaagcgcccacttcagcgcggcaaaggattcatcggaaccatccacaccgacaacgatgtcgggcttggttgcagcttcactcatttcgagcctccttgtaatcgactacgggtgaatctagaaccagcatatcgttttcttctcctctcacggcgcaattcgtggaatccgatgaataaacgtcatcgtgaatcggtagagtaagacggaatgtcaattgaggaaggacaagcatgttcgaacggtttaccgaccgtgcacggcgcgtgatcgtgttggcgcaggaagaggcgagggcccttcagcacaactacatcggcaccgaacacctgctgctcggcctgatccgcgaaggtgagggtgtagccgccaaggcactcgcctcgaagggcgtggagctggatgccacccgcaagcaggttgaagaaatgatcggcaagggcaacgcggctccgaacgggcacatcccctttactccgcacgccaagcaggtgttggagttttcgctgcgtgaagccctgcagctgggccacagctacatcggcaccgagcacatcctgctcggcctgattcgcgaaggcgaaggcgtgggcacccaggtgctcatcaagatggacgtcgatctgggcgagttgcgtagcgcgaccatcgatatgattcgcggcaactccggcaccggcaccggtgacggcaagggcgacttggccaacgccggcggcgtgacggacaagcagaacaagtccggttccgccatcctcgatcagttcggccgcaacctgaccgccgaagccgctgaaggcaagctggacccggtcatcggccgtaccaacgagattgagcgcgttatggtcgtgctttcccgccgcaccaagaacaacccggtgctgatcggcgagcccggcgtgggcaagaccgctgtggtcgaaggcttggcccagaagatccaagccggcgacgtgccggaaaccctgaagggcaagcaggtctactcgctggacctcggttccatggtggccggctcccgctaccgtggtgatttcgaggagcgcctgaagaaggtgctgaaggaaatcaagactcgtggcgacatcgtgctgttcatcgacgagattcacaccatcgtgggcgccggctcggctgacggcgcgctgggtgcctccgacatgttgaagccgatgctggcccgtggcgagctccagaccattggtgccaccaccaccgacgagtaccgcaagtacatcgagaaggacgcggctctggaacgccgtttccagccgattcaggtgcacgagccgaccatcgccgagaccatcgagatcctgaagggcctgcgttcccgttacgagaaccaccaccacgtgaccatcaccgatggcgcgctgcagtctgccgcagagctgtccagccggtacatccaggaccgtaacctgcctgacaaggccatcgacctgatcgatgaggccggtgcacgcctgcgcatcaagcgcctgaccgccccgcctgagctcaaggaactcgacgagaagatcgccaagatcgccgccgacaaggacgaggccatcaagggccaggacttcgagaaggccgccgaactgcgcgacaagcaggagaagctggaagccgatcgcaagcagaaggaagactcctggcgcgaaggcgagtccgacgtcaagatggtcgtggacgaggacgtgatcgccgaggtcatcagctccaccaccggtatcccggtgttcaagctgactcaggccgagtccaagaaactgctcaacatggaagccgaactgcacaagcgcatcatcggccaggacgaggcggtttccgccctgtcccgctctatccgccgtactcgcgtgggtctgaaggacccgaagcgcccgtccggttcgttcatcttcgccggccccaccggcgtcggcaagaccgagctggccaagacgctcgccgaattcctgttcgacgatgaggacgcgctgattcgcgtggatatgtccgagttctccgagaagtacgcggcttcgcgactcttcggtgcgcctccgggatacgtcggctacgaggagggcggcgagctcaccgaaaaggtgcgccgcaagccgttctccgtggtgctgttcgacgagatcgaaaaggctcatccggacatcttcaacacgctgctgcaggtgctcgatgacggccacctgaccgacggtcagggccgcaaggtggactttaagaacaccatcatcatcctgaccaccaacctcggtacgcgagacatcgccaaggccgccaacacgggcttcaacctgggtgccaacaacgagtccagctaccagcgcatgaaggaccaggtcagctccgaattgaagcagcagttccgcccggagttcctgaaccgtctggacgacatcatcgtcttcaagcagctcaccgagccgcaggtgcgccagatcgtggatctggacgtcaagcagctcaacgaccgcctgttcgaccgtcatatgtcgctcgaactcaccgacgccgccaaggacctgctcgcgcagaagggcttcgacccgctgctcggtgcccgtccgctgcgccgcgtgattcagcgcgacatcgaggacgccatctccgagaagatcctgatgggcgatctcgaagacggtcagcgcgtgattgtggatgcggaaggcgagggtatcctcggcgaattcaccttcaagggtgaggagttcgaggagccggccgccgccgatgccgaaacttcgtccgaagccggtgcctccactgatggcgagactccagccgacgccactccggccactgaaccggccgaatccgctcccgccgattccggtgacgctccgcaggagtagtccgtttcgatagcgtagctagcgcataccagaaaagctccccttgacaggggagctgtcagcgaagctgacttaggggtagaccacaaacgcatacatgatgtgcacgtttgtggtctacccctcagttgcctctggcgacagctcccctgtcaaggggagctactgtttgtgtcggattattacagcagggcgagtccggtgtcgatggtctcctcgcgggtaaacagcgtgcggccggcgcgcaccgaacgcaataccgagcagcgctcatacacggcgttgaacacgctatcggcgtccagcacaatgaagtttgctggcttgcccgtttccaagccgtacatatcgcgcaggcccaacgtagtggcaccgttgacggtcaggaacttcaacgcatcgtcgatttcttcaaagctcatcatctgtgccaaatgcagcacataatcaagaatgagcatcatattgccattgcccagcgggtaccacgggtcctgcattgaatcctggcccaatgacacattgacacccgcctcagtgagctccttgactcgcgtgatgccacggcgcttggggaaggtatcctgacggccctgcaaatacaggttctcggtgggggcgcaggcgaagttgatatgcgccgccttaagcagcttggtcaggtggaagaagtaggcgttgtccgccgatcccagcgagcaggtgtggctggcggtgaccttcgggccaatgccagccttatacgccaatgccgaaagcagctccacgtaacgggaattcggatcatccgtctcatcgcaatgcacgtcgatgagcttgtcgtatttcgaagccaactcaactaccgtgtgcatggaatgctcgccaaactcacggcactgttcgaaatgggggatgccgcccacgcagtcggcacccatcttgagtccttcctccaccagctcggcacccgattcgccatgcgggccctcgtaggagtacatgccctcctgcgggaagctgacgatctggagagtgaccgtatccttcaattcctccttaagctccagcagcgcctttaacgaggtcaggttcgggtcggtcacatcggcatgggatcgaatgagctgtacgccatgcagcatttctttcttaatgccgattttcgcgcgctgcttgatctcgtcgaccgtcaagtcggacttggtctcactccatcgctggatgccctcaaacaaggttccgctttcattcaccgcaccgggcttgcgggccgtgaatacgtaatcaaggtgcagatgcgtatcgcagaacggtgggcagacaagtttgccgcccagatcgaccacctcaatggccgccggatcaccaccctgagcctcatattgttgcgcgagtccggggccgaatgcggtgaacacaccatccgtgacgagaatgtcctgcaatggcagggtgcttgcagccgtgcttccgggttctccggtggcgatatgtgcgttggtgaacagtgtggtagtcatcgtcgctccttcaactggtgtgttgccgaacggttacgtgaaccgactgcccgcgtaaccaactgaggttattgtcaacagcacgctttgcggtgaggttaaccggaacgaccggtgttccgcgggggaatggacagattgtatgactgtatcgattcgcagtgtgcttcataacacgcagttcaaacgagccgatcctgtggtggaggtcgaaggcaaagacctcgatatgccagtgcgatgggtgttcaccaacgagcgagaggatgtctccagcttcctttcgggcggtgagatgctgattatcgagggcaacgctctgctcgccgccgattggcacggcacgctaggacaatatgtagcaagcctggcacaggctggtgtcgccgctctggtggtcgaactggtggagggtgtggtgcggatgccggacgaactggtgtctgcggccaggctgcatgggttgacgttgattggtttgaaatctcgcgtaccttttgtcgacatctgtcagagcgtcaataccgctattgtgcacgaacagatgcacttgcaattggaggtggacacaatgtccacttcattacgtgagggattgtcccgtaccggcaatatcgaggctgtggccgaaaccattgcgtcgctgttcggcgaaagcgtcgctattttcgatggtgacggtctgttggccgctcgagcgggtcgtgcgttcgatgtcggcaacgaatcgagcgtcgtcatcgcccttgaaagtcgctcccggccggtgggagcattggagatcacgcaacgcaccatgactttcgacgccacgatgcgtcgggccatcgccaccatcgtgtctccggtggctgccctttatattgacggcggtgcgcgcatgggcatgatgcatcatctgagtatgggtccggccgacggcgtgcacgtcaatacatttgaggcgcaggaagcgcatgcgatgctcgaagcgctgggttttgccggatcatgcatctatatgccattcgcttttcggttcagatcggtggtggaaggcatcaaccatgtatcgacgatggtcgaacggttcgaagaacggtcgggatgcgccgtctcctgcatgctggaaggtgacttgatggtcggatggtgctccaccaccgattcctcagacggtgcggccgcattcggacgccattgcatggatgcgcttgccgtactggaaggcgacggtatatacgtggtgcatggccgagtggcattggacacggtgacgctggtcgacgggttcgcggtattgcgtgacatcgccaatcaggaaccggcatacgggcgaatcgtaagtaccatgtccgcactcgtcgaccgtttcgtcgcatcctctgatatggacaaggcgatgcgcatgctcgtggtgcagaccatcggattcgaggtcgccgcctctccgttgttgctggacacactgtgcgcctgcttcgacaacctcgacagcaaaaccggcgcgtgcgagcaattgggcatcagacggcaaaccctgtacaaccgactggacaaagtgacacaaatggtcggcgtcgactataacgacaaaccgaactggtcgatgctgctattcgccgccaaactcacgaaatcatggcaagaacagcatgttgaataatgcgccggcaccactgggcaacctgtccacttctacgccgaacgggttaatcgacgattcacgtttcagcaaatactcaagggcatagtcgaggctatcgcggcgctggtcgacctgctgcgaaacggattcccacttgaatctcattcagtcacacgaacagcacatccttgaaaggacggtgacatcatgagttccgcaatgattactacatctgcacgactgatgaattccaccccgcaaactgaagaacaggccatggtcaggaaagtcgcggtatcctccttcctcggcaacttcatcgagtggttcgactacgcctcctattcgtacttcgccaccactatcgccctggtgttcttcccaaccgacaatcacaccgtcgccatgctgcagaccttcggcgtgttcgcgctatccttcatcctgcgtccaatcggcgcactgttctggggtagctatggagataagaaaggccgtaaagccgcattggcccactcgattatgttcatgtccggtgcgagcttcctgattggctgcctgccgtcttactcggtgattggcgttggcgcgccgattctgcttctactgctgcgcatggtgcagggcttctccgcctccggtgaatatgccggtgcggccacgttcctcggcgaatatgcgcccacttcaaagcgcggcatctactgctcgctgattccggcttccaccgctatcggtctgctcgccggttctactctggccacgctgatgaccgccaacatgaactctagcgcgatggtcggttggggatggcgtgtgccgttcctgctggccggcccgctcggtctgattgtgctgtacatccgcgccaagctcgctgattcccccgtctaccagtcgatgaacgatgcgcttgagtccaagggcgccgcctccgccgacggtcaaatcgctgccaagagcggcatgttcgccccgctcgccgagttgttccacaaccatctcaaggctctgatcatcagcttcggagcctgcgtgctgaacgcggtcggcttctacaccgtgctcacctacctgccgacctatctgtctgacaccgtcggcatggacgccccccagtccggcactatcaccaccatctgcctggtcgcctacgtgttcatggtgttcggcatgggccacgtctccgacaaattcggccgcaagaaggtgctcatcggcgcttgcgtggcgttcatcgttctcaccgttcctgccttcctcatcctcaacacctcccagttctggcccgtgctgctggttgagctggcaatgtgcgccaccctgaccgccaacgacggtaccctgtccagctacctgaccgagacgttccccacctccgtgcgcttcaccggattcgcgttcagcttcaatctggccaacgccatcttcggtggtacggcctcgttcatcgccactggcctgattgccctgaccggttcgtccatcgccccggcctggtacatggtgggcgttgcggccatcgccttggtcgcgatgatcctctcccacgaaaacaccgacaaggatctgaatcacatctgatctcctcagctccggctccttccccgagggagccgggcgtattcatcgaccatccaatccaccaccaacctaaaggagtactgcaatgggtagcaaccgtcgtatggaccacatgacctggccggaattcaaggaggcgaagactcgtcccgtcatcgtgccgatcggttcgaccgaacagcacggccagcatctgcccatcggcaccgacgcggtactcgccacgcgggtcgccgaagatctggcggaacgcatcgacggcactgtgctgcccaccctgagctacggatacaagtccaagccgctctccggtggcgggccgctgttcccgggcactatcgacatgaacggcgtgacagtgatcaaccaaatgcacgacgtgctgagcgaactcatcgccgatggcttcaccaagatcgtcgtcatgaacgcgcattttgaaaacgaggcgttcatcgtcgaggccatcgacctggtcacccgcgaaaccgggggagtggccaccatcgtggaaaccaattggtgggacccggttccgcagtcggttatcgacaaggtgttcgatggattggtgttccccggctgggcgttggagcatgcggccgtcaccgaaacttcgttgatgctccactatgcgccggaactggtgcacatggaccgtatggtcgaggaagccggtgccacggcgaaatcctatgtccgctaccctgtgcgccaaggtgacgttcccgctcacggcggactcgccaatccggccggctcgagcgccgaacgcggccgtctgattgccgaggcgtgcgtggatgcggtagctgagatctgcgccgaggaatttggcgagtaatctcctcttgctgacgcattcgtagtgactcccgatgtctatttagaagtgcaacacccttgttggtcctgtaattctaacagttctaaacccgaaaaatcatcgtgactaaacccgcaacaactaattgaacacaaacatcgaacgccgtggacggcaacggcatcaacgcggccctctcctcgtcgaacacctcggccacgggcacgtccggcaacctcgggcaacacgagtccctggcgagcccgtcgcaccgctccagcaggagacggctcaactgcccatacgattccgcgcgcatgggcggcaccatgagattgcgccgcaaaaacccgaccgcgttctccacgctgcccttctcgttgcccgagtacgggttgcagaaccggacctcgagccggtaatgcgccacgaacgcggagaacaccccggtcaacgcgacctcgcccttcgcgttgcgccggccggcaccggtcgcgttgtccatcacgatcacgggaggaacacccccgatatgctcgaacacgagcatcaggccatggcacagacactccgcgttctcgcccggcaacgccacgcacaaccgcatgttcgaatacggcaacgagaccaccaggcaatgcacgtccgccatctcgccagcgatccgggcccgggccacgccgaaatcgacctgcatgctgcccgccgcccactcgagccgcacgtacccctcgcgatccggcacgccgcggttcgcctcgcgccaccggtgcacgtaacgcatcgtggtcgaatactcgccgtcgtagtccgtctccgccagcagacggtcgtgcacgcgcctgatcgtgtgccgctgcttcctgggcagcagacgatcggcctccagccacccgtccaccagatgcgcgtacgggtcgatcttcgacccgtacctgcgatccgccttcggcttgggcgagcaatcctccatatccgcgtacttcgcgaccgtcccgcgatccacatgcagacgacgcgctatctgcgcgcgcgacattccctgccggtcgagtctcctgatatcttgcacaatgggcatcggtatcgccatgttcctttccttcccgagcgccggccggcggcaaccggccgaatcaaaaccgattggcaactcgggaatatacaggccgcggcaccgatgcctctcacatcaccgggaaacgatgacgacaccggggaaaaccatcagcccacactgcggaaaaacactgccgaacctgtcgaacaaacattgaagcaaaacactcgaaatccctggtgaaccggctgcccggttccgcccacggcacggaggcgaccacgacgccgcacctcgggcagtccacgcgcggcatggcggcgaccagttcgacgcgccagcagcccgaagtcctggccacgccagcggcgcactccgccgccctggtcatacccgcggtgcctccttccgcagcgggagcatctgagcgcgcccgcacgcgggcgcacgcggacctcgagcacgggctcgggacgcaacggcgagtcgacgatccgcacgtcctcgaccaccgtgcctttgacgttgagaagctggttgaatatgctgctcatcaggcgctttttggctgtgcttttcttggtcgttaaacagcctacccaaaaagcgctcttctcttactcccacaacggttcaacaacgaaccaccacccacgaaaacaacaacagcgccgttttttgatccctccctcagtcagcgcgactgacagctccctcacagagagagctcagtttttactgcttgttgatggaacaggcagcggtgtcagtggtgacaccggaatcagtccagcccattggagtttggtcgatggtgaggtcggagacggccttgatagaggtagtcacatcaaaggagtaggtaacggattctccagggccgatattggcgatgctggcatacacggtcttgccattcaaagtctcctgacgactaccagtcaccgtaccacctgaggtttgaagattcgtgaggctgcctcccgcaggagcgtagattaaggttttctctacgccacggccttgttgatcagcgtttacactgagaatatacgttccggcagctccagctatgccaatctggttatcgtctatcgtattcgtcatcgtatattccacatggtaggtctgagaaccatcattattgcaggcggaacgagttatcttcgacgtgcggtgaatataccaccccatctttgacgggttctgctcagtcacatacacacccgcctgcggatgttcctcactgctcggagtctgtgcagtgaagcctgcatcgctaatagtcttctcagtagcctcgtcaaacgaatacattgagaagcaacgaccttccgacatacttcccatcagttgcgctaccttgctcagcttcgtcaaatccaaattagagaacatgttactaactgtttgctcggcgacttgggcaaaataggtgtcctgcatgtaaaccggataatcgatatacaccttgtttaacaggaattcagcagtgttgcctccggcgagcacacggccatcagaaagcgtgatgttgccgttgattttcaccaattcctgcagaaacaccggatcaaccatgagcacaccatccaatggagtgtcacgtccccatgatgtgcgctgccagatagactgcataccttctgcaacacgagaggtatcaggatatacagccaaatcacggatatcgaacgacattttcagaggcccccactgctcgaaaatacgctgttcatcttccgttggatcaccagcaccatacgggatgcactctttgttcgagcggaaatccccaatactaatcttgccgttgtccgtagtcaccacacccacggaaccaatcaggccaccggatgagcgctcctccgaagtggtcatggccatcaacgcgtatgtacgcgcctggccagagccgagaaaattcggcggaatctggaatgtgccagatagctgatcaaccctatcggccaatttcgttaattgagtcttgccggtgttgtaggcatcgttgactatgccgatatgggccttcggcagattctgatatttctggacctgctgttgcagcgattcattggctgagacaatggtcttctgcgcctccagaatcggctgaatattcagctgcccatcccctgtgctcagttgcgcattcttcaaagtagtcagcacattcataaactgcggcgccgagtcgccaatcaatgaatccactaccgaagtcatgccctgcacggcggtaatgtcatcgccatacactggcagtttcgaggcaatgttccacagcgtgccatgcacaatatcgttcgccgcggcggtttcggtcttcgcttgatcgatctgctaactcaccttatcaacgttgtcgagattgctgagatcggatatgccacccaacaattgcaaagcctgctcctcatgagccttaacctgcttggcttcggaatacggtttcaatccgcagaatccacacacgcctaacagcaccacgagcaatgccagaatcgacaccacccatggccagacacggtgccttctgctcggaatacttactgcgtgccctgccctatgcctgctcataccaattcccaaaatgtctgagccaacttgcatatctatgcaatgaccaaccacctattatgccccggtctcttgcgaaaagtgggttcgctccccgcttctgcacatattccgaaccgactgggcacccccaggtataacgtattggggtgcttttgagaggctgcccggccaagcacatgaagagacggtcgccgaaaccatcgattgttgcgcgacatatgacgccgcatgaagaaccgacatgccaaccgacaccgcccaaagccatcaggccgagcaacggaagtggagtgtgtgcgtggctggagagagcggaatcaagaaccgtcgtggcgaactgcaacgagtgctgagccaagaggaatcgtacgttgacggcaagctgagtcatgccgcgtttatttcgatcgcaatcctgaccttcatcacctttgtcggcaactttacccagctgcaactgagctcggcgctgccgatcatcgtgtcggaattccatatttccgtgaccacaggccagtggctgacctccgtgttccagctggttatgggcgtcatggtaccgctgaccgcgttcctgacccgtcgtttctccacccgtcagatcgtgatctgctcgatggcggtgttcacggtcggctccctgcttgcctggctgggcccgaacttcctcttcgtgctgctcggccgcgtgctggaggcagccggcacaggcgtgatgtggccggtgctgcaaatcaccgtgttctccatttacccgctgtctcgccgcgggtttgccatgggcacggtgggcatggccatgagcgtggcgccagccatcggccccaccttgggcggctggcagaccgatgccaacggctggcgctcgatcttcctgaccatgaccatcattggcgtaatctcgctgctggcggccatgttcggactgcataatttcggttcacacgacccttcggcccgcgcggacttcttctcggtgtgcctgtcggtgatcggctttggtgggctgatgttcggcttcaccaattcagagacctatggattcgcggcaccggtcacgtgggggcccatggttgtgggactggtcggcatcgtgtggtttgtgatgcgcaacctgcgcgctggcaagcggtatcgcgaggccgtagccaaggacgagtcggcactcccccagccgccgctgctggacttggaagtgctgaagaaccgttcgttcaccgtcggcactattaccgcgtcgctggcatttttcgccttcagttcgattttggtcatcatgccgctctacatccagactgaccgcggctattcggccacgatgagcggtctgatcatgctgccgggcgccatcggccagtgcgtctcccagttcttcggcggccgcgcgatggatcggttcggcgcgcgcccggtggctttgttcggttcgattgtgttgacccttggcaccttgggcatgtcgctggtggcgatggatacgtggatctggtgggtatcgatctgccagttcatccgtcagatcggcatgggtttcctgctgatgccgattaccacgtggtccctgaattgcctgaacgggccgagcgaagtgtccgccggatcatcggtgacgaataccgcgcgtcagattgcgggcgctgtgggcgcacccgtgttggtgattctgatggaaacgtttgccgctttgcataagcagggcggcgcctccgccgtcgccgcttcgattttcggcattcaatgggcgctgcgaatctccgcaataatctgtctggcaatggtgttgatggtgttcttcggcgtcaagggcgacggtgccggtcgtacgcgagacattatttccttgcgcgcgctgcgcgaacggcgtgcgcggcgtatggctgcgaactgacggcagattcaaccattctcaacataataagaaaccccggttccaacaccggggcttcttattatgttgtgctatcgcaggatttcagctggagtctattacgccctgcccatcagcgtcaggacaatcagcagcacgttgagcgccacaatcagtgccaccacaatcataaaaatcacgtgcttgacggttccatcagcccacttgcccatgagttccttgttatgcgtgtatcgcatcagcggaatcacggcgaacgggatgccgatggaaagcaccacctggccgatgaccagcgcctgagtcgggtccttggcgaaccacagcacaatcagagccggcaccagcgtgaccacgcggcaggcccacatcggggcgttaacgtgcagcagaccgtgcatgatttccgagccggcatacgtgccgaccgatgtggagctcagcgacgaagccagcaggccgatggagaagatcgtgccgatcaccgggccaagcacctgcgtgatcgcccgttgtgcgccgtcgatggagtccgtgccagacatgccgtgcagcgagttggcggcgagcaccagcatcgccagattcacggtgccggccagcaacagcgcccaggccacatcgattttcgagcctctcagctgcgttttgattgacggcttttcgccgcctgcgtaatggtcgttcaccagcgtggagtgcaggtagatggcgtgcggcatcacggtggcgcccagaatcgaggcggccatcaacaccgagtcggcgccttggaagcgtggaatcatgcctttgaccacttcgccggggttcggcggggctacgaacagacccgcgatgaagccgaatgtgataatcagcagcatcacgatgatgatgcgctcgaacgtggtctgtgtcttgccaccttggaaccacagcatcaccgtggagattgcgccgatcaccagaccgccgatgaacagtggaaatccgaacagcaggttcagggcgatggcgccgccgatcacctcggccagatcggtggcgatggcgatgacctcggcctgcataaagaacatgaaacggccggcatcgctcatacgctcgcccagcagttccggcagggatttgttggtcacgatgccgagtttggcggactgatactggatgagcacgctcatggcgttggcgagcaccagcacccacaccaacaggtagccgtatcgtgcgccggaggtgatgttggccgccacattaccaggatcgacgtaggccacggccgccacgaacgcggggccaaggatgctggccagcgcatggtcatgcggcttcttattgttgttcgtccctgctccggccccggttccgactccggcaagctggcgttccttcccgatttccggtgtttcctgttcgatgtctgccacagcgttcgtcatagcggttgccgcagtggcatctgcttcggtgtgtgttactgccatatcgtttgtaccagttcccttcataccgcgcacagttatagcgcaggcctgtttcccgagtcaacagacggacaatctgcggacgattgatggatgaccggcggactggcagctggcatttcccgccatctcgctcatgaaatgtgccagacggtagaaaactcgctcatgaaatgaggtaattactagaaaactcgctcatgaaatgtgccagacggtagaaaactcgctcatgaaagtgtaaaatcattgatatagcagtaattcggaaaggggctcctcatgtatctcaaacgcaaagccgatgcctatctcaatgcatggaaatccgacccgaatcgctccccgctaatcatcaagggccctcgtcaagtaggcaagacagagactatcgattactttgccgcacacaactaccgttcggtagtggaaatcaacttcgttgaggaaccgaaatatcgtgcaatcactgcggacggttatggcgcgaataccatcgtccgcaatatttccctgatcgacccagccaaaaagttcattccgggcgatacgctcatctttttcgacgaaatccaggcccatcctgatatcgccactgcactgaagttctttaaaatcgacggcaaatatgatgtgatttgcagcggttcaatgttgggcatcagctataagcaaatcgaaagcaatagcgtgggatataagaccgactacgaaatgcgatcgttggacttcgaggaatttctgtgggctcgcggatacgatgaggccgtcatcgaaagcatgttcacccacctgtgtaatgctacgccattctctgaagtggaaatgaacgtcttctccacggcatttatggattactgcgtgcttggcggcatgcctgcggttgtcgcctcccatatacgcactggcacgttcgagggaacactgcaattgcagcgccagcttattttggactaccaggaggatatccgcaaatacgcgcaaggactcgatcaggcacgaattctcaacgtgttcaaccatattcccgtgcaacttgccaaggaaaacaagaagttccaaatcagcaaggttgccagcggagcgcgtttcaaagactatcgaggatgcgtggaatggcttgaaacctcgggaatggtgaatatctgccgatgtatgtcctatcctgaactgccgttgaaaggcaattatgacgaaaacaagttcaagatatatttcggcgataccggtctgttcgtagcgatgcttgacgacgaggccagtgatgatctgcgggccaatcgtaatcttggtgtctataagggtgctatgtacgagagcatcgtctctgaagcgctacggaaatccggctatgacctgtactactacaaaaaagaggattccacactggaacaggatttcttcgtccgcacgcgcgaatggctggtgccggtggaggtgaaatcgaaaaaaggcaccgccaaatccatgcggacgctaatcgcttcggattcttatccggaaattcagttcggcgtgaaactatccgccggcaatatcggtagcagcgaacacgtgttcaccgcaccatacttcaccacatttttgctccgacggctcctgcgcgcttatgacgaggggcaggcacctatgctcaacaatcctgagcggtagcccctattcgtctgcgggcacggcctggcccgggcaggtgtggaggacggcgagcatggcgtccttttcttgggaggtgacggtgagctggtacttgtctttgacgccaatctggcgggccacgtagtcgcaacggtagtcggcgttggtgggtagccagtaggcggcggaggccgaacccttctcctgattggccgggccgtcgactgccagcaggttgtaggggtcattgccgaattcatggcgtttggcagtggaccagtcgtgtgcaccggattgccaagcgttttcaagggccaccacatggtcgatctgcactttggcgctggtggcgcggccacgtacgaaatggatggtctgagcggtgtacggatcggccagtgtgccggactcgaccacacaggaaccggcgtatttgtaggtgatgtccgtgagatcgcgggcgagcacgtcgtcgcgtacgtcgcagccattgccgtcgacgtcggtggtgcggaaaccgaaggaatcgcggtcgtagccggaggagctttggttgtcgtctacggcgagtgcgttcaaggtgtcggcggctgaaccggtggcagtgtagccaccggtgattttggctgcgtcggagctgatctgcggcagtagcaggccgatggtcacgccgattgctgcggcgagaacgatgaggatcagcacgcgctccagcggtccggaggcgttgaaacgacggcggaagtgggcgcgacggcgtgccatcaatcacgcataggtgaaggtgagggggtcgtggccggcgcgggtggggccgtcgagggcgtcgatggcagcgtgttcgtcggcggtcagggcgaagccgaacaggtcgagattctccctctgacggtcggcatgcacggacttggggatgatgatcgtgccgttttcgatgtgccagcgcagaatcacctgggccgggctgacctcatgggcggcggcgatcttctcgatggtgccgtcgccggcgttgaggtcggcgccacgcgccatcggcgagtaggcctccacggcgatgccgtgctccttgcagaacgccaccacttcgcgctgctgccacgtggggtgcagctcaatttggttgacggccggccatgcgccggtctccccgtgcagacgcttcagatcggcgggcatgaagttgcatacgccgagcgtgcgtgccatgccttcgtcgcgcagcttgacgaacgccttccaggtgtcggtgctgcgccagtcgaacggcgtgggccaatggatcatgtacatgtccacgtaatcgagctggaggagtttcagggagttgtcgaatgccttgagcgcggagtcgtagccctgctcggagtcgcgcagcttggtggtgacccacagggtctcgcgcttggcgccggtgttgtatccggaagcggcgagcgcacgacccacgccggcctcgttgttgtatccggcggcgccatcgatgtggcggtatccggcttccagcgcagattcgacgacaggggccacgccctcgtcaccgatacgtagcatgccaaggccgacctgcggaatggaatggccgtctttcaaggcgatgtccggcacgttggcgggattgatgtgtccgttggtcatggcttgtgatgctccttcatgtactgcaactacacgccactgtacacggttatgcaggcgatgtgcgggtgctgcaaccaaacggcatgattgcgcccggccttccgtgtgggagagccgggcgcaatcatgacaacatcacgctctactcctgcgaccggccctcgccctattgttcccgggcgcgaatttgccccggtacaggcgtcaatcgattgacgtttgcaccggggcagaaatcgttgtcccggtacgcaatttcgggccattttcgagaaccaggacaagacaatccccaaagtccacataccccaacaaacagaatcggcggaatacagccaatcccgaaatcaacatactgtcccggttctcacgtagaacgattgacgtgcaaaccggggcaacgggaattgtcccggtacgcgaaaaacacccgttttcgcaaaccaggacagtgatttctgtcctggtacccacatcaaacgattgatgcacgaaccgggacagaatcgcatcgccgcgccgagacagacgcatctgacagccgacaaccgataaacgacagccgacagatggcatctgacagccggctgccggctgccggcaaccgcatcataatgccgcatcagtctctatcaggagcgcttacgacgcaaagcaagcgagaccccgccggccacgccgagaacgacaaccgcaagacccacggcagtcaccgcgctaccggtattgctcagcacaccagtgatcttgtcgccattcgcaccgttggtcttatcgccctcgcccgtatcgggattgatagtagccccgccattacccgcaccgtccgagccgttgccggaaccaccttcggcccgagcggtaaccgcaaccgtataggtttcggtgacattcggattcgacttgaacgttacggtaaccttcgccgcatcagcgggagcggagaaatcgtaatcgagcgtgaactggtcggcggaaagcgtcacgttgcccatgcctgcggaatagttgcccacgaccttgagatcatggtcggcatcgatggcatcgcccacctgataggtggttttgcttggcgtgacggtcaggctggagacctccttttgggcgaggccggcaatggcatcggcaacaagcttgatcacatcgttcacgtcctgctcggtgtaggtgctgccggcaagcagcacgtcagcggcggcaagcgcctgatcgagtttggcgagcgactcgttggtgtactcatcgcgattgattttcccggcttcggccacggccttgtccaggttctccgtggatggcttcaccggagtttcggtctttttgacgagtgagaccttgtccacattgccccatgcgtcggcaggcaggttgcccgtgatggtgatggtcgctgtgccatcagcacccacggtgacaggcacggtggcggtatcgaacttaacccaaccgttgagttccagcgcatcggacgtggtcttgccacccgttgtggcggagagggccacaccatcggtaatagcggcgttgtccgctgccgcgccttggctcatggcggtcagcacgtattcgccaggctcgagtccggtgatggtctgcgtggcggagaaactgtaggcatcggatgtccaaaacttcagcgcgcgcttgccgtcggcggcgttgccactgtcttcggtgatggacgcaccggtgccggcaatggtccagttcttatcgttctcagcgttctcgaagctgccgtccgttacgtaatccttggcgggagtggcggtgacggtgacggtgacggtcacgtcgtggccagcgttggtggtgccggtgatggtgtatgtgcctgcgccacgaatccagtcaagcgcagcggattgccaggtcacggtttcggtctcgtccaccccatcctgatagtgtgcggccacctcactcggcaattgcgctttgatcgcgtcgatggaatccgagtcagtcgcggtaatctccactggatctatcttggtgaacacatgatcggtgacggcaccggtgtgaatgtacttgaacgtcggcagagaggcgagcgccttgccatcgaaatcgaacaaagcttggttatcgacacctgagccgccccagtacaggccggcgtcattgggttcgtattcgccggccgcttcagtggcccagccgccaccgtacttgttccacgtatccaccagttcggcgttatccttgccgccggtgcccacgggcacccatgcgggctcccagtagaacacacccaggccgtcgttttcgccatcgccatcattgtcgccgatattgttcacggcctcggcgaccgcgcgaatctcatcggcctggccttgcgggctgatgtcgtatttcttgaggttatcggcggttactttactgggcactgtgttggaatcgtcgtcgccatcatccaaggtgtatgcccacgacgtttccgccaccatcacatctttcttataagtggaggccacgttcttgagcacgctggtgaggttttcggtggtgccatgccagaacgggtagtaggagctggcgaacacatcgtaatccacattgtggttgctcaactgtttggcgtaagtggcgtaggtgccggctttctccgggttggtgaaatgaatgacgaccttggcttcggggagcacttcgcgtatggctttggaacctgcggagaatactttggacatgccgtcccagccggagatgccggcgattttcgcagtggtttcgttgccgacctgcaccatgccgacgtccacgccggcttgtttgaacgtggtcagagtctgcttggtgtagtcgtatacggtgtcggcggttttgtccgcgtcgccttcaaaggatttccacgccttgggcacctgctgcttgctggggtcggcccagaaatcggagtaatggaagtcgaccagcactttcagccctgctgccgtggctcgcttggccatggtcagtgcgcgatcggcgttgacgttgccgccgccatatccttggccgtctgcggtgaacggatcgttccacacacgcagacgcacatagttcacgccggattccttgagcaacgtgaacaaatcctcgacctcgccattggcgttcttgaacgtgacgccgctttcttccagcgagagcatggatgagacgtccataccgccgatgaaatcatcgcttaagccttggatggccttgaccgagacgtcggctttaactggttcttcttcggcggcgtttacagtgaacgtgcctcctgcgcagagcattatggcggccacgccggatgccataatgcgagtaagcacggtatttcggcgcatgctttttctcctttgaatggtgaacgctcagaacgaacgcccagtgatgcttggcgcttcctttccttatgcgccacgcggtacagctgtgtaccacgcaatcgtcaccttagcactttatgccgtgttggtcaaccggtgtatcaacgcctcgtacggcccagtacagcaacaccagcattacagcaatgtcgttcagcgtgtggaggcgcgggcgatgacctgggattcggtggtgagcagttcggacttggtgatgctgccgtcgatgcgtccgaggatgcgattcactgccgtgggagccgtccagtcaaggcgggaatccatggtggtcagcggaatctgcaggtagggggcttcctcgttgttatcgaagccgatgacctgcacctgcacgggcacctcataaccagcggtgcgcagagcggtcaatgcgccgatggccaactgatcgttcaaggcaatcacaccgtcgaatggcacgccggaatcaatgagccgctgggtcacacgggcaccggctccgatggtccaatcctgatcggtgttgccaatcagctgcggatccaaggagagcccacgcctacgggtctcttcgatgatgccgcgcagacgcagctgcgcgttgccttctacggcattcagcaatgcatcttcgtcgtaaacgtcacgggcaccgatcactgcaagtctggtggaaccgcggtcatacaggtagcctgcggccatggcggctgcggatacatcgtctggggtcacgtgatccacaatgccccacgtggtacgcgcgccaacgatgaccagcggaaaatcaaccttcagatcatcgggcgaaatgttttccacctcgctcatggaaaggatcatgccatcggacaccgtggagttgaacttcttcagcagatcgcgcgcgcctttcgcggagccttccgcatacgtggtgacgtatacggaatagtcgcgctgacgggcggcctcgatggtgcggttggcgagctcggccagatatggcggaatcagcgaaggcacggcgagggtgatgaagccggtgtgatcgcggttgaggttgcgggcggccacgttgactcggtagtcgaggtccttaatgaccgactcgaccttggcacgggtctcatctgtcatacgcccggagccattgatcacgttcgacgcagttttgagcgatacaccggcggcctgagcgacatcgcgtagcgtcactcgacgcttggctgttttctcgtcgctcatgccgcactcctctatccggacaacattgccattctagcgcggtttagcaggacgttttagcgataagaatggcgttgcggttcagcgtatatccaacggcgtcagtctcgcaacggtgggcgatgatgggatcaccttccacaccgttgatggcgacgggctggtttgagcggttgaggtagaaatcgaagcgggtggagccgtctgcggatcggcggatggtgtgcaggatgcggggatctgtggtgggataggttggagtttgaccactctcagtcggctgcgccgacaactcctgccatcgggagccaagtgctttgagcaactgggcaatgtcgtgacggttgaggtcgcagcccacgtagatggcggtaccgttgccataggggcggctggtgatggcgggggtgcgctccagctcccagtcggcggcggactcacctgcgtaagaggcaagcactgtggtgtccgcggctacggaagtcacgtcgttctgccacaggcgggtcgtcagaccattggacaggctgatttcgctgggctcgccttcggcttcttcaccgaggatgttgaattcttcggagcggatgccgagcatgtcgcgtaggagcccgttgccggcaccggggtagccgccgaggccgatgtggaagtgctcgtcgatcaggccggcggcatagccgacgatgacggttccgccggccttcgcgaagtcggcgatacggagaacgtcttcgtcggacaggctgagcacggtgggcagcacgatggttttgtagccggtccagtcgtaggcgagcggcaccacgtccgcgcgcagcccggcatccaggaagccgcggtaccagtcgcgcacgtcgtgccagtggttgagtttcatgctgggcagggtttcggagcgtgtggcccattcggattccgcgctgaacaggatcgccgtgccggcacgctcgagctcagtgccctgcagcccggcgtcggagagggtcttcagcgccttaccgagctcgcatacgccgcggaagaccttggaatcggcgcccgcgtggggcagcatggcggagtggaacgcctcggcgcccgacttggattgccgccattggaaaaagcagatggcgtcggcgcccatggccacgtgggccagggagtcgcgcatgagttcgccggcccgtttgcgtgtgttcagcggcttccactgcacggctgaggtggagtgctccatcacgtaccacggcttgcccagcgcgagggagtccatgagcgcgtccgagcaggcgagttcgtccaggtgggattcgccctcatggaagtagtgatcgttggacacgaagtccacctcatccgcccatttggcgtagttcatgacgcactggtcggtggagaccatgaagttcgtggtgaacggcttgtcggggcagatctgctcgatggcgtcgcgttcggctttgtagaagtcgagcagcatgtcgttgccgaaccgctcgtaatccaactgctgcgacgggttgaccatggcgtcgccgcccatgtgacgtggcagcagcacctcgtcgaaactgttcacgtgctgcgaccagaaggccgtgccccacgcctcgttcaacgcgtcgatggtaccgtacttggcctcgcaccacgtgcggaacgcggccaaggcgttgtcggagtagtcgtagcggttgttccagccgtattcgttgcccatgtgccaggcggtcacatacgggttgtccttgtagtgttcggcaagtttgcggcacaggcgcagcgcgtattccttgaacaccgggcttgtgggctgccacgactggcgtgagcccgcgttgacggtatgaccataccggtctaccggcagcacctctggatgggattcgtacagccacagcggcgcggcggctgtggcggaggccaagtccacggcgatgccggctctgccgagcctgtcgatcacatggtcgagccactcgaacgtgaacgcgccctcgaccggctcgatcttgtcccagctgaaaattgccagcgatacgacgttcacgccggcctcacccatgagacggatatcctcgtccagcgtctcctcgggccactggtccgggttgtagtcgccgccgaacgcgatgccgcggccggattccgtcagcagggacggccacctaaatgctctatgagtagtcatattaatcaaatcctttattgtatcggtttgcgggaagtgctgtgcttgcaggttgtgaacaccagagaggccgcccccgctggcggggctgtcagcgaagctgactggggggtggtcgccagtcgaatccccatatgaccaccctcagtccgctccgcggccagctcccgtcagagggagccagaggttactccttgacggcacctgcggcgaggcctgactgccagtacttctgtaggcacaggaacgcaatcaccagagggatgatcgtgatcagcgaaccggtaatcacgaggttttggatagcttgaccgcctgcggttgaagcctggtccttccactggttcagaccgatcgtcaacgggtaccagttggaatccttcaacatgatcaacggcaggaagtagttgttccacgtcgctacaatggcgaacaatgcagtggtcacgatgccgggtgccaacagcggcagggaaatctggaagaaggtgcggaactcgccggcaccatccacgcgcgcggcttcaagcagctcatccggcacggcctgatcggagaagatccacatcagatacagaccgaacgtggataccaaactcgggataatcatcgaccacggggtgttcgtgaggcccatcttggcgaacagcaggaactgcggcacggccagcgcgatacccggcaccgaaatggcgccgatgatgatcacgaagcacagcttacggccggggaagcggaacttggccagcgcatagccgcccatgatggccagcaaggtggcaccgccggcgccgaccaccacatacagaatcgtgttgacgaaccagcggccgaagataccgtcctgataggtgaacaccgtggcgatgttgtcgaacagggcgaacgttttgccgaaaccgaggccgaacgtcgaagtgaagtcggactgggtcttggtggcgttaatcatcaggtagacaaacgggaagaggcagtagaccgcgaaaatcgcgcacacgatggtcagggccatcgagcgggtcgggttcgccgggttggagaaaccggttttggcggcgcgcttgcgctcggccttctcgtcggcgtcgatgcgcttctgacgctccttctcggccttcttggcggccttttcctgagccttgagatcggccagggtcatggttgttgttgaagtcatggttgcagtgctcataattacttcatctgctccttcatactcttaagctggacgacatacgcaatggccatggtgatgatggccatcacgatggccagagctgcggcatagttgctctgattgccggtgaagctcaggttgtaggcgtacatgttcggcgtgtagtacgtggtgatcgcgttgcccggaaccatgttctgcaaaatgctcggctcgttgaacagctggaagctgccgatgatcgagaagatcaccgtgatggccagcgagcccttcagctccggcagcttgatcttcttaacaatctgccactccgaagcgccgtcgatggaggcggcctcatacaagctgtgcggaatggtgcttagggagctgtaaaaaatcagcatgttgtagccggcatattcccacgtgttgatgttcgcgatggatgcaagcagcacgtcggggttgagcacatcgatgttggtgccgaggaagtcgttgagggagccgaccagaccgtatttggcgccatacacgaaaccccaaatcatggtggagaccactgcgggcaccgcatagggcaggaatgtggagatgcggaagaacttggtgccatgcagcttcatcgaatccaaagcgagggccatggctgcggccagaaacagcatgatcggcacctggaatacggtgaagatagtgacgcggcccaccgagctccagaactgcggatcctgaatcagtcgggcgtagttctcgaagccgacgaacttggtgccgccgaccatctgcttcttgaagaaggagatgtaaatggcgtacacaattgggatgatgaacacgaagacgaacaccacggcgaacggccacatgaacttccagccgcgccagtcggccttgtgcttgttgacgcgggcctcggccgtgtgcagatccgcctcctcaggcaggattcccaccgttggctgcggggctgcggccattgtttgatcggacataatcgattgctttcttggaatacggattgctgtgctgcgcccgctaccagggggtcgctcgattggagcggtcacgtcaggcgagggcacgggaaagcggggacactggggagcatccccgctttgggagatcgggcggctaggcggaaggagagtggcctagccgcaggttttgattgttggtcagtgccggatgtaccggcaatagatcggttgcgtcacttgacggtgacgttgtagccctgctgattgccttgctcggcgagcttgttggcatagttttcaagcgccttctccagggtgatgtcgccggagtaggccttggagacttcgtcgccgtaagcggtctgggcgtacgggttgtacggcaggtactggaacttctcggtcgggcgctgagccgcggcggaaaggacttcgttgacgttctgaccgccgaagtagtcgttggtcttcttgttggactcggtggtcgggtcggtgaaggagtcggaccggaggatcttcttcagggacgggaaggtaccggtgtcggccatggtctgagcgccctcgccatgagtcatgtactcaacgagcttgtaggcagcggcctggttcttggactgcgaggtgacggcaagtgcagagccaccgtcttcggcggagacttccttgccttcctcccactgcggcagctgggcgacgcgccagttgccggcctgatcgggggcgccggtcatgaggttgatcggcatccaagcgccgatggtcagggaggcgagggtgccatcgttgagctcgcggttccaatcgtcggaccagttcggggtcttggcgtccacgaggtcttcgtcgatgagcttctggacgaattggatatagcgctgcatgccctcgtccttggtcatgttgatggtgatgttctcgccatcgaccttccacggctgggcaccggcctgccagatctgggcggtgaacggctgatagtcgttggaggtaccggccagattggtgatgtaggagccggtggcacggatcttcttggcggcctcgtagtagtcgttccaggtcttgatggactcgccgtccacgccggccttgtcgaacactgccttgttgtagaagaacatttcggggccggaatcaatcggcagagcgtacggcttgttgttgtactggagcttgttccacgggccggcggcgaagtcgtcggcgagtttgtcggcgccgaattcgctcaggtccacgaggccatcggtgacggcgaactgggtgacggtcggatcttcgagcatcacgacgtcaggggcgccgttgcctgcggcgatggcgttggagagcgcggtggaggtcttctcggcggtgccggtgttgttgaacttgacggtgatgccggggttggccttctcgaagtcagcgaggatttccttcatcgagttgccggaatcccagccccagaacacgagttcggccttgtcagcgtcacccttgttggcgccgttgtcgttgctgctgccgcaggcggcgagaccgacgagcgtggccacggctgccgttgccgcgatgaccttcttggtgttgcgcatgttatctccttctggaccattggagttgacttgcgggtggttggctttcttccgactggcttccggttttcgtccggttacttctcggttatcttccggctgtctttggctgccttccgattgttgacgactgccttccgattgccaaaaacgaatcgactgctgcgttggatttcaattcgtttggccgcttgcgaagtctcctctggccacctttccttggggtgttttctttggtacacccgtgtaccaatacctaagatgatacacctgtgtaccaatttgtcaaatcacccgacacgcctgatttttttcgccttttccatgctttccacgtgagcaaatctccagtcgaacagcgacttgtctcagaggctcttcatcccctcccccaacgtgagtaggtcccgactctcagcacaccaccaaataacgcgcagcatgctcgtgagtccccaacacccacacaccacggcgcgattccaccactcagccgcctcaccagtgcccacatttgtagatattcaacgccatatgacaagaatctgactagtatgaacaggcacccccccatagctgtattgagaggaaaagcacatggcgggcctgtttcaagctgcttccaagcagcgcaatcccttgggaacaaccatacgtactcacggatcgggcaaatatacgttcggtctggccttaagcgccggtcaatatccgcggtctgcttgccttttcctatcagctcctcgcggtatgcggcatcttcctgaccaatgtcatcaactacatcatcgcctcctacggttccagaagctgggatgtcaacgccggttggcgttggatgctgaggctgggtgcgattccggccgccgcgttcctgctctccatggtgcgagcaccggaaagcccacgattcctcattcaagccggcaaaaccgaagagggattcgcggtgctcgagcacatcatcggcaccgaacaggcacgccttcgcactgacgacatccatgcatcggtcaaactcgaaaccgaaatgtcgcatgaatttcacgacctgttccgcccagggctgcagaaggcgctcatcatcggcactttgatcaaggcgtgaatgctgcgttgcgttactgcattgccatgttgccgcgttattgcatcgctacgttgccacgttgtcgcgttattgcatcgctacgttgccacgttgccgcatcacattgcattgccgcattgctgcgttgccgcatcacatatcgcaacacaaacgcagcaacgcaatgacgaccggagatggcatcgccgccacccgcgaggaaccgcagtgcaacgcggtaacgtaacgcaatgcgatgtgattcccgcgtagttacaggcagttacagattgagtaccgcatcagcaatgcgcatggcggattcgcggtgggagaccagcaccacagccgcgccgcgctccttgtctgcatgctgctcacccacggccatagcgtgaatggaacgtagaataatagcctcgttcaaagcatccaaacggctggtcggctcgtcgaaaagcaccagatcagcattgcgcaggaacacacgagccaaaccgatacgctggcgttcaccttcggatagacggtcgcccaactcgcctacctgagtatcaaggccatcgggcagggaatcaatgagatcaagcacggaggccttggcgagagcctgacgcaaacgagcatcgagaccgtcagctgctgccacccgaacggcatcgccctctgccgattgcgccgccaactgctgctgtcgggaatcaacggtcttggcacccacttccccattgcctgcaacatttgcagcttcaacctcggactcaggcaaagcaatcagcagattgtctcggatagagccatcaaacaggtgggtttcctggctcatcatggcctgaatacgtcggcgagcatgcacatcgacctcgggcaacggcgtgccggacaacgtcacctgaccgcgctgcggatcccagtagcgcagcagcagcttgagcatggtggacttgcctcggccggacggcccctggatacccagcacgccatgctgcggcacgtcaagcgagaagtcggacaggacttcgcgctcccccgcatatgcaaaggtgacgtcatcaagacgcatgcccatatactcctgcggcacaacagtgccgttctcggtcacagcgggcacctcgtccatcagtccgaacagtcggctagcggacgcgaaggtctgagtcaggttagcgggcaaggcggcgagcgccaaagtcggtccgaacgagccggcgaacagcacgaaggcggcaatcagagccggaatgctctgcgggttcgcgccggcacaggcaatagccacggcgaccgaagccgctgtgagcacagccaccaagagtccgctgattccggtgaaacggccgttgaccttgctgagtttggcgtgatccttccacaacgcatgggtacggtcctcgatggtctgcgcacgttcctcgccgcggccaaatcggatgatttcgtccaggccgcgcatgtcatcgagtatcacatcgtcgagttctccggcagcgccacggatggcagggccaaggttacgtacgccggtggcaaagaatcgcggcacaaggatgccgataaccaggtgggcggcaatcaacgccagcgccatccatgggcttagggtggcggccacaatcgtgtagatgatggtggaggttaccgcgatggccaccggactgatggtatgggcaaagaagatctcaagcagttccacatcggtggtcagcatggcgataaggttgcccttacctttgcccgcgagcttggccggcgccagtctgcgcaacgcggcgaacgccttggaacggaagagtgcgagcagatggaatgccacattgtggttcagatattgttcaatgtatcgggtgatgccacgcagaagagcacagataatcatcatgatgacggcgggcgcaacacccatgccccacaccggattaccggtaagtgcaaatgccgcgataatgccgaacacgggcaggaaagtggccgaaagatggccgatggtgccggcggtggaggccgctgccatcagtcctgccagaggtcgggcttccttaagcagtcgcctgatcacttggaatgtgctcattttggaagacgaatcgctatttgcaacaccagccggagtctcagccgaggcctgctcactcccgccaacggaagccgtcggcaaagctgactgcaggcggtcaaccgtcatacccgcctctgcgcttacgcgcgctgcgccaccctcagtccgactgtcgtcggacagctcctgcttgcgggaaccaacctgcagcacacgccgagcatggccttctccgaagttctcaatatctgcctgcgtggtaaacagcttggcgtagacgccgtccgccgtcatcagctcggtatgggtgcccctctcaaccgacttgccgtgttcgagcaccaccacttgatcagcgtgttcggcgttggccatgcgatgggtgatcataataaccgtcttgccgcgggattgcgccaattcgcgaattgtatccaggatcagctcttcggattccatgtcaacgctgctggtcgcctcatcgaacacaaataccggcgaatcatgcaggagcgcgcgggcgatggcgatgcgctggcgttggccgccggacaggttggcggcatcggactcaatcggcatgcccagtccgttcggctgtgcgtgcacgaagtcggcaatgcgcgcctgctcgagcgcggaccacagacgggagtccacggaatccggcgaatcaggaatctcgtcatcgggcaaggccatcagaagattctcgcgcaatgcgcccgcaaacagatggctgctggcaccaatcacagtgacggctccggccagtgtttcgcctgacaaatcggatacctcgacaccgttcagcgtgagcgaacctcggtaaccggccagtgtaccggcgagcagcgaggcggccgtggacttgccggaaccggagatgccaacaatggcggtgaactgaccgggccgtgcggcgaaggtgatgttggtgagcgcaggagcgacggcggaattggggctggtttcaccttgcttatcggtctttgcggatgcggacttggagtcgccgtgcccggcatcatcataggaatagccgacgtggtcgaagcggaccgtcagaccgtcgtcagcggaatcggaatcgttggccggcagggtcgccgtgccatgctcgggctccggggtgtccagcagagcgaagatgcgcttggtggaggtcatgccgttcatcgccacgtggaagaacgagccaagctgacgcatgggaataaagaattcggcggacagcagcacaatgaacagcagaccggtaagagacagcgggtagcccaccccgaacgggatgagatagtgcaggccgtatgccgcgtaggcaagcacaccaggcagatgtgaggccagtgcgattggcgaccagccggacgcaccattggcaaaagcatcgccaatatgcgcgtattgccataacgccacaccgatgccggccgcagcaccgccgtaggccactatgtccatggcggtcagcgagcgcagctggatctgcagcacgcgcatggtcatgacgcggaagccttcggctttcttgtccatctcgatggcggcgcgctcgtcggcgtcgaagtttttcagggtctcaaggccttggagattgtcgaggaacgcggcgcccatatcggtgtagcgcacccagtacttcttgaaggcgcgggcggcggtcatggagacgatgccggtcacgatgatgatgaacggcgcgcagaccagcatgacggcagcggcgggcacgttaatcggcgcaatggccacgaacaaggtgattggcgcaagaatcgcatagaagagctgcggcaggaacagttcaaagaagctttgaatctgttcaacaccttcgccggcggattgcaccacatccgaggtcttgatgcgggttttgtaggacgggccgagtgccaccattttgcggtacagcttggagcgcaaagcgagcttgactcgttcggcggcttcggtgccgagacgggtggcgtgcgtggtggccgtgtaacggaccgctatacagaccagcgcaagcagcacgtaaatcatgacgtcgccagccatgggcagcacatccgcgccgtgccgatcagacaacggcacggggcaggccgcgccttgcgaagtgccgccgcattggagcagcggcggtgccacagcggtcagtaagctgttcagcagcattaccagcgacagcataaaaccaatgttggcaagcagacctacccacatcagggccactttgccagctatgagttttttcaagccaggcgccaattggaacagtcgtttgtcgaacatggtccgcttccccttgccgtgttgttgcggtgtgccctcgtcatgtgtacctgcgctccacattccgcgcaatcccattcaccttaagcgaacgccctcgcacacgccagacttttaaagtgagagaggccacagaattatcgattgcggagtgcgcatgctagacgcgccaaccaaaaaaatatgcttcgatatcaggggctgaagcatccactacacccaatacgtgcatttatccgtttcgaggaggctcatttttgcgtttgccggaggcctacttccgtttcaaggggctgatttcgcatttgccggaagtctatctccgcttcgaggggctcctcatccatgtaatcggaagtataaacggctacacgtcaacgtcattccgccgttttagggccgtgtctacttgggcatcagcccctcgaagtggaagtagacttccagataaggcaaaatcagcccctcgaagccgagaaagcacgtttctacggtgtcagaagccgacggaacgcaaaagggtcgtctgcacgcagacgacccatatgatcaattcgccaatagacgcagcaaacgcggcctagtgctgctttttgcgcggcgaccagtgcttcggcggcggccgtacttatcggacaggaagccggagaagccggcgccgatcacgccgccgatcatgatggagctgatgaccagaccctgcagggccgggctcagcgcgtacttgtcctgcaggaagtcgatggctcccgaaatggacacggtcataaccgtagagcaaaccggttagacacggcgttgtatacaatccacaaaaccagacagacaacttctccattgcccacaacgcgcgcaaccttacgccagcgtaacctaacttgtcagaatggctcgattttgtcaacagccatcacgcaacgcacgtaaggacacggcccgcttatgcttgaccactacaccacgcctggcgaatccatcgaaatccgcgacaaccagaccatctactccctacttaccgatcgccttgcccgcaccggcgcggacacggtaatcgccgccaagaaaatcggccccggccgctggcagaacgtcaccaccggcgaattccacgagcgcgtggtctcggccgccaagggcctgatcgcgctcggcatcgccaagggcgacgcggtgaccatcttttcctccacccgtctggaatggggcattctcgatttcgcactggccgcggtgggcgcggtaagcgtgccgatctatgacaccgactccgccccgcaggcccagcgcatcatgaacgattcggtggtcaagctggcctttgccgacaatcgcgagcgcttcgaccggctcgactcggtcaaggaccactgccctgccttgaagcagattctcatgctcgagggcaacgcactgggcgcgctcgaaggtctgggcgtggctgtttcggacgaggaactgaacgagcgcgtggccaccgtgcgcgccgacgatctggccaccatcgtctacacctcgggctccaccggcaacccgaagggtgccgaactgacccataagaacttcgtgtccatcaccatcaccgcttcgcaggcgcttcatgaagtggtgcttgacgaccatccacgcctgctgctcttcctgccgctggcccactgcttcgcacgattcatccagtacgcctccatcgcctccgatgacggcgtggtcggctatctgccggacaccaaaaccctgctgccggacctgcgttcgtttgaaccgacctacctgctgggcgtgccgcgcgtgttcgagaaggtgtacaacgccgcctcgcataaggccggtgccggctggaagggccgcctgtttgtcaaagccgccgaggccgcgcgcgtctggagccgcaaggagcaggccggcgagcagcacacatttgccgaaatcgccgagcgcgccaagtacgaaacgctcgtctaccgcacggtgcgcggcgctctgggcccgaagatcaagtacgtggcctgcggcggcgcaccgctgtcgcttgatctggcgcatttctacaacggcatcggtctgccgatgattcagggttacggcatgaccgaaaccgccgccccgttcgccgccacgcgcgtgaccgacaatgtgatcggcaccgtaggccagcccgcgcccggctcctcgattcgcatttccgacgaaggcgaactgcaggtcaagggcccgaacgtgttccgcggctaccacaatctgccggagaagacggccgaggcattcaccgccgacggctggctcaggaccggcgacttggccgagatcgatgacgccggccgcatcatcatcaccggtcgaatcaaggacattattattaccgccggcggcaagaacgtctcccccattccactggaggaggagattgccaagtgcccgattgtggagcattgcgtggtggtgggcgatcagcgcccgttcatcggcgcgctggtgacgctcgacccggagtcgctggcattgtggctgcccgcgcatggactgtccacggagacgccggtggaccggctcgccacgaacgcggcggtgcgcgaggagattcagcagtacgtggacaaggcgaatgcgacggtctcgcgcgccgaatccgtacgcaagttcgccgtgctggacacgcagttcacgcaggagaacaagtgcctgacaccgtcgctgaaagtggtgcgcccggccgtcaatcgcgtgttcgccgatgtgatcgacaacgagatctacaacggcaagcggtgagacgcgcggttcgtaatccgacacaaaaaaagggccttttgaaccgcaccccgattgttggactggagtaatccagattcgatgatcggaggtgcggtttctcatgtccagggatcgcaggcgtcattatgacgatgattccatgcgggtcgtcgccggggtgccgcccggcccaggtgggtcatgcccgggtcagtttcttgctcctgagacgcagcacgacatcggcggagttggcgacgcgcttggaatgcgtcaccacgatcacgcatttgccgagctgatgggcggcgtgctgcagcagatgaatcacctcgtcggtcatctccgggtcgaggctgcccgtcggctcgtccgcgaggatcgcgcggcccggggcgaccagcgcgcggccgaccgccacccgttgacgctggccgcccgacaggtgcatgatgttgcgcttggattcctcacggctcaaacccagttcctcgaggatcttcatatcggccttggcgctgaccagccgcaggttctcttcgggggtgaggtagtcgatcaggttatggtcctggaacaccagggacacgtgctcccggcggtgcttcgcatagcccgatgcggcgatgtcctccccttcgaagcggaccactccccgggagggggcgtccaggccggccagcagcgacagcagcgtgctcttgccggcgccggacgggccggtgatcgcatacatcttcccggattcgaaatccgcgctgacatccgaaagaacacggatcttcgccgcgccgtaggcgtaatcgacatggtccagttgcagacagttagacatgattggtgactcctaacgcatagaggaaagaatggatttcggggatttggacagcacggcggcgcatgacacggcaagagccacggcgatgaccgcgcatccgagcagcaggatgagcatcgtctgctcaggcggcaaggcctccacgtgcaacgattccaacggcgcgacgcccgaatcgcgcaacagtcgggaagacacgtatcccgacagcatggcgccggtgcccagcgaacacagggcggcgaccgccgccatgagtccggtttcgatggcgagttgtgcgacgatccgcatcttgtcgatgccgagggccagaagcgtgcctatctcatggatgcgtgagcgaatccagaagaccagcgccatcgccagcaccagtacgtccgcgaggcagacggacagcagcaccatgcgcaccagattacgcaccgtctgcacggattgcaggacgccggagagccgggccgaatcgtcggtgacgtcgtacttgccgccggccatggtcttggcccgtccaatagccgcggacaggtcctgcggattatccgacaggcatcggatcatgtcgatccggtcgtttccggtcagagcggaagctactcgcctacccgaatagatgaggttctcggaagtgtccgagggcagggggctttgggcctgcacgttgccggagaagatcccggccacacgcaccgtggcgttgcgcccctcctgccggagacggaatgtcgagccgaccgataggccgttctgcatcgcgaagtcgcggtggaccagcacattgtcgccgtcgcccgagatatggcggccctgctccaggcggtacaggccgctctggaattcctcggacaatgaggaatcggtggtgcccagcacgctgacctgcatggccagatcggagtccaatcgggggccctgccggggcatgaccgggcgcgcgccatccacctgcgccaaggtcttcgtcgcataggcggtcttcgtcacaccggggatacgcgagaaccggctcgcctcctcggcgctaatgggattctcgccggcgctgacggtaaaccctatgcccatgcccgcgccgatgccgtcggacatggtacgcagggccgtcgagactccgacctgcgccaccaggctcgtgaagaccatcagcatcagcagaccgatgatgccgctacgtaccggcttgcgtacgatcgccaacgtggcacgcttccacacattcatgctcatcatcgaatctccgacaggtctcgcggcgatttgcgcagcatcggcatgcacgccaccgcgacgcacaccagcatcaccgccaacaatccgagcgccacgtacagcatggcggtcccgtcgaccgacaccgtgagcgaatccagggtgcgcaccgacatgctggattcaagatcgccgccgacctgccccatgctgctcagctccttcgccgcggaggcgttcacggaatggagcgccgtggcgccgagccattgggccattccctgcgcgcacagccagccgagggcgagggacggcagaccgatcagcaccatctcggtgaggtattgggcgaccagggagggcttgccgacgccaagggacaccagtatgcccatctcttgacggcggtcgttcatccacagcagcagcatgagactgagcacgagcacggccgagacggtcacgccgatcagggcgccgcgcatcatggagcgcacgccgcgggcggcatgcagcatgctcgatgaatactggtcgttgcgcgtgatctgatagttgttccaatccaccgggagtttcttcgcggcatccatggtcttctccacgtcaacgcccttggacagcacgaaggtggcgtcctggtatatttccttgccgtccttgtactggtacaggtcgcgtgtggtatccagatcggtgtagatggtgttggcggtgagttccgctcggctggatacctttctggcgctgtcgcccttgaatatgcccacgatggtggtcttgacggtcgccgtcgaatgtgattcgttgtcggcgtcataggcgttggccttgagcgtgagcgtgtctccgactttgagcccgttggctttggcgagatcctcatggatcatcgacgtgtacttgtcggaggccttcagatgtcgtccttcggccatgccgagcgtgcgcgacgtgaacacgttgagtttcgacgaatcattcgtgcccatgacgttggcggcgttgccaaactgctgctcctgggtcgcatcgtaatcatcgccgccggggaccttcgccacattcgcccccacgagatcggcggtggcgttctgacggaccatatacgaatcgaccccgggcagttgggcgatcctgcgcacgtcggcggggcgcaccatgccgcctccgcgaggcgtgagcatgctgccctgcatgttgctggacagcacgaatccaccgaccgcttccttctcgattcgtccggcggcctgttgagctgcccgagaaaccgcgatcgtggatagcatgctcgccgttatgatggtcagtattataaggagcactatggttcgcactcgttttctgagcacatagcgcaccgaccgtgcaacgaacgtcatcaatacctcctgtgggacttgggcttttcgcccaaaatgcgaaacatgccgcgtttcgccgattagttagccgcgacgatacatgatgcacctcaagatacgggagatatacgccttgagcgaaaaacggaacagcggcgaatgtcggttattctggattttggtccatctcgggccgcgtcgatgcgtcggcccgcgagaaatcaggctcgcgcctcaccttcgaggcggcgaacacaagaagcggcagagcggcgaacgcatagttctcgcattggatgtacaggtatgcgaccaggacgagccagcagatgacggtcttgtgccagacgccggattcgcccgaacccgcgccggcaacgccaccaccactattacccccggcaacatcagcaacgtcggcaacgtcggcgacacaaacaccgtgcgccagctcgtcggacgatgcgccatccgcaccgccacggcataccgtcctcccgcgcgtcatgcagaccatcgaggctccgaccagcatggccagcccgatcagcccgtattcggcgatgacgctggtatacgcgcacatcgtccacaccgtgtccgcgttcacgccggccgcgaatcccgtggccgcgccgccgttcatgccaagaccgcccagcagccgtccggctttggccgcgccggcccacaccgcattgatgatgttgcccgcgccataaccggtgagcagcgtccacggatgggtgagcaatccgcatatcggatcgaggctttggtagatccgcgcgaagaacgagccgtctccctcggccccgttttccgcgatggcggagagtctggaatccgccagcacacccagcaggcccagtgcgcatgcgccgagaatctgcagcatgccccggacgcggcgtgcgccgtcatgccaatcggtgcgcgccacaagggcgatcagcaacgccacgacggaatcgatgacgattctggtgccggcttgcatgagcaccgcgccgacggcatacgtgacgatgaggtcacgcagccgtttggcgtagatgcggtcgcgcccgcgcatgagccacatgagcggaagcagtatgccgaacaggtgcatgccgatatagctgggctcggcgaacaggaactgcggacggccgccgccccacaccgagttgtcgctgatgtattgccggtacatgaggtgcgagaaatagtcggtcaacggtttggcgtgcagacggatggacagccattgcacgacgcccactccgaaggaaacccagtatgatgcgatgagaatccgcaatggcgtacgccacggaatgcgtttgatgtcgaacgcaagggcgatcgcccccaaagtggcgagcacgcccagcaatccggtgatgctcatgaacgcggcgttgaggtggatgccgaacttcagccatcccgggatggacaggattatgcaggccaccggtaggaggaacattggcaggtaccggttggctgcgatgcgcagttgccgccaattgcataggcagtacacggcgaacagcgccggactgattggcgaccagaacggcgcgtacaggccaagcgtggtgccgtccaccggaagaaaagcgatggccagcaacagccaaatgacgttgcgttcctgcgatgtcagaaatcgcaggaacgaccggtattgcggtcggccatgatggttgcccgcgtcgatggtgtcgttgcgtacgcatgcctggttcatgtgattctccctccccgccaaccttactcgttcatcatgatgcgcggacgggtcatgctttccccgctgaaagtgcaatggcccgaacattgacaaggtcacaccgaatgcccccatcattggcacattgtgcgatctcgtcgcggctggctgacgaaataatgttggccgaccggttacattggttcggtacagtggcggcattatcggccactgaatcaagcgattcgcggcagaacgacgaaaacaacacctgggcgaaaagaggcaggcatgactacgaatcgaccgctcattgcggtgactccgctgatggattacgggcgcgatagtctgtggatgctgcccggatatatggaggcgataatgcgggccggcggtacgcccgtcatgttgccgctgaccgatgacaccgacattcttgcgcaatgcgccgaacggtttgacgcgtttctgtttacgggcgggccggatgtgggaccgatggttggtgcagcggcctccgccaccggccgtagcgaggtgctctctcctgagcgcgaccgaatggaatcgattctgttgccagctgtaatggcttgggacaagccgattctgggcatctgccgtggcattcagttcatcaacgcagcgctgcgcggcacgttgtggcaggatctgccaagccagcatccgagcgatatcgaacaccatatgaatccgccgtacgatgcgttcggacataacgtttccttggtgcccggcactcccttggcttcattgttcgcagggcagactgagattgcggtgaatagctatcaccatcaggcggttcgtgagcctgctgctggactcgaggtcatggccgtcgcgcccgacggcgtgatcgaggccctgtaccggccggcaagccacttcctgtgggccgtgcagtggcatcccgagtttctctacaaggtagatccacgctcgcaggcgatttttgatgcgtttgtggggagttgccgataacagcaaaaggggctgctccggtttcccggaacagccctttttcaacggtagcagtcagcagattgatttagtcatcagtgctggcttgccagcgctgattggcgcgtgcggagaccgccgtccgaaggcgaaggcgtacgaaggtacgtcgaacctgaggaaaggcggtatacgctccgccaatcagtgctggttgttgagacggtggtacatctcggacagctccagttccttctcgaactggcgagcggtggtgttctcgtcgatgacggcgagctcaacaccggcgatgcgggcgaagtcttcccaagcctcacgaccaacggaggtggtcatgcaggtgtggtgagaaccaccggcggtgatccagcactcaacagcggtcttcaggctcggcttcggctcccagacggcgcgggcgcacggaagctccttgagggagccctgcggctcaacgacgtcgacgacgtccatgagcaggcggaagcgttcgcgaacgtcggacatggagatcacgacggcgtccttggtgggcttgccggagaagaccaggcggaccgggtcggccttgccgccgatacccagcgggtgaatctccagcttcggcttggcgatggtgccgatggacggggaaacctcgagcatgtgggagcccatgtcgagctcgtcgccctcggtgaagttgtaggagtagtcctccatgagggaggcgccaccctcaaggccgtagcccatgacggcgccgatgcgcacgaggacggcggtcttccagtcgccttcagcggagaagccccagccgtactcggacgggaagcgctgcgggccaacgcccggcagctgcggcagagcgccgaggtcctcgaagttgtcgacgccggcggtgcagccgttggcgcgcatcatgttgaccatcgcggcctcttccttggcggcgatgaacagggagtcgtacttggcgtccagcagagccgggtcgacgtcgtacttggccttgtagtcctcgatgatctccttgacctggtcgtccttgacggcgtcgtacgcagcgacgagctcgttgacggcccaagtgttgatggaggcgccgaacacgcgctcggcctcggtcttgtcgccctcggtgacggcgacgttacgcatgttgtcgccccagcgcatgaccttcatgttgttggaggcatcccagccggcgcaggcgcgggcccaggtgccgaccttctcgacgacctcaggatcggtgtagtggccgacgacaaccttgcgcttgatgccgaggcgggagacgatgtaaccgaactcacggtcgccgtgggcggcctggttcagattcatgaagtccatgtcgatggtctcccacgggatttccttgtggtgctgggtggccagctgcagcagcggcttggtcagcacttcgaggccgcgaatccacatcttggccggggagaaggtgtggcaccaggtgatgacgccgatgacgttcgggttggcggaagcctcgaccatgaactccttgacaccgtcggaggacttcagggtgggcttgaggacgatcttggccggaatcttgccggtgttgttcaggtagtcgaccatttcagcggagtgaatggcgacctggcgcagggcttcttcgccgtacaggtcctgcgaaccaacgccgaaccagatttccttgccctcgaaggggttttccataaccatagggttacttcctttacttctttgtttatgggggtttgtttaagtttcattcgccgaccgaggctcccctcagtcagctatcgctgacagctcccctcagagaggggagccaagacaccaccgtgctggcggagtcagcgctgatttgatgtgtgtgtccgcaaggcgcggaaggcgaaggcgtacgaaggtacgtcgagccttccgtaacgcggcggacactccatcaaatcagtgctggccgtagacgttctggtagcggtcgttgagcttatcgatgtcggcctggtcgatctcgatgatgtcaccgagctgacgggcggcccacatggtgtgagcgacttcctcggtcatggcagcggccttgacggcgccttcagcatccttgccgatggtgaaggggccatggttctgcatgaggacggccggggacttcgggtacttcttgagggtctcgacgacaccctcgccgatcgcctcggagccgatcagacggaacgggccgaccggcaccgggccgccgaactcgtcgcccatcatcgtcaggccgcacgggatgttctgaccagtggcagcccaagcggtggcgtaggtggagtgggtgtgcacgacaccgtagacgtcgggcatgttgcggtagatgtaggcgtgggaagcggtgtccgaggacggggcttcggtgccgtcgaccacgttgccgtcaaggtcgcacacgaccatggaggacggggtcaggtactcgtagcgcaggccggagggcttgatgacgaacaggtcggcggtgtgcagacgctgggaaacgttgcccgcggtccacacgaccaggttccacttgatcagctgctggtgcaggttggagacgacctcacgaacctgcttgacctcggcgcgaacctcggggccgtaatcagccaaagttgccattattggttttcctttccactgtgatggatggacgttttttcaaaatctcaaggacctccctcaatagagggaggtcagaaaggcttacttatcttcgaggttgatggtttcgatggcggcgtgctcgatgggcaggcccttggtgaagcgggcgaagaagtcctcgaaaccaaccacatcggaagccaccggcttctccgtggtggactgggcgtccttgaacacgcaaccgtcaaggaagtcagcgaggttgctgtgatcttcgttggtgttccacaggtagttggcgagcacggccataccccaggcgccaccttcggcggcggtggacatgaccttgatcggggtgttgaaggcagcagcgagaatcttctgagccaccttcggagtggcgaagatgccgccgtggcccacgagagagtcgacctgcacgcgctcctgcttggtcatcacgtccatgccgatcttgaccggggagaacgcggagaacagctgggcgcgcatgaagttgccgagggtcatgttggcctcggggctgcgggcgaacagcgggcgaccttcaggcagaccggccaggaattcgccggaacggaacgggtagttcagcaggccgccgcagttggcgtccacgtcgtcggcgatggccgcgcggaacagggtgccgtacagcataccggcgtcaaccggctggccgatggccttggcgaactggccgaacaggccgacccaagcgttgaggtcggaggtgaagttgttggcgtggctcataccggccagatcgccggccggggtggtgaccaagtcaacctcagggtggagggccttgagcttatgctccagaaccaccatggcgaagatggaggtgccggcggagacgttaccagtgcgtacgcgcacggagttggtggctaccatgccagtaccggcgtcgccctcaggcggggcaagcacgatgccgggcttcagggcgccggacggatcgagcagcttggcgccttcctcggtcagctcgccagccggagtgccggccacaagcggctcaggaagcaggttctccagcttccacggctgggctgcgacctcaggcagagcgtcgaacttctcaatgaatgcggtttcgtaagtgtgagtggtcgggtcaatcgggaacatgccggaggcatcgcccacgccgaggaccttcttaccggtgagcttccagtgcacgtaaccggcgagtgtggtgaagtaggccaccttggagacgtgctcttccttgttgagcacggcctggtacaggtgggcgatggaccaacgctcggggatgttgtactggaacagctcggagagcttcttgtgagcttcggaggtgttggtgttctgccaggtgcggaacggcaccagcagttcgccggcctcgtcgaatgcgaggtaaccgtgcatcatggcggagaagccgatgtggccgacgtgcgtgagcttctcgccataggcggtctcgacgtcgttggccatggaggcgtaagcggactgcaaaccgccccagatctcctcggtggtgtagctccacagaccatcttccagatgggaagcccagctgtagtcgccggaggcgatggtctggaagttgtcgtcgatgaggacggccttgatgcgggtggagccgaattcgatgcccagcgtggtcttgccagcgcgaatcttctcggcgatgtgggcgacctgctcggccgcgttgtcggttgctgccatatctttcctttgccttggagcgccggcgttgttatccccttccttggggagggtgttagcgctcacaatttccaaaaaacattgtaccgacaacctgcattcgacacaacttataccgtgtcacgcatcataacggtttgataacagcgccaatttaccgccgaggagccggtcccaaggaccgccgagcacgcacctcggcgggaatcagccccatgccgtgctgggtggtcaggaaggtcggctcgccgccctcccccagcaagcgcagcgtctcgcgcatggcggccacgccgagcccctcgaaatcgggatgcacggtggtcagcggtgggtacatgttatccacgccagacatgtcgtcgaatccgaccacgctgatgtcttgcggaatccgaagcccatgctcatgcaacgcgcgcatgatgccgacggcctgattgtcgttcgcggcgacgaccgcggtgggcaacgccgcgcctcgacgcccatactcatcaatgagatgattcatgtgcgcatatgcctcagaggcatcccacgtatggcagcgcacgatctgtgaatcgatggatcgggaggcggcgagcttgcgccacgcatccagtcgggtgtgggcgtcgcgccattcgttgggaccggcaaaatacagagccgatttgtgcccgtattcgcccagcaaggccaccactttggccattgcaccccactggtcgataccgaccagcgcagtgcgacgcttgttttcggtggagataaggcccaatccctcacgcacggtcatttggccgtgggtggcggtgacgatgacgcgcggctgagtgactcgtgcacggcaggcggcggcgaacatcacgtcggtcggggtcaggaagatgaaggcgtcgacgttctgctcgttgaaggtgtcgcacaggttgtcgaagtcggcctgcgcgcacaaggcctcgtggaccatcatcacgctcatgaacagaccgtgctcgcgggccatggattcgatggaggagatggaggaaatcgggccgaagaatttgaggcctccggcgatcagccctatggtgcgcgaacggcgggaagccagtgcgcgcgcggagttggaggggcggtagccgagttggtcaatggcggcctggactcgcgcacgggtggcgtcggaaacgtccggcgagtcattgatcacacgggagacggtttggtggctgactccggcgagcttggccacttcgaacatggacggacgtttgcttggcttgcggctggtcaccatgctacctaacctccccgctggcggccggcatccgtgcacggccaggcttgtaccttaatcaatactgactttagcgcgtccacaacagttttgcgttagcgctcacactgtcgtgtcgcacgcggctcaggtcaggtgccatgagacacgatggagcggagtcggcccgtgttcggcgatggcggcacggtgtgcggcggaaccatagcccttgttatgagcccattcgtaggcggcgtaacgtgggttgctttgcgcgaggtcgaccatcagccggtctcgggtcactttggcgatgaccgccgcggtggcgacggtggcgcaatgctggtcgcctttgactttggtcgttatgtcggctggaatcggcacgtccggcgcgtcgaacgtgttgagcgccttggtgatgtaatcgctcggcccgtcgagaattccggcgactttgggcagggcgcgaacgcttcccccgcaatttccaatggattcccctacggagcctcccggacgaccttccacaatctcccccgcagactcccccgaagccttttttatcgtcgattcccctccaagccgtaagccaagttcgcgttcgacttggctgagcgcgcgcagggcggccacgccaagcgcgtaggtgatgccccattcgtcgatctcggcgttgctggcctggcctacggcgtaggccgcgcaccagtcgcgcagttcgtcgaaaatcgcctcgcgcctatgttcggtgagcattttggagtcggccacgccgtccggcacgccgaggtaggtccgcccggacagttcggcggaatcatcgccgtcaagcggcgccaaatcacaggcccagatggcggcgcacccgaccatcaccggaccggcgagcgcgccgcggccgacttcatcgaatccagtaataaggtcatagccctgggccgcaaggctgcgttccaagtcaagtgtcggggtaatcatgcgcggctcccatcgtctcacaatggttaggattcagacggtccaggttcaaatggttcaggattcagacggcccggaactcaatcagttcaaagactcacacggttcaaaaaaagactcaggaattcgagccggaagcgtcaggcacgtccttgaagacttcgtggtggtcatcaatcgcaccaagccggtcaagcggccagtatttcgcgattccgactccgaccacatcggagatgggaaccaagccgcgatcgccgtcatcctgatgatagcgggagtcggcggaattggcgcgattgtcgcccatgacgaacacgcggccctcggtcacggttaccgagaacgggaaggcgctcgggtccacgccggggcgaatgtaggaggtctcattgatggccacgccgttgatggtcaccggctggcccgcgcccttgcattcgaccacgtcaccgggcaggccgatcagtcgcttgatgaggtacccgccaccgggagcgctgctctgctcctcgttcaaccagttgttgggatctttgaataccacgacgtcgccgcgctgcaaatcgaagatcttgggggtgagcttgctggtcaccacgcgatcgccgggcaccatggtgtccatcatcgagcgcgaaggaatctcgtaaaagccgacggcgaaaatgcgaatcagcagcacgataagcacgggaacgccgcaccacaggaaaaagtcgcgtagggtgaagtggtcatcatccatcgatgatgctgccgcggcattcgcaccagcggaagaagcggcgtgcgccgggcgcgccggtgccgggggaaccggggacggggcgatgccgtggtcggcgacttggaacgtacgggaatcgcgggcatcggcctcgtcatcatacgaggtctgattgctctccggattgtcggaaaccgggaattcgccgttatcctgatcgtcctgcataccatctcctcgcgattcatgctgccggatatgaggggtgccggcgcccgtccatcatacgtggaaaatacggaaacagcccgaaaccgaaacggttccgggctgaatttcacggtttattcgcgcacctgcatcatcaggcccacgattgcacccgcgaatcgactcacttagcggagttgtcgcggcgctcggcaatacgagcggccttaccgcgcagagcgcgcaggtagtacagcttggcgcggcgcacacggcccttacgcacgagcttgatggagtcgatggacggggagtgcaccgggaagcgacgctccacaccagtgccgaagctgatcttgcggaccacgaaggtctcacgcacgccagcgctcttacgagcgatcaccacgccggtgaaggtctggatacgggagttgttgccttcctggatcttcacgttcacgtcgacggtgtcgccgggacggaaggccgggatttcctcggccggcttcatgtgcttggcgtcaaaagcctcaacagcgttaaccattgttttccttcagtgctgccgcatatcagccacagatctggggccatccacgcgattgcgcatcgcgcgcgttgacctgttctcgttatccctcgagtttgcccttgggaagcctgccgatccgccaaaagccaggccttgcggccgttcggactggacccacggagacgcgggcttatgcggcggcccacttctcgacacagcaatcgattattgtacggattcttgcggacagtatcggcgtgtcgtcgtctctctccgttattaacgcatcagtttggccgaggcagcacggatggcggattcgaatactttccgtccctcctgctggtcgcatggataccgacgatggtattgatttggcgtttcagcgcacggcttgaagaaggtgagagtccgatggacggtgattattccagtagtttcgccgccggcaacagtcatagttgaggggggggagcatacggagcgttccataactccctctcagtcagcttcgctgacagctcccctcagtattgaggggagctagaaaagcgaatcagaattcgcgacgtgggcagtcgccagactgcccaccagacagcacagccgcggtcgcgcgaatcacgaattctgaccgagcaaagcgaatcagaactcgcggttcttgcggtagaacttgatcaggctctgggtggaggcgtcctgggcggcgagggcgtcgtcgtcctgggagatggccggggtgatctgcttggcaagctgcttgccgagctcgacgccccactgatcgtaggagtcgaggccccagacggtgccttcgacgaaggtgatgtgctcgtacagggcgatgagctcgccgactgcgaacggggtcagggccacgccgaagatggaggtggtcggacggttgccggtgaacacgcgggccgggacgatctcctccggggtgccttcggcgcgcacttcgtcggcggtcttaccgaacgccagggccttggtctgggcgaagtagttgcccaggaacagctcgtgcacgtcctggtcgccgtccttggtcgggttcggggtgttgacgaacgcgatgaagtcggccgggatgagctgggtgccctggtggatcagctggtagaaggcgtgctggccgttggtgcccggctcgccccagaagatctcgccggtctcggaggtgacgggggtgccgtcccaacgcacggacttgccgttggattccatggtcagctgctgcaggtaggccgggaagcggtgcaggtactggtcgtacggcagcacggcgtgggaggcgaccttgaagaagttgcggtaccagacgttcagcataccgagcagcaccacgacgttcttctcgaacggggtgttggcgaagtattcgtcgatctcgtggaagccgtgcaggaactcctcgaagcgggccgggccgaagacgacggccagagaggtgccgacggcggagtcgacggagtaacggccgccgacccagttccagaagccgaacgcgttgttcgggtcgatgccgaactcctcgaccttctccaggttggtggagacggcgacgaagtgcttcttgatggcttcggcgttcttctcgtcggagccgtcgatggcgccgttggcggtgagctcttcgagcagccaggtgcgggcttcgcgagcgttggtcagggtctccagggtggtgaaggtcttggagacgatgatgaacagggtggtctccgggtcgaggcccttggtcttctcggccaggtcgttcgggtcgatgttggagatgtagcgggcggagatgccagcgtcagcgtacggcttcagagcttcgtacaccatgacggggcccaggtcggagccgccgatgccgatgttgaccacggtctcgatcttgcggccggtcacaccggtccacttgccggaacgcacgtcgtcagcgaaagcgtagatcttgtcgagcacctcgcgcacgtccttgacggtgtcctgaccgtcaacgatgtacttgccctcgtcttcgaccgggcggcgcagcgcggtgtgcagcacggcgcggtcttcggtgttgttgatgtgcacgccggtgtacatagccttggtgcgctcatcgagcttgacggccttggcaaggttggcgaacagctggagggtttccggcttgatcaggttcttggacagatcgaagtgcaggtcgccggcgtcgaaggacagcttctcgacgcgctcggcgtcctcggcgaaccacttcttgaggctcacgccttcgacctgaagctcgtcatagtgcttctgcagggcagcccactcaggggtctgggtggcgtcaacgggcggattgatggccataggattccattcctttcatcagtgactggagcgcccttgcacacggctcggatgcgctccgtatcaccaaacagaatactcacaaattcggacatgaacagaacaaaatgagtcagcgatgtcggattgccatcgtttgcattatcgaacagttcacggcgcggcgcaaccgtcatcttcgactgagcggtcgcgacacaaccgccaatccgccgattggacttttcgtggggatgtcttatacttgacttcttgtgcgcggctggcgaaataccttccgcgaaccaagccactttagctcagtcggtagagcggctcactcgtaatgagcaggtcgtcagttcgattctgacaagtggctcggatgccctaggctggctggtctgtaatggctgtccggcctagggttttgcatatcttccacacctgtggaaacgcggatatgcacgcgcgagtggcggaattggtagacgcgcaggatttaggttcctgtgtctttgacgtgtgggttcaagtcccatctcgcgcaccggcttgagcctcttggaagcattggattgccaacgcttccgggaggcttttcgtatatgcgcgcggcagctgcaagcccttgcggacacctctacatatggcaatgccaaggcggcaaatataatgggccacagcattgcgggtctgagcctgtgcgccatgagcctgtgtgagtcaaggagagaagtgtatgtccgccattcttacgccggttggtctgttgctgatcatcctcgccggctatctgttcaagcggttcggcctgttcgggcagaaggattatcgcgtgctgcaaaccgcggaattcaacatcgtgctgcccggtgccatcgtatactcgttcgccaccaatccgcatgacatctcgctgctgcttatttcggtattcgcattcctgtttgcttttatcccggtcgtgttcatctttctggccacccgcaagcgcaatgtgaccgaccgcgccttcctgatgctcaacggtgccggcttcaatctcggctgtttttctttcccggtcgtccagtcattctggggtgcgggcgcggtggtgccggctgcgatgttcgatatcggcaactgcgtgatggtggccgccggcaccaatgtgctcacccagcaactgctgcatattcagcccggcaaaacacttgccgaacaacacgccggttcggctcccaccctaccgtacgaaaagcccaaggatcgcgacgccaaacggcttgcccgccgcgcattgctgcgcaccatcggcaagagcttcttcggctcggtgccgttcgacacgtatctgctcatgatcgtgttgaccgtcgccaacgtgaagattcccgattggatcgcctctataacccagccattgagcggcgccaacgcgctggtgtcgatgctgatggtgggcatgctcatggacctgccccaatccaagcatgacgtgaaggaagtcatggccgtcatcgcttggcgtataccgttcagcgtcgccttcgcgttgatcgcgtggttcctgctgccgttctcggcttcgattcgcgccgtgatggtgatctgcgcgttggctccgatcgccattttctccacgctgttcaccgacaaagtactcggcaacgccaaactggccggcttctcgctggcaatcaccgcgatgatttcactggtgatgatggctgtggctcacgcgctgatgggcgtgtgagcaaatgcgcaagtaggcacacggcgggtgcacggtcagacgagacgcagcccacataggttcgtcccccggccgccagctgctaccggcgcagcagcttgtgcgccagattgctcacgccgaagcggaacttatccaccggcaacgtgaatttgcctaccatctgctcgacgtagccgttaaagccctgcttgaattccagcacgccgcggccctcgtcgttcggatcgtcgaacacgccggaaatgccgtagaagttgtagcggctcacaccctgttccacacacaggtgcagcattgctccgtactgaatcagcgccgaggcgtagaacggcttgtactcctccaacgaaccggaatactgatagaccacctcattggggtgactgacgaacattgaagccgccgccggcagcacatcgcccttcctggcatatccctccacctcagccagacgcttgtcggcggccgcgagattgcgcgattcctcccccagctgacgttcgatgcgcgtggtcggacgttcatcgtatttcgcctgcaatcgagctaccttggcctgcaaggcctcgcgcttggcggtcatatccgccacatattcggcgatgtggatttccgcgagcatgaaatgcgcatctgcgccatacgcctgcttgaactggcggaaatagtccgcgccgcgcgtcgcgaacccgcggcgttcaccggtccgccgttcgatatcggcgaacacgtcgaactcgtcggggccgatttcgcgaacgtgcacgcccatcgactgcgcccgcttgacgctccattgagcgcgtttgccgaatgatgccagcagttccttgccgttggtgatgccggtgagatccttgacgtacatccactggcagaccacgtcataaccggtatggaatccgccatgcgtccagccggcatcggtgaatccggccagtagtgcatcgttcggctcgccgtcgggctgcccgttcgaggaatacagacggtaggcgacgttaggccagcatgccacggaaacagcatggtggcgacgggccgattcacgaatcgcctcggttatggcccgcagcagagccggatcatcgctaatgccgatggggccgaaatatacggagccatctgcaccgaaacgaccattgaggtacagaattacgcagccggttaccagattgccggatgcgtcgcacacgccaacgcattcggcttcatgcccacgaatcttggcaagacggacctgcccggaccattgctggaagctgccctggcttgtggcttcggaaagccggtcgagctcttcgggcgtaatcacgccaaacgtatacgtcgtatctgttcgattcgcagtcgcgctcatctcgtcgtcacctgtgccttatttctgtgtccgtgctcgccactgtttgtcagcgatgcagcagcttgtgcgctgcttcggatacaccgaagcgcagtccgtccaccggcagcgtgaacttgcccggaagctcttccacgaatccgccgaagcgagtcttgaactgccagacgccgtaggaaggatcgttggcgtcgaaaatgccggaaatgccgtagaagttgaagcgctccacgccacgggcgatgcagtcaagcatcgcctcgaagtggattagggaagacgggtagtaatccatgaaacgatcgtcctcgccgctggacaggcagacgacctcgttcggatgccagaagtagacgccggcttccaccggaatgaccgggccgtccgaagcgatgatgccattgacttcgccgatggtcttttccagcgccgcaatcttcttgtctgcggtggcgatgcgcttttccagcgttgccgggtcggaagcacccttcttggccgtgccttccggctgctgttgcgtgcgctggagcaggcgttcgaggttgcgcttgtctttggaggccgcattcagcttggattgcagggtgtccagatattcgtcgaaatgggtttcgaccaccttgaactcgatcaggtcgccgaaggtatcgaacagacgctcatagtaggccagatcgcggctcttgaagccttgacgtgcggcgctcatatcgcacagcttgacgaaagtgctcagttcgccgcgttccagtcggcgcacgcgcagaccggaatcctgggcaatgcggatgttcttacggcggtacttggagaacgaggccagcagttccttctcattatgaatgccgtcaagccccttgacgaagttccagcggttcaccacggattcgtagcccacggtgaaaccgccatgtttccaaccgaagcgggccatgttgtccatcatcgtggtgtccgggtcgctggtcggcttgccgtccagatcatgcagacggtagactgcggccggccagcaggatacgctgatggcgtgatgggccttggccgaacgacgcagggcttcggtcatcgcctcaaccacctgtggattgtcataatcgcacagcggtccgcaccagaccgagccttccaaaccgaaacgggaccgcgtgtacaccacgtagcaggcggcaatcagcttgtcaccgcgcttgacacccacatagtccaccggaccgttgaacgcacccatggcggccatctgcgaggtctgctggaaactaccttgcacttgagctgcggagaacgcatccagctcggcaggagtgatcttggtaggggtgagcgaggcgacgcctgcatcggattgcgtcataatcgaaccttcttacttgtcgttactctgatcgttactctgggctctggaacggcctgtgtgctgcgtccgtttaccgcgacagcagcttgtgcgcaaattgcttcatggcataggcgaccggtttgaccggcagtacgaactcgcccggaagttcctcgacatatccgttgaagccctgcttgaactccagtacaccacgcccctcgtcatcgggatcatcaaagacgccgtcgatgccgtagaagttgtagcgagacagcccgtgttccacgcagaaatgcagcatcgcgtcatgctgaatcagcgcggaggcgtagaagggcttgtactgctcgacgctaccggagaacaggtagatgacctcgcgcggatgctccacgaatagtgatgccgcagccggcagtacatccccgtctttggcgaactcggccgcctcgttcaggcgcttttcggctgccgccagattgcgggtctcctcccccagctgacgttcggttttggtggtggggtgttcggcgtttttggcggtcaatgccgccaccttggccgaaagcgcttcacgcttggacgtcatgtccgctacgtattcgtcgatgtggatctcggcaaccataaaatgcgctttgctgccgaacgcttccttgaaacggtggaaatatgcttcgccacggtattcgaagctacggcgttcagcggtttgctgctcgattcgtgcgaatacccccagctcgtcgtccgacagctcacgcacgtgcacacccatcgattgggcacgcttcacgctccactgggtgcgcttgtcataggacttcagcagacttttctcatcggtaatgccggtcagatccttgaggtagcgccaacgcggaaccgccgtgtagcccacggtgaaaccgccatgagtgaagccgatcgcctcgagctgttctatcagcttattgtcgggagcgccattctggtcatccggcaaagaagctccattggtgtcgcgaagccgatacggggattcaggggtgatttccagctgtgaagcaccctttgccttggcatggcgtttcagcgcatccatgaagaaggtcaatgcttcggtgtcgtgatagtcgcacatcgggccatcatggatgaccgcaaatgtagagaatcgagagcggtgagtttcgaacagtgccgccgcgacgatcttctcgccctccttgagggccaaatattcgacgtcgatcccctgcgcggtgcgaaggcgtcccatcgccgaggtttgttggaaattgccttgtggatgtctggcggagaaatcatcgaactcctcgtctgtcaacttcaccagcacaaaatcacgcatgcttccctttgcctccgagtcaatcaggctcaccatgctagcatagcgcgcacacgacgaatggcggccgagcagatgaggtgtgcacatcgttcgcactattgccgccacgatggtccaaagaacaatggcccaaagatgatgaatgtccggcttgcagtgaatcaaacgcagtgctatattctctacttggctcttgaagccacgccaccttagctcagtggtagagcatccccctcgttcgtgggaaggtcggtagttcgattctatcgggtggctcttgttcatcaagaaggccgacgcactaagcgccggccttctttcgtatcgcccttgctaggtcataggcgcttgctagacactcgcccgattcgggggctgagtgctgagccgcgactcaactgtggcttagtcgcggctcagtgcagctagacagcctagacgacttagtgcagcagggcctcgatggcggggaccaaggctttcagcgccttgcctcggtgggaaatcgcattcttctcggccggagtcatttcggcgctggtcagcggctcgccttcatggtcaggctcagtgctgacgcgaccggcaggctggtcgtccgggacgaacagcggatcgtaaccgaaaccgtgttcgccacgagcctcgcggatgatacgacccggcatgtcgccgagctccactgtctccgacttgatggcgtatcgagcatgcaccggggcagggctcccagcggcagccgtggtgtgaacggtgatgccgtcggcagccactccaccggtcacgtcggcaccggtctcggtgtccgggaccaccagcgcggcggcgcaacggaagcgcgcggtacgcttgtcatccggaatatcttcgatttgggcgagcagcagcgcattattggccttgtcgtggccgtgagcacccgcccagcgagcagacagaatgcccggagcgttacccatcacatcgacgatgagacctgaatcatccgcgacagcgggcagaccggtacggatggccacagcgcgggccttgagtagcgcgttctcctggaaggtgacgccggtttccaccggatccggcaggtgaaggctgccagcggacaccagttcgatgttttcggcatccgcgccaagatcctcttcgagaatgcggcggatttccacaagcttgccttcgttatgggttgcgacgacgatttgcatgaggttctcctttaagaaggctccccttgtcaggggagctggcttagtctagggacagagcggcacgctgggcggcttgcagttccttgttgcccttttcggccaagtcaagcagggtgccgagttcggcacggttgaacggacggtgttccgcggtgccctgaatctcgatgaaggtgccggaaccggtcatggccacgttcatgtcggtcatggcctgactgtcttcaatgtatggcaggtcaagcatcggagtgccgttgatcacgcccacagacacggcggacacatagtccttaagcacgcggctggcggacttgatatggcggtgcttctccgcccaattgactgcgtcgaccaaagccacgtacgcaccggttacggaagccgtgcgagtaccaccatcggcctgaagcacatcgcagtcaagctgaatctgattctcgccgagcgccttcatatcgatgacgccacgcaggcagcggccaatcagtcggctgatttcgtgggtacggccaccgattttgccacgtacggattcacggtcggtgcgttcggcggtggcacgcggcagcatcgagtattcggcggtgacccagccgaggccggagtccttgcgccaacgcggcacaccgggagtaaaagtggcggtgcacatcacgcgcgtgttaccgcattcgatgagcacggagccttcgggggcgtcggtgaagtggcgggtgatgcgcacagggcgcagttcgtcgaccttgcggccgtcggcacgaattatttggtgattgccaagcatgtctttgatttcaaccatgcgccccagcatacgccatccgctctatgcctggatagcaactcgtcaaccatcatcgaactccagcgcaatgtcattccctgcttacatatccatcccatgacacttggctgcacgccactattttcttatgcaccactcgcttacagagtcaatgcctgcgtacctgatgaggattgggaaagatcgtccgctggaataaggatgccatattccatgaaagcttggttgaattgcttgcgctgcatagcgttgagttcgtaatcgattaacggcaaatatgtatagtccatgtcatgcaacggctcttcatatcgatgaagcacgtgcataattgccgcgctcggcagtggggaccaccatccatccaagccataccggtacggaggaaccaatgtcaagcgtctgttccttgggttgatatcccaacgcagaaaacggtataaaccagcgagaaacgcaatccagcacgcatcgttcacccgtgcaaccgctcggacgaacgatatacgttgatgttgaacattccgagcatgaatcagattgacgcagagcatcttcaacgtagaccaggtcgctccgctttctattgcatcgaaatcaggaggcctacgcagttgcgccaacaacatgtgcaattcgtcttccggaatcgtttgcgagggggccacggcttctaggtgaagaccaaaaccagcccgctcaagcccctcgaccaaaacatcaaacaacatacctctttgcccacgcaatacgcgaccaattgcagaccgatccaaaccagtgcgctgtgcaagctcataggcattccaaccagtctgcgacatcacttcattcagcacagccgcacacgaattaacagggcaaccagataccacaccgtgatgcacgacatcgcactgttctaacgctcgatgctctacagcgcgccgctctgatacgtcatcgttgcccgccgcgttctcatcattgagagtttcactcatcgaagtcaccttgcctcggccgatttcccggtcatttcatcaaaccgcaatcatcatatcccacaatcccatgacgatacgattcgtcatatcccacaattcagagacggtatgattcgtatcgcatcagttcacacgattcttcaacgattgctccgcaaacgattgctctgcacgcatcacggcattctaccggcacactattcctcccaatcagcccaacgcaacatcacacgcaacatcacacgcaacatcacacgcaacatccctcacgcaacacccctcacgcaacacccctcacgcaacactgcgccatctctgtaacatcaccgacaacacggcaatcccacaacgtctcggtgcaatatcctctgaaatggtttggttttcactccacctcgtcggcatcctgaccaggataggaatatgtgtcgttccgcaccatgtacaaaacgttgtcaactgacaacgttcttcaaatcaattggataagacaaatggccatttcccgccaattcatctgaatcaagacgttgtcaactgacaacaaaatgtacattgcaacagcatgcacatatacatatttccccggtgagcagtacccccccccaaaaaaaaacaagggggcaccctcagctggaaccacgtccggcgaaccgggacgcagttcagcccgaggggacgcggccaatacagccccgggacacagccacagggggtgcaaacacgggggtgcgaccggggttgcatctccccgcctcggcggcgaccacaggagtgcggccaacacagacagaggggcacagacagagggaagagtagccaatgtaaccagagggatgcggccagtgcgatacggtcagaggactttggtctctgtggtcgaaccgttaagcggacagcccagtgggctgtccgtaggtaaggggagcagctatgctgcgacggattcctatggagacgaaagttctcgtcagagaacctgagtctccgtaggaatcacgggctcgcccttcatcaggctttgtgcggtgatgggcagttcggacaacgccttggcgcggtagtcgtgggcggccatgatggcgtcatggccctgccactgcgcatcgatatggccgtggtccacgaaatcgaccagcaggttcttccacgtcggttcgggcgtgaaaccggccagtttctcttccgagccggaaatcacgtgttcggcttcggctagcgcgtattcgtaggagcggaatgccaacttgcgaccgggcactgtggccttgtccttggacttcttcatgaccggaaccatcgtgccgtcagcgccttcacgctcggtgagcttgtacaccatcgcacaagtgggagcgccggagccggtgaccagcatggtgcccacgccataggagtcgaccggcgcggtctgcaatgcggcgagcgcgtactcatccaaatcgttggtcacggtaatggtggtgttcgtggcacccagggcgtccagctggttgcgcacacgctgtgccatggcggctaggtcgccggagtcgatgcgcacgccacccagttcgggaccggccacttcgacggcggttttcacggcttcctcgatgttgtaggtgtccaccagcagcgtggtgttcttgcccaatgcctcgatctgcgattcaaaggcgtcacgctcggaatcatgcaccaacgtgaagcaatgcgcggcggtgccgatggccttcagaccatacagctgggcggccagcagattggcggtacccttgaatccgcccactacggcagctcgagcggcggccacggcggcccactcgttagtgcggcgtccgcccatatccatgcaaggacgatccttggctgccgacgccatacgtgaggcggcggaggccactgcggaatcgtagttcagcacggatagaatcaacgtctccagtagcgtgcattcgccgaacgtgccttcgacctgcaaaatcggggagttcgggaagaacatctcaccttcgcggtaaccgcgaatcgtaccggaaaagcggaagttctccagccacttaatggtctcggggcttaccacgtgacggtcgaccaggaacttcagatccgcttcatccaagtggaaatgttccagcgcatccagaatgcggccggtgccggccaccacgccatagcgacggccttcgggcaagtgacgcgtgaacacctcgaacacgcacttgcggtcggcggtaccgtctttcagagcggcgtcgagcatcgtgtattcatacatgtcggtcatcagagccggcgaataatcgaccattgcaaggcctttcctacataagtggtgaagttgcacctaagtgtagtccgggcaaagccgtgcgggaagggctcgtcttattctcgtatcgccagattcgatattgccgggttcagtatcgtcatattcatcggcactatggcggtcggtcacaccgaccataatcatcacgaccagccaatacgccagccgcaccatacggcccactggcgaagcggtagactcgatgcatgagattcatcgtggcgttgtggcgctttgcgatcgccggtttctgcttcgtgggcacatatgaggcatggtccaaaccgcagttctgggtgtatttcacgttccagaccggtttcgtgctgggcatcgtgatgctgtggtccggcgcggccacactgctcaaaggtattcagccgcctgcatggcttaaggggtgcctgactgtgtacgccatagtcaccgcactggtggcgttcttcctgacgcctccggacgacccggcatacgtgccacaggttattggcatcatgaccaatacgatgctgcacaaaatcgccccgattatggcggttatcgatttcgtgctattcgacccgcaccggcgtttccgctggcattacatgttctcgtggctggcgtacttccctgcatacttggtcttcgtgctggcccgtgcggcgatttggccggggtccggaccggcggccggcggcagtccgtatccgtacgacttcatcaacctcgacgcactcggctggcaagggttcggcattagctgcggcaagctggccatagcgttcttcgtgatatcgctcgttgtctggctgctcgaccgcgcactgccgagcaaggccttactcggatagacgcgcccacgatcgacgcgcattggtcttagtgcccagccggcatccagctcagcactcgatggtctcaacattcgatggtctcaacattcaatggaataggcgcggtttttgtactcgcgccaatccggccagtcttcaccggcgtcgatggcacgcttgatgtcgccatagtaatggagcttgcgctgcacgtgcatggccgcctcgttgagggctcggcgctgctcgtccaaggattcgcggcgagattccagcagatcaaggatttcatcgatatgctcgggctcattggactcatacacgaagaactttttaagatcgtcaatggtcatgccggcgttcttgaagcagcaaatcgcgcgcagacggtcgatatggcagtcttcgtatatgcgctggccggtttcggtgcgctccacgttggtcagcaatccctgatcctcgtaatagcgcagcgtagagggctgcatatggaactgcgtggccacctgacgaatggtgtaggacatcatgactccttactgcggcaacacgccgaagcgtcgcagccgtttgcattcaagttcacttgaactggaaccatagtatccaagaacacttacgaataccgctcaatcggcgtcggtttgcccatcgcaggtaagcattcgtaagaacaagaatgacattgtaaggagactcaatgttcgagccaaccgccatctatgcccccaacccgcaccgttacgacacgatgacctacaaccgtgccggcacctccggcctcaagttgccggccgtctcacttggcttctggcacaacttcggcgacatcacgccattcgaccagatgaagtccctggtcttcaccgccttcgacaacggcatcacccacttcgacctagccaacaactacggccccgaacccggccaggccgagaagaactgcggactgctgctcgccaagtatttcaaacatcaccgcgacgaactcgtcatctccaccaaggccggctatgaaatgtggacaggcccctatggcgacctcggcagccgcaagtacctgctcgccagcctcgaccagtcgctggaacgcttgggcttggattatgtggacatcttctaccaccaccacccggatccggaaaccccgcttgaggagacgatgggcgcgctggctcaggccgtgaactccggcaaggccctgtacgtgggtctgtccaactacgatggtccgacgatggaaaaggccgccgcaattctggcagaactgcacgtgccgttcatcatcaaccagaacaagtacaacatcctcgaccgcaccgttgaaaagaacggcctgaaagagaccgccttcaagctgggcaaaggccttatcaccttctgcccgctggctcagggcctgctgaccaaccgctatctcaacggcattccggccgacagccgcatggctcacgatccgcgattcctcaacgattccgccctgaccgagaaactgcacaagcaggttgtggacctgaacaatctggccgccgaacgcggccagacgctggccgagatgagcctggcatggctgctgcacgacggcaaggtgacctccgtgctgaccggagcctccaagccgcagcagattctcgacaacatcggcgcactgaagaacacccacttcagcgacgaggagctcaagctgatcgacgagatttccgctcggtgaccattttggctcccctcgctgaggggagccaagtaccacctttagcgcgtcatttcctcgtaaatccgcttgcagtcggggcaaaccgggtacttggacggatcgtgcttgggcacccaaaccttaccgcacagggccaccaccgggcggccggtcgcacgcgattcagcgatacggtccttggatacgtagtgcgcaaaacgatcggcgtcgccaccatcgtcacgaaccggcgactccttggtctccggacgctccagcaccgacgtgccggcaccttggtccgggttgcgcagcggttcggcatcatcaacgaacatctcggcaaaagtcatggtgcacttctttcctcgcattcaacgattcgactgcactccatcatagattcccgtcgttacccgcgaaacccagtggcgcgtaatccgcacacctccacacacccatgtcgcgcatcacgccaccccgccacatacaatgccacatacaatgccgcacacgacgccacaccgacgccacatacggcaccgcacacactgcctcatacgccgacgcgacaacaatgcacgctcggcagcacgaagcacaccactagcggtaggctataaagcatgactatcgcagtatgccccggctcgtatgaccccgttaccgccggacacttggatgtaatcgagcgctcggcgcggtttttcgacgaggtgcatgtggtggtggccgtcaacgccgcgaaaacaccgatgttttccgaagccaccagagtcgacgtgatccgccgcgcccttgacaaagccggttgcaagaacgtcaccgtttcttccaccgacggcctgatcaccgactactgcaagaaggtcggcgccaccgttatcatcaagggtctgcgccagaacggcgactatgaagccgagctcggcatggcgctggtcaatcgcaagctcgctggcatcgaaaccctgtttttgccggccgatccgattcttgaacacatctccagttccatcgtcaaggacgtggcccgccatggaggcgacgtgaccggcatggtgcccgattgcgtcgtgccgatgctggccgatgccctggccgaggaacgtcagcggaaggactgatgcactaatgactatgagcgatgaccaccctactggatacgtcgatctgaccaaaccgaatgcggacgccgcatcgtccactccggagccgtccgccccggaaccgcccgcgtctacgcaagccgcgccggcacccaccgaagaggccgatgttctcgccggatcgccgcccgccgcgcctacccctactccggcacaaatgcaggccaaagcgcaggcccaagcagctcagcagacccgggcacaggctcagaccgctcaggccgccggcattcgcccctcgttcatgaacgaaatgcccgacctgcgagaaaccacggacgacgacccggccacggtcaagagccacgaggaattcaccacggtgtatgacatcatcgaccagctcgaggcggcactgggcgaagcgaagtccagcatattcgcccccggcatggtgaaggttgaccgcgacgaattcaccgaccagctttccgagttgaagaaaatgctgccggtgcagttggagcgcgcctccgccctcatgcgcgaggccgagcgccgtctggaatcggcacagacccagtccaacgccatcgtcgcctccgcacaaagccgcgcagccaacatgatcagggacgccaacgaacaggcacagttcctggccggccaagagaacgtcaccgagcttgcacggcagaaagcgcgcgcgattcttgaccaggcacagaccaaagccgaccatctgacccaaggcgcggaccagtactgcactacggtgatggaagggctgtcccagcagctcggcaaactcagtcaggatgtgcaggccggtcttaacgtgctggaagagcgccagcgcgcggcccgcgaacagatgccgcacctgacgctgaacgactatcccgaagcccagtaacgccagcaacgccggcaacatcagtaacgcgaataacgccagtaacgaataactccagccaacatacgaaaggcaccaagaacataccatggcacgagttgaagattccccgtgggccattccggtagcgcagattgcttcgcgcgccggtcaatccaagccgattgacgccgatttcccggcaccttccggcattggcgacagcattgtcggcatcaaggaaggtgagcccgtacacgtgagcgggcagttcgattcgattgtggacggcctgatcttcaccggccgcctggtcgcgccattcgtcagcgagtgcacgcgctgcctgaagccgattgacgaggactggccggttgatgtgacggtgttcttcccgtacgagtcgggtcaggacaaggccaacggcaagggcggcaagagcaagaaggacgacgaaatcgacatcatcgccggcgaggacgagtcggaagacacgtatccgctgctggagaacggcgcattcgcggacatcgaggcgatgatccgcgacacgctggtcgaatcgctgccgttgcaaccactgtgccgaccggattgcaggggtctgtgctcgcagtgcggtgccgatctgaacgaggatcccgaccatcatcacgatgtgacggatatccgttttgccggattggcggggctcaaagcccagctcgaggccgagcagaacggcgagcaggccgagtgacgcgcgcctgaacgaagtttgtacgagccgtgcgttaagataacggacgcttaagctcaattgttcgaacgaaatagaggatactcaaatggcactgcctaagtacaagacctcgcgcgccaacacgcattcgcgtcgcgcgaactggaaggccaccgctgctgcgaccgtgaactgcccgaactgtggcgctccggccctgccgcacatggcttgcccgagctgcggtaactaccgcggccgcacctaccgctccgccatccagccggctcacaccaagtgagtcctgcgataacggcttgaatgaaggccctgccatcgacgggtggcggggtcttcgcataagtgcaccattgcgtacaccatcgcatcgcaaacaacacaacacaacacaacacatcaccatcgcgtgaaggaccatacaacaatcatgagtaatgaaaccccacagcagccgacgccggccaacgagcttcttgaagcgttgggcaccactctcagcccggatctgctcgtgcaggcactcacccaccgttccttctcgcatgagcaccccggcgtggccaattacgaacgcctcgaattcctgggagacgcggtgctcgaactggtctccactgaaacgctgttcaccattcacccggatatgaccgaggggcaactggccaagatgcgcgccaaggccgtctccgaagacgcgctgagcgccatcgccaaaaccaagctcaaggtgggcccctacattctgctgggtcacggagaagccgagcagggcggcgcggagaagaactccatcctatgcgacatcgtggaatcgctcatcggcgcgaccttcctggaacacggcatcgacgaggcacgcaaggtgattcaccggcttattgacgacacgctcgccgaagtggccaccgagggcccggcacttgactggaagacctcgctgaccgtcaaggcgcacggcctcggcaaggaggagcctgtctaccatatggaggtctccggcccggaatacgcgcagatcttcaccgcgcgcgtctcattgggcgagaacggcgacatcatcggcatcggtaagggctccagcaagcgtaaggcgcagctggcggccgccgaagcgggctggaagtcactggactcgttcaagacgcggactaagtaagcccgctgtcggatttgcgaatagactaataccaacatgagcgacgagtcgcgccggggccacaagtctcggggaagcgactggaatcagacacgcgggcacccggccccatcccaaggtcgggcaggttcgcgacaaaacctatgaggtgagaggaatcatggctttacccacgcctttgcaggcattcagcggtgtaccgaaaatcaacacggcccccgataagcagaccatcgtcgatggcgagaagatgactggcgcccaggcgctgattcgttcgctggaggacctcggcgtcgaggacgtcttcggcattcctggcggcgcgattctgcccgtctaccacgagatcaaagacaacacgaagttccgcttcgtgcttatgcgccacgagcaggccgccggccacgccgccgaaggctacgcactggccactggcaaggtgggcgtgtgcatcgtgacttccggcccgggtgccacaaacgtggtcacggccattgcggacgcgaacatggactccgtgcccatggtcgtgattaccggtcaggtgggcgtgcaagccatcggcactgatgccttccaggaggcggatatcgtgggcatcacctacccggtgtccaagcactccttcctcgtgacccgcgcgcaggacattcctcgcgtgctttccgaggcgtactacatcgccaacaccggccgccccggcccggtggtcgtggatctgaccaagaccgcacagaccggcgacatgtactactcatggccgcagcgcatgattctgcccggctacaaccccaccaccaaggcgcacggccgtgtgctgtccgacgcggcgaagctgttctctcagtcgtaccgcccggtgctgtatgtgggtggcggcgccgcccgctccaacgccggcgcacaggtcaaggctctggccgacctgaccggcgctcccgtggtcacgaccctgcccgcacgcggcatcattcccgactccgacccgaagaacctcggcatgctaggcatgcacggtacgattgccgcaaccggcgccgtgcagcgcgctgacctgcttgtggccatcggtgcacgtttcgacgaccgcgtgaccggcaagctcgacgccttcgcaccgaccgcccgcgtgattcacattgacatcgacccggctgaaatcggcaagaaccgtcagcccgacgtgccgatcgtgggcgatgtggctaccgtgctcgacgacttgattcccgagattcagcgtacgcaggccattcagggcaagccgaatctggccccctggtggaaggcgatcgacggctggcgcgaggaatacccgatgacgtgggatgagccgaccgacggatcgctggccccgcagtgggtcatcaagaagctctctgagatggccgatccgtccaccatctgggtgaccggtgtgggccagcaccagatgtgggcttcgcagttcatcgattttgagaaccagcacgcttggatctcctccggaggcctcggcacgatgggctacggtctgccggctgccatcggcgcatccgtgggctcggcccgtgaattcgagggcaagaagccggtgtggctgatcgatggtgacggttccttccagatgacctctgaggagctggccgccgcgttcctggaccacgctccggtgaagatcgcgattctgaacaactccgtatacggcatggtccgtcagtggcagacgctgttctacgagcaccactactcgcagaccaacctgctcgatggtgaagcgcacggtgccgatggtgcggcggcactggccgacggcgatgcgccgctcgaagtgcctgatttcatcaagttggccgaggcatacggctgcgtgggtatccgcgcgttcaccgaggaagaggcgattgccgccatcgaaaaggcgaaccagatcaacgaccgcccggtgctgatcgacttccgcgtgtggaaggatgcgatggtgtggccgatggtagccgccggcgcccccaacgacgaggtgacgtacaagcccggcatcaagccgctggctggcggcaccccggctccgggaaccggtccggacgagcatgcgaccggcgtgttcgagcacgagaccgccgctgccactgcgagcgagcactgaggagaggagaacactcatggctaactatcctgcatcccagcctggttcccagcgtcatacgctgtccgtgctggtggagaaccgcccaggcgtgctggcgcgtatcgccggcctgttcgcccgccgtgcgttcaacatcaactcgctgtccgtctcccccaccgagcgtccggacatctctcgcgtcacggtgaccgccgacgtggaggccgtgccgctggagcagatcatcaagcagctcaacaagctgctgcatgtgctcaaaatcgtggaactcgacccgaactccaccgtggaacgcgaactggtgctcatcaaggtggccgccaacgaatccaaccgttccgacgtgctggagatcgtgcgtctgttccgcgtgcgcgtggtggacgtgaatccggaatcgctgaccattgaggccaccggtgccgaaggcaagatcgacgccctgctggggcttttggagcattacggtgtgattgagctggtgcgctccggtgccgtagccgtgacccgcggcccgcgcgccctgagcgaaaaggtcgtcggttccgaggttaccgggcgctgattcggcgactgcgggaagacccagtccaagctcaaaaggcggatgcgcatgatgcatatccgccttttttcatgcgtgcatacctcatcacccgtactgcaagcaaaacgacagcacctcatgctagcattatgacagcaacaaggaggtgcatcatggcaacattgaccatccgaaaaatacccgatgagcagattcagcagctcaaagaagtggctgagaaaaacaaccgctccatggaatctcaggtgcgatccattcttgaagaatggctggctggcacggtggcgcatgaaatcacgcgaaagaccaatttctatgacgagatccgcgaattcatgaagaacatggattttgagggactcgacaagggggaactcccactatccgagcgaaattccgccgattcccgaccgccagtatcttttgaataggaatcggccatgattattctggacaccaacgtcatcagcgaaatcatcaagaaacagccagacgaacacgttgccaattggctgaggaaccaagatacaagcaatttggcaaccaccgccatcaccgtcgccgagttgttggccggaatatgtcgcatgcctgaaggcaaacgacgaaagtacacagatacgaccgtcaagctggcgcttatgacattagaggacagaacgttcgcatttgacactcaggcagctgcggattatgcccatatccttgtcgaacgcgaacacaggggcacacctaccagtattcaagacgccatgattgcggcaattgcctgttcctgggatgcggccatagccacgcgcaatatcaaggacttcgaaggtaccgacgtggaattgattaatccgtgggagtttgcatagcgggaggccccggcaaactgccgaggccttgtgaacgttacggtttctcccgctactccaattgttcggagagttcgagccattcggcttcgagatcatcgctttcagtattgacggcggtgagttgttcattgagcttgttgagacccccgtagtcgctcgggtcatgggcggccatctgcgcctcgagatcggccttctgctcttcaagcttagcgagcttacgttcgatggcattcacgcgcttggatgcctcgtggaaggccttgccggtgagcttcgaggtggagtcctcaccgttattggctccctctgacgagggagctatccgcgaagcggactgagggagagatgcggcagcgttgacggcggccgccttacccttaccagacttcgccgagctgctaccggtgcccgcgaagccaggcgtgtcagccggcaatcccttgccgttcttaatagcctcaaccatatcgaggtagtcctgcacgccgccgggcaagtgacgtactttgccgccaatcagcgcgaactgctgatcggtgacgcgctccagcaggtaccggtcgtgggagaccacaatcaacgtgcccggccaagtatcgagcaggtcttccatcacggcgagcatatcggtgtccagatcgttgccgggctcgtccatgatgagcgcgttcggctcgtcaagcagaatcagcagcagttgcatgcggcgcttctgaccaccggagagatcgcggatcggcgtcatcagctgggcggattcgaagccgagacgctccatcaactgtcccggcgtcacttccttgccatccacaatgtagctcggcttatagcgggaaagcacttccttgatcttgtacttgccgagcttctccagctcatcgaggcgctgcgagagcaccgcgaacttcaccgtcttgccaatgttcacatggcctgcggtcggggtgagtgtgccatcaatcaacttaagcagcgtggacttgccggcaccattcgcaccgacgatgccgaagcggtcgcccgggccaatcagccaagtcacatcgtcaagaatctcgcggccggaaaccgtcaccttgcgtgcagccgaggtgacaccggctgcagcagtgtcatcatccgaatccgttgcagcagtgccaccgccgatggtttcaccacccgtgttcatgcgacgaacctcgcgatcgtcagcaagctgcggattgccgctctcagcctcggccttcttacgcgcttcctcagcggactcgacggcttccggcacgccggcgtccaccaggcgcgggtcagtcatgtcggtgaccgccacctcaacggaaccatgcagctgcggctcggcgtacatggcgttgaccacatccacgcgggaagcggacgcggagagcgccgccacatccgggtcgatatcggccatgccctgcggtttttcgaaaatctgcgtcacgtcgaccaaatcgaccacctgtttgccgagacgggaggtggccatttgcttcagttcaagtgtgttacgcatcggcggcacatcggcaatcaattcgcgtgcggccttgacgtggaacttctgcttggtggagcgggcacgagcaccgcgggaaagccatgcgagctccttgcgagccagattgcggcgcttggtttcgcgcacatcggcttggcgatcgcgttccacgcgctgcagcatatatgcggaatagccgccctcgaacggctcgatcacgccatcgtggacttcccacatcgattcgcagacctcgtccaagaaccagcgatcgtgggtcacgagcaacagagcgccctggcctttggaccagcggttcttcaaatgttcggcaagccagtggatagtgaccacgtcgagatggttggtgggctcgtcaagtgcaagaatatcccaatccttgagcagcagtcgggccaaatcggcgcggcgacgctggccgccggacaaggagccgaccttggcatccaggctcatgccgccgagcaatgcctcgacgatttcacgggaagtgttatcggacgcccattcgtagtcggcgcgcccctcaagtgcggcttcgcgaatggtggcgttgtcatcaaggggatcacgctggtcaagcatgccgaacgtgagtccgccacgctttgtcacgcggccggaatccggctcctgagcaccgcggaacaggtgcagcaacgtggatttgccgtcgccgttcttgccgacgatgccgatgcggtcgccttcaaaaacaccctgcgttacatcagtgaagatggttttggtagcgaaagcgagcgaaacgtgttccagtccaatgtcataagtcggcatgactcaccaatgtagcgccacgcttgcccagcggcggcccgcaaacgttatttgttcagcgtctgagcgtaggagttgcagcgggccgcaaaaccggagaacacttgctcggcgagcggttgcagtagctggtcgtattgggcgaactgctcgcgcaattgggacttggaaccacccgcggccttgagatccttgaccatgctcggctcatccagccattcgtccagcagcgagccgcacacttccaggtggaactgcatgcccagcgcggatcccagtcggaatgcctgcaccttggtggaagacgaacgcgacagcagctggccttccgcgggcaggcccaccacgtcgttatgccagtgcagcactgtcagctgcttatcccacatggagaagaagtcatgcttgtccacacgcttgatcggcgcgaacccaatctccggcgcatcgcccttgcgcagctgcgcaccaagcgcagtggcgataatctgatgccccaggcatacaccgagaatcggcttgcctgaagccacggcggcacgcgccaacttggcttctgccttcagccccggatacttatcgtaatcaagcgcgcccataggcccacccatgattaccacgccagccagttcgccgaaatcaggcaagtccggtttctttttgtcgacgatattcatcgtcaccgtctcaagaccgatgtcctcgaggttcgacaatatgcgtcccgggcgttcccatgggacatgttgcaaaatgagcacttgtggtgtggccatgacttctattgtggcacgagcgttccccgtttgcgtaacgagcagggcaaatccatgaatctcgcagtttccgcagcggtcaaagacgtgttctcgcgagactgttgtcccgcttctcatccgtctgtcacctcgttcgggccccacctgtgaagcgttcatcaaactcttcgagtaacgattcagcatgtctggttcggaccctacgcttgagtgttatgggaaacagccaagaaccgcaggatttcaacatttccgtcatgccttcaagcctgacgccagtgcatgttgcaaaggccgcagaaggcctgaatctgtatgacaccgcctcgcatcaggtcagccatttcgtgccgctcaagccgggcgaagtcggcatttatgtgtgtggcgcgactgtgcagtcgtcaccgcatattggccatatccgtgccgccgtggcgttcgacatcgtgcgccgctggtttttgaagctcggctacaaagtcacttttgtgcgtaatgtgaccgatatcgacgacaagattctcgttaaggccgcggccgcaggccagcgttggtgggcccgcgcctattactacgagcgcgaattcaccgaggcatacaacacactcggcgtactgccgcccaccgtggaacctcgcgccaccggccacatgtcggacatgatcgacctgattcagcgcattctcgacaacggacacggctatgtggtcacggatgcggacggcaagcccaccggcaacgtgtacttcgatgtggcatcctggccgcattacggcgaactcactcaccagaagcagacctccgaagtcgatgaggccgccgccgtggccgaccgcatgggcccgtccgtggacgccaccggtgccgacaagtacaatccggtcgacccggccgatgcctcccccgacaagcatgatccgcgtgatttcgccctgtggaaggctccgaaggacaccgatcccgaggacgcccgttggtcgacgccgtttggcgtgggccgccctggctggcacatcgaatgctccgccatgtcccaccgttacctgggcgatggcttcgacattcacggcggcggcttggatctgcgcttcccccaccacgaaaacgaaatggctcagacctgtgcggccggctacccctccgctgcgcgctggatgcattcggcatgggtgaccgccaagggcgagaagatgtcgaagtcgctgggcaccggcctgtccgtgccgagcgtgttggctgagcattccgcttgggtggtgcgttacgccctgggctccgtgcagtaccggtcgatgctcgaatggtccgatcaggcgctggtcgaggcgcaggccgcatacgaccgcgtctcgaacttcatcgagcgtgccggtgtggcgctgggtggacagccttctcgcgaggaagtcactgccgtctccgccgacgatttgcccgccgatttcgtggccgccatgaatgacgatgtcaatgtgtctggtgcaaccgccgcgatcttcaccgccatccgttccggcaatacgttgctttcacagctggctgaccgcgccgattccgaaaccgccaaggccgaggtgcgtgaggcgctgctcgccgtgcgtgccatgctcgacaccttgggcctggacccgctggccgaaccgtgggtgtccgccggcgctgccggcggtgccgctgatggcacggccgagtcgcccgagcatgcagcgctggaggcactgatcgccgaacagctcaacgcccgtgccgaagctcgcaaggccaaggatttcgccaaggccgatcagattcgcgacgctctgaccgaggccggcatcgccatcgaagacggcccgcagggttccacttggagtctgaagtagtcgcttcaaacccatcaatcagtcaaacacgaagtccacgtccacgatgtgcaggcgcttgctgagctccttttccagcgagcgcttgcattcgatgaggtcagctacatcaatggtttcgccgatgccgctcagatacacgtcaacggtgtagttcataccggtcttgaagatcagcgtctgctcgtagtcggtgttggcaggcagatggcgctgtgcctcggcctccacgtaggcgttggtttcatcgtcgtcatgcacgccgccgaccaattccacgaacgcctctttgagcacgctgaacggctccttgatggtcaatgccaccaaagccacggtgatgaagaaatcgccggtgtagtgcaggaagtcaagcggaccgccggccggtagcagcatcaggaagatggcaactacgccgatgccgaacgacatcgatccgtcgaccaacgtgctcttgcactcggcggtgagcatggtgctggaatcgccgatggatcggttggagcgccggtaatacgtgtataggctgaagcacacgattacggtcaggatctcgtagatgaccaccgggccggtttcaatgcgttcgccggacccgaacacgaagtagtcgtacgctactcggcacacgtcaatcagcgaatacaccaacaacgacatggtgaaaatggccttgcagatcgcgtagataggttccagtgcgaacatgccattggggaagcgctcggtggttcgcaccgtgcgcgacgagaggtacaccgccaccattccggacaggacggaaatcgcggtgaaggagaagtcgaggaacatggccttgagaccggtcatgaagaacacggccatgccggctaagacctgcagcacgttgatgacgataccaacgatcagggctttgcgttcgagtagtttttgggtgggcatcagtgggccttccttattgcacggcatgtctgcgttggcccgaacgtcatggttcggagcgcacggcagtctgcgtataagcggtgtccagcgattttcaaaacagcgtaagtattccaaaaaacacaggattctttacggtttccatggtatcggaagcactcgattggcttcgccacgagcggacggcacggcatttgccgtctgaatgcccaacatccctgactactacgcggcacattccccgaaaagcgtcgtccccaacaccgcaatttcccgcgtggcggctagactgttgcccattatggcagctttttcatctttgacagacagactctcgaatgcgttcaagcatctgaagagcaagggcaagctttccgaggcggatatcgacggcacgatccgtgaaatccgccgcgcgctgctcgacgccgacgtggcgctcgacgtggtgcgttccttcaccggcaaggtgcgtgagcgtgcactgggcaccgaggtgtccgacgcactcaaccccgcccagcaggtggtgaaaatcgtcaacgaggagctcaccgacgtgctcggccaaggcgtcgaccgtccgctgaacttcgcgaagaacccgccgacgatcatcatgctcgccggccttcagggtgccggtaaaaccacgctggccggcaagctcggctactggctcaaggattccggccacacgccgctgctggtggcggccgatttgcagcgtccgaacgcggtgacgcagctgcaggtggtcggcgaacgcgccggcgtgcccgtctatgctcccgaaaagggcgtccaatccgatggcggcgaggccgtcgcagctccgggccagacctccggcgacccggtgaaggtggcccgcgattccatcgaactcgccaagcagaagctctacgacacggtgatcatcgataccgccggtcgactgggcgtggacgaggagctgatgaagcaggctcgcgacattcgcgatgccgtgcgtcccaacgaaatcctgttcgtcatcgacgcgatgatcggccaggacgccgtcaagaccgccaaggcctttgacgagggcgtggacttcaccggcgtggtgctctccaagctcgatggcgacgcccgcggtggtgccgcgctgtccgtggcgtccgtgaccggcaagccgatcctgttcgcctccaacggtgagggcctgaaggacttcgaggtcttccacccggaccgcatggcctcgcgtatcctcgacatgggcgacatcatgacgctcatcgagcaggcgcagaagcagttcgatgaggaagaggcccgcaaggccgccgagaaaatctccgaaggttccttcggcctggacgacttcctcgatcagctgcagcaggtgcgcaagctgggctcaatgaagtcgctgctcggcatgattccgggcatggcccagcaccgcaaggaactcgagcagttcgatgagagggaaatcgaccgcaccgaggcgatcattcgctcgatgaccccggccgagcgccgcgatccgtcgattatcaatggttcccgccgcgcccgtatcgcctatggttccggcgtgacggtttctcaggtgaacgctttgctgcagcgtttcgagcaggccgcaaagatgatgaagcgcatgtccaatcgtggcggcatgggcggcggcatccccggcttcggcggcccggctatgggcggcggcaagaagaagggcaagaacaagaagaagggcggcaagtccggcaatccgatgaagcgcgaggccgaggagaaggcattgcgcgataagctggccggcaagtcctccggttcgaccggcggttccgccttcgccaagaagccacagaacccggccctgcccgctggccttgagcagatgatgggcaacgtcgacggtggcactgaactgccgccgaacctcggcggaggccttggcggactgttcggtcgctgatctcacaacttggctcccctcgcagaggggagccaaattatatctcggttcaatttatatttcgaaaggaacttccatgacgacaatcctcagcgcggtggcaatcatcgcactgttatggacgaccttaagcgcgctgcccgccggtctcgaggcccgtatgccgcttccgtacatgattgccctgacgccgctgttgtgtgttcctttgatgattctggccgcggtcgccgcatggcaacatgaatggactgcgatgtcgttgcttattgtggtcgcgctgattgccagctcacagcgcatcaactactggggtacgtcaatcgacccggccgggaaacgcaaagaatcccaccgtgaaacagcccgtgaaacaacttcgccgacgctgtcaaaaagccataacagcaatacatcgggtacctcaaacacttcgaaggaggggcccgaaaccatctccgatggacaccgtgaaacaacgcgtgaaacactctcgccccagttctcggttatgacgatgaattgtcgatacggacgcgccgacgccgctgaaatcattcgcaatattcgcgaacgcaatatcagcgtattggccttgcaggaagtcaccgacgacctcatcacacgtcttaccgaagccgacatcaacgaacttctcccctaccatcagttcggagacgccaaagagaccgataatggcggattcaacgtgatctattcccgctacgagccgagcgcagcggtgcccaacgtggtctccatccctgccgccgacgttcccgccatcaccctcaaaacctccggtaatcgcacggtgacactttgttcggctcacccgaaatcgccgatgcgcggctgcgcggattggtcggccggcattttgggtctgcgagaactcgcccgtgcaaaatccgtcagcaatcgcaatatcgtcgtcgttatgggcgatctcaactcgagcaccgaccatccgagcttccgcgcgttgctcaagtccggattcaaggacgcaagtctgattcaagccgccggcccgaatctcaccttcccgagctggctcaagtggccgcgcatcgagctggatcacgtgctgttcactcccgggctcaaaccgtccggcgtgaagtcgtttgaggtcgagggcactgatcatctggccctgaccgcaacgcttgcactgcgatagccggcattttcgcgatacattccccggaatgttgcgcaacggggaacgcgcaccacaccgcaaccacagtgcgccacgcccagtccggccctgtgcgctataataggccagttattcgcgcgcgcgtggcgccctctacaccccgagccgcgaggacacgtggattccggacggccatgccccacatggcaaaccgagaacccgcacacctagcattacaaggagagccattttggcaaccaagattcgtctgaagcgacagggcaagaagttctacgccttctaccgtgtggtggtcgtcgattcccgcaagaagcgtgacggcaaggtcatcgaggagatcggtacctacaaccccaacacccagccctcgaccatccagatcaagtctgatcgcgctcagtactggctcggcgtcggcgctcagccgtccgagcccgtcttcaagctgctgaacatcaccggcgactggcagaagtacaagggccttgaaggtgccgaaggcaccctgaagaccgttgaggctggcccggacgccgaggcccgcatcgcggccgttgaggaccaggctcagaagctgaaggccgccaagtccgaagctgctgccaaggccaaggctgaagccgaagccgctgccgccgctgaggaagccccggctgaagaggccgccgaagaagctccggctgaggcctgagcggaaacgaaaggctagctatgcttgcacaagctgtggaacacctcatcaagaacatcgttgattttcccgacgatgtttccgtcaagtctcatgagaacgcgcgcggcgaactgcttcgcgtacgcgtgaacccggaagacatcggccgtgtgatcggccgtggcggccgcaccgccaacgcgattcgcaccgtgattcaggcactgtctgaccacaaggtccgcgttgacatcatggacgtccgtcgataaccgataaggaacgattcacagcatggcacagcaagacatgcacgacgaccctcagcagctcgagttgctgagggtcgctcgtattggccgcgcacagggcctgaagggcgaagtcaccgtgcgcctgtacaccgatgatcccgagtggcgcttcgagccggactccgtgctctacagccaggatggcgagaccgagtacatcgtcgagggctcgcgcacgttcaaggatcgttggattctcaagcttgagggcgtcgacgaccgcaatgccgccgaggccctaaacggtgtcgaactctacggcgaggtcgacgatgcggaggacatgctcgaggccgacgaatggtatcccaaggatcttattggccttgaggcccgtctagtcgagggcaacggtctgggactgcccgccggccaagtggtcggcaaagtggtggatgtgatcgactcccccgcccaatccctgctcaagattcgtttgaccgagccggtggtaaccggccagaattccaagggcgaggatgtggtcgaaaagaccgcgttggtcccgttcgtggaggccttggtccccgacatcgatctggaggagcaatacctcacgctcgatccgcccggcggtctgattcccgggctgtaaacagtctttcaaaccaataccgagttccacactcaatttattccattgcaaagggcggtctttctgagactaatctcagaaagaccgccctttgattgctccttaacgcttataccgcgtaatatggctgagcctcacagataaccaaatggaatgccgaagcgatcaagacccgtaccgatcagctgatatccgttgcgctaaaactactgcgactgcaataaactataaaaaatgtgtaacgcttacacgtttatgatatgataaatgtgtaagcgtcgcacatttatcataggatatccgtcatgaagctccagcgaaaagcactgaaaacgctcaagcagtggaagaccacacctgaccataagcctctcctgatccgtggcgcacggcagacaggcaagacatggcttgtcaacgagttcgcgaatggacaatacgacaacatcgtctcggttgatttcatgcagcggccatccctatccgggatattcgagcaggatcttgacccgcaacgaataatccgtcagctcgaactcgccgccaaccaacggatactccccggcagaacactgctcttctttgacgagatacaggaaagtccgctcgcgttgacctctctcaaatacttcaccgagcaggcacccgactatgacatcatcgccaccggctcctacatgggaatatccaagcacggcaaaacctcttttcctgtaggaaaagtcaccatgatgaacctacatccgctctccttcgtcgaatatctggacagcatcggacaagacatgatcgccgacaccatacgtgaaggccggttcgaggacattccacaagctctcgaacctcagatgaatgacctactcaaaacatatatgtgggtcggcggcatgccagcagcattaagcgctcacctggataacgggattccgcaggatgtgcgagctgtccaacaagatattctcaacgcctacgatcttgatttttccaagcatgccgcatatacgctgggcgagcgtatccggcttgtatggaacacactgccatcacaacttgccaaggagaatcgcaaattcgtttacggtgttgtcaggcaaggagcccgcgcccgcgaatatgaggaagcgctcacttggctgacggactacggaatcattaccaaagtcccctgcctcgatgctctgcatattcctctgaccggatatgagagtcttaacacgttcaagatctatctggaagacacgggcatactgggcgcactgtccggtctcgacgtgaatactctggtgaacaagtcgaagctcttttccgaattcaagggcgcgttcgtagaacaatacgtatgtcagcagctggtagctcaaggaatcaaaccccgctattgggctaacccaaatcctcaaggaaatgcggaaatagatttcgtaatggaacagggagacgaggtttttcccatcgaagtgaaatcctcttccaatattcgtgcgagaagtctctcgtatgtctgcaacagatacgggctccacggtatccgtataggagaaataggctataggaagcaatcttggctgacgaacatcccactttggtgcgtggatgggctgggcgaatatctcaaacgtcaaatcgaaaagagcagggaaaatccagcgaccatctgattctttttctgatttttcgggtatgtgaaataggtggttgagttttggtgattctcatacatcaattcggacgaggatgccatcgcatatctcaatggcgcactcgaagaggatgatcccgcatttgtgcaagatgcgttcggtgtggtcgcacgcacacgaggcatgaccaatgtggcccgaaaatccggtctcggccgcgaatccttatataaggcgcttcgctcgaattcgcagccctcgtccaacaccatcatgcgagtcacaaacgcacttgacgcagaactctattccctgccgaagcgtaatcgttcacccgcgcgcggccgcggtgacgcgggtcatgaaacggtcgaggaattccggcacgttgacgcccaatgcgacttgggtgtgtttgtcggggtcctggagccgtgaacgatcgccgatggtacggcctcggaacgggccctcgagatcgacttgcaagttgaacccgaaggtcgtgaccagcgatgggtcgagcgcggcggccacggccagcgggtcgtgcagtccacatccgtgaatctccggctggttcttcaggtagaagtcgatgtagtagtcggtcatggtgacgaggaagtcgccggccggcgtccccagagacgcccattcatgggctttctcacaggtgagcgcggtctggtgggtcacgtcgaggccgatcatggtggtgcgtgcgccacacttgaacagatagtctgctgcctctgggtcttgggagatgttcgcttcggcggccgggcttacattgccgggcaatgtaagggcaccgcccatcaacgtcacgttcacaccggaatccttcaggtccggagcgttgcggaatacggtggccatggtggtcatcgcgcccgtaggtacgatggccaggtccgggccgtattcgcgcgcggcggtgatgatgaaatcgaccgccgagcctggtacttccggagcgcgcaaggagtcggggatgattgcgccgccgatgccgttgggatggtggaccgccaccgagccgggagttggtgaccacgaagcgtccgtttgccagccgtccgcgccgccgttctgccagcgcgcgtaggcctgggcccgctcgtctggtgtggtgccacgcattttcggcaatgttgccggggcgatgggatggtcgactccgggatagaccggaacatcgtcacggccgaacaagtgcagtaccgccagcgcgttgcgcgcggccagcggcaccgcgacattgccgtaggtggccgtgataccgatcaaatcgatctcgtcggcactgcctagggcatatgcgatggcgagcgcgtcatcgatgccggtatcgaggtcgaggatgagttttttgcgcacaattatctccttgtggaactacccgggactactccggcgactacccctcagtctcgctacgcgagacagctcccctgacaaggggagctgagaaagttcagccgagcttggcgagttcttcgggggtgagttcgagctggtcggccttcagggagtcgaggatggtttcgggacggtgcgcgccgggaatcacgaacatgtggtcgcccttggcgagctcccatgccagcacgacctgctggtagctcacgccgtgggccgccgcgacctcgcggaacgggtcgaacttggtctcatcataggggtgacggtagccgccgagcgggctccagcacacgaaggccaagccaaccttggcgcagtagtcgagcgtgtcctgggtctccaggtgaatcggcgagtactggttttgcacggccacgagcttgtcgcccagaatgccgcgcgcaatgtcgatttgctcgatggaggcgttggagataccggcctcctgcgccacgccctcgtccaccagctgcttgatggcttcgacggactcgttgtacggcaccttcggatcggggcggtggaagtacagcaggtcaatggtgtccacgccgagcgccagtgcgctctccttgccgcgacgaatcaggttctccgggcgaccgtccacatcccacgtggggcggccgtcggtgaagttgcggaagtggcccaccttggtggccaccagcacctcgtccttcggccccttccaggtctcaagggcctcgcgcaccagcttttcaccggtctgttcttcgccgccggagcagtagtaggcccaagcggtgtcgatgtgacggcagccggcgtccagcgaggcatgcagggtttcgatgccgacctcgtggccacgattgttttcgatggtcagcggcatttcgccgtggccgatggcggtggtggagaacggtccgaggttacggaacaatgccatggtgattcccttcaacagtaatgagacggtctgtgtccgattccagcgtaagcagaacgctggatttaccgcccgccgaacgagccgccacccgagccaccgaacgagccaccgaaaccggagccgccgcccgagccgaagctggagaaatcgccaccggaatcagcggatggtgctgccgcgctgatggtcgagctgatgtcagcgagtccggagttcagctgcgagccgaggtcggagaatccgccggcaaacgacgtgcctccgtaagccggagctgggccgctaatgcccgggtccatctgcccggcagcatcgtcattgtggcggtggctgtaccagccatacgggcggtagttccagtagaacaacgagttggaggcgttggcatccagccaagccggatcgttgacctgaggataggccttggccagctcacgcatcacgcgatcggaaatgccaaacgcggcggcgtagaccatataccaatcccacaaggccaaatcggcggcaccacggtcggtgaagttggagaagtcttccatataacgcttaaggcccagagtccggccggcaatatcctggccttggtcggtgagcacggtcatcgcgccggccatcgagcagaacaggccgaccaggaatatcggcagctcgataagaccagccaccgggtatccgataaagctgttggccagcagcgaaccaaatcccagcacggcggccaatacgccgggtaggatccattgccagcccacagagcgcgtggcacccagccgctggtattccatgctgcatgcaccggtgaatttgccgagctcaatatagccgtcttgccaattctggcaggtcgccttcatctggttcaggtcgaataccgggctgcccacgcgctgcgaaatgacgatgagcaggttcagcagcgcatcttccgattcactcaatcccaactgttgcgcgttgggtgcctcatcaatggcgagcggcagaatcacgatggtgctggtgatgcctgccgcatactgcttgccttggtcggcggcaatcatttggctcaagcctaccggcgtggcctggctcatgtcgatgccgcgatacatgtccgacggccccggatagacggcaatggccttcttgacggcgagcgacagcatggtggcggtcagctggcggtcttcatcggattggcgcgtcgacggatcgaccacgcgaatcagacgggctgcggaagccggactgatgccgggctggtcgcgccagtattcgacgctgccacggtattgcgcacgccggttgctggagatcacagcccagataccccacgcgcacaacgcgatgccgagcacgatgctgacaatccaggacacgagacgagctctggcagcgaatcgttgcttgtcgagccagcgctgctgttgcttatattcgtcctgtttcaggtccttgagatgattgccggttcccttgcgggcgatgcccttggctttggcggcatcgaacgccgcgaccacatcgaggtagtcgccattgtggatgttgtaggccgtgaacgtgtagctgccgtcgctgttgcgcttggtttccgaagtgcgctcggtgtgcagccatgcccatgaggttttgccggtgatgccgttggggaagtggacggtgccggtgaccgtgccgataggcacttggttcttcttgccgaacggctcccattggaaggaggccacgtctttccatttggtggccacatcgtgcatggtgaagctcacgtcgaacttcatactgtcggcctcggtggtgaccggaatattccagccgatctccacggtcatgttatcttcggtggcggaggcgctgggcttgaggccatcggtaccgggcgtgtatgcctttggatggtcgctgccatcgctcacatcggcgatataccaatggttggcgtagtcactgttccattccttgtcggaagagacgtcactgggcagcttgggctcgctctgttgggcatagtcgatgccgtctgtgacgttgcgcacactgatatcgctgatatcagtcagggtgccggagttcagcgtgtattgctgaaacagttgcttccacggcttggtgttgtcgtcactgtcggtacgttcacgcatcttgacgtcgatatgctgcgtgaccttcaaatcaccgttcgcggtggcggtcacatcatagtccagcgtgcggtagctgaggtcggccgaatcgccgaacgcggaagtcccgattatcgccaaggtgataactgccaacaccaccgtggcaacaatgctgacgattccggcgcgaatgaatcgcatccacatatcttccctctcttaaggcaatacgggcccggccggcggcataccggacgggcctggagcgggtcagaactggacctgtggcacctgacgggaggcatcatcggcctcgaagtattgcgcctgttcaaagtggaacaaaccggcgatgatattcgtcggcacggtttcgatggcggtgttgagcttcaggaccacgtcgttgtagatctgacgggcgtaggcgatcttgttctccagttccttgagctggttctgcagatccatgaagttctggttggcttgcagctgcggatatgcctcagccgtggcttgcaggttgaacagggcgcgggacagctggttttcagcggcggcgcgctgagcagtggtcgtgctcgggttgctggccgcagccactacgccggcgcgggcggcggtcacctgagtgaagacttcagactcgtgggatgcgtaccccttgacggtattcaccaggttcgggatgaggtcggcgcgctgcttcaactgcacgtcgatttgcgcccaaccgttcttcacacggttcttcagcgtcaccaggttgttataggcgctgacgccccaaccaatcaagacaacgataataacgacaacgacgatgctgacgatcagaccagtactcacctatgctcctttgctggacctcgctgcgaccattcttccatactcgcacgttaacagaaaatttatcacggagtattcatcgtgcggacttgtcttgtaccgctttacccgccgttctcccgtcgatcgaccgaagcgggaagtcgccgcccagtccgacaaagtattccagctcgctccgttgcgagaacgataatactcggcaatactcgcgttgaatatgcgaaagcccgccttgcggcgggctttgccgtttctcctacgcacaaatcattacgctgcgcgcaggaaacgatcagccgaaccttccagagatgtagcgctcggcttcttcgttttgcgggttgttgaacatcgtgatggtgtccgcgaagtactcgaggtgaccgggctggcccactgccttcaggttgaagaaggcggtgtagtcggcgatacgggcggcctgctgcatgttgtgggtcacgatcacgatggtgtagtcgctcttgagctcgttgatcagatcctcgacagccaaggtcgaaatcgggtccaaggcggagcagggctcatccatgagcagcacctgcgggtggacggccacggcgcgggcgatgcacagacgctgctgctggccaccggacaagccgatgccagggttgtcaagacggtccttgacctcttcccagaggttggcaccgcgcagagcccactcgaccagatcgtcggcgtcggacttggccaggtggtggttgttcaggcgcacaccggccagcacgttctcacggatggacatggtcgggaacgggttcggtcgctggaagaccatgccgacgtcgcggcgcacggccaccggatccacgtccttgtcgtacaggttcttgccttcgagcagcacctcgccctcgacgtgagcgccagggatgatctcgtgcatacggtccaaggtgcgcagcacggtggacttgccgcagccggacgggccgatgaaggaggtgaccttgttcggctcgatgttgatgttcacatcttccacggccagaaagtcgccgtagtagatgttttcgtggttgacgtcaatacgttgtcccatgatgtttccttatatttccttgtgttcttaaggcttaggcttagcgactggcttagcgttcggtcttgacggcgaagaccttcgccacgattcggccaatgaggttcagcagcagcacgatgacgatcagcacgagagccgcagcccacgcacgttccatcggaatcgtggtcacgcaggtggcgtcggcgttgggcgggcagttcgcgctgagcttcgagtactcctggtagacgaacaccggcagggtggtcatctggccggagaacaggttcacgttggtgctggagatgtagccggcggtcatcagcaacggtgcggtctcaccaatcacgcgggcgatggccagaatggcaccggagacgatgcccggcagagcggtgcgcagcacgatcttggtaatcgtgcgctgcttggtaacgcccagagccaaggaagcctcacgcaaatcgttcggcacgatcttgagcatttcctcgctggacttgaccacggtgggcaacatcagcagggagagagccacggagccttcgaaaccgttgatggtaccggggcccagcagaatcgtgaacatcgagaaggcgaacaggccggccacgatggacgggatgccgctcatcacgtcgacgagcagggagaccgtggtggcgagcttgccgcggttcgagtattcgaccaggtacacggcgcacatcaaaccgatcggaatggagataaccatagcgccagcggtgatttcgagagtaccgatgatggcgtgcagcacaccgccgtaaccaccggacggggtctggttaccaccgaccacaccggtcatgttgtagctcaggaagttcaggttcaggcgcttgatgccgttgacgatagtggtccacagcagggagatcagcgggatgcaggcgatcacaaacgccaccgcgatcaggacccacatgaagtggtccatgatattacggcgctggatggcggaacgggtcgggcggaaacgatcgaagtcgatttcgggcgcgccgtccatcggagtcttttcagtgttctcagcagcagtcatcacgcagtcgctttctcggtaagcttacgggcgatgaagttgaccacgaacgtgatcaggaacagaatcagaccagttccgatcagcgtggagacgcccagatcgttggcttcagggtactgtgcggcaatattcgcggcgatggtctggttctgcgaggcctgcagcagcttgatggagtagttgaggcccggggacaggatcatcaacacggccatcgtctcaccaagcgcgcggccgagagccagcatggaggcggacacgataccggacttgccgaagggcagcacggccagacgaatcatctcccacttggtggcgccgagcgccagcgcggcctcttcgtgcaggcgtggggtctgcatgaagatatcgcgggacatggaggtgataatcggcaaaatcataacggcgagcaccacagccacggtggcgacggtgcgcggcgggttggcggccgggccctcgaacagtggaatgaagcccaggtggttggcaacccagttccagaacgggtagatggccggcaccagaatcaggccgccccacaaaccgtagataacggacgggatggcagccagcaaatcgaccacatagctcagcgcggtggcgagcttcttaggcgcataatgcgaaatgaacagcgcaatgccgatggacacgaagaaggcaatcagcagtgccagcaaagacacgagcacagtaccgaacaacagcgggagcacgtagccccagaagctgctggccttgccgccggtaaagctggacacggtctggctgttggcggcctgatcgccaccgatgagtggccaggcgcggaagaacaggaacaggaacacagcggcaagtacaaccaggatcaggatgccgcaggcgtatgccacaccgcgaaacaccttgtcggcggtcttgccaccaactggctgcacagccgttttgtcttgcgaactcacggattctccttatatagggtggttatcaagtattcaagtggtgcggttttcgtctgtgacgttgccaaaccgttcgggtcctgacccgctttaagccgcagccgtatggtttacgactgcggcttaaagttggcggcgactgctcttactactacagtctatcgttcagttgtcaggtccagtccacacgacccttgcgggccgacgtcatcacttggtcttgatggcctcgatggacttggtgatctcggacttcagggaggagggcagcggagcggtgccggcggcatcctgagcggccttctggccctcgtcggaggtcacgtaggtcagccaagccttggcgaactcagcctgcttggtgtccttgtaggccgggcagacgatgtcgtaggagaccaggacaatcgggtaagcgccctcggcctcggtggcgtggttgatcttgatgacgatgcggttgtcacccttaacggtgtcgtcctgcttggaatccccaatgaccttggagccggcctcggcggaaatctcgttgtacttgtcgccgaccttgacggccacggtgcccaggtcgccgacctgagagaagtcagcgtagccgatggtgccgtcggcctgcttgacggtggagatcacgccagaagtgcccttggcaccctggccaacctcgttcggccagttctcggagaggtcgtaggtccagttgtcaggggtgacgtccttgaagtaggagacgaagttctgggtggtgccggacttatcggagcggtgcaccacggtgatggcggtgtcgggcagcttcaggtccttgttctgatcggcgatggccggatcgttccacttggtgatcttgccgtcgaagatcttggcgatggtggcagcgtccatgttgatgtgcttgccggcatcggaaacgcccttgaggttgaaaaccacggcgatcggggagatgtagaccgggacatcgaaggcggtgccttcagtgcacacggacttggactgctcaacttcgtcatcggcaagggccttgtcggagccggcccaagcggtggcaccggtcaggaaggtctgcacgccagcgccggaaccggacgggttgtaggcgatcttggcctcagggttggtgccctggaagccggcgatccaagcttcaacagcggcctgctgagaggaggcgccggcgcccgagaagttgccggagatcggggtggacttggaagtggaatcggaggaggagctgttgtcggtcgtggtggcggtgttatcgccgcaggcggccacggaagcgagcatcacaatgccggacagagcggcaatggagcgaacgaggatgttcttctgcatgattattacttaatccctctatcaactattcgcgggcggctcagcgctgcccggtcaattcatgacaactacaagcgtattggtggtttcaagggcccaaaaccgaaatcagtaaacagaagatgaacacttggatgtttgtgggctacgttgaggctacgtagtttttggagcgggctcgcctgcggcgagtccacagcgagcccacaatccacaacaaaaaaaggcgacccgaaggccgccttccatttactccgcgggagtatcgatcttgtatccgagaccgcgcacggtagtcagatacttggggtgcgccggatcttcctcgatcttggagcgcacgcgcttgacatgcacgtcgagcgtcttggtgtcgcccacataatccgaaccccagatgcggtcgatcagctggtgacgcgtcatcacacggcccttgttctgcatgaggtattcgagcagttcgaattccttgagcgggaagaacacggtttcgccgcgtacggtgacctgatgctggccaacctgcatggcgatatcgccacacaccagcggaatatcgtcatccacagtgccggaagcctgggcagtggcctgattgcgacgcatcacggcacgaatacgtgccagcagctcacggaaagagtacggcttggtcacataatcgtccgcaccaatctcaaggccaacgaccttatcgatttcggcgctcttggcggtgagcataataatcggcacacggctctgctcacgaatgcggcggcacagtgcagtgccgtcaatgcccggcagcatcaaatcaagcagcaccaaatcgatgccgcccttggtgaacagttccagaccttcctcgccagtggcggcggcggacacgtcgtacccctcgcgtgtgagctggtataccagcggctcgcgataggattcctcgtcttcgacgataagaatgcgtgtcatagtagcctttcttgggtatgttcccgtgcgcataggcgcaaagttttccgacattatcgtaaccatttgttctccgttagcctgctgtttcccgaaagtacgtaattgcgtaattgggctacgcgcggtgtgcgcacctcgcccactgtgtgattgtgtggcaatggaatggcaccatgtcgggcaccaaccaaggccctacgcttgtgtcgactcgtccgaccgggcctcgtcgtcatcctcatccggggcggccggcagctcgatggtgaacgtcgacccctcccccgtacgcgaccagaccgaaatccgaccgccgttctcctgcacgcagtgcttggtgatggccaagccgagtcccgaaccgccggtctcgcgcgaacgggccgggtcgacccggtagaatcgctcgaaaatgcggtccagcgatttggcggggatgccgatgccctgatcgaccacgcgaatggtgactttgccatcgcgctcccccacgccgaccgccacagtggtgtgttcgggcgagtaatggatggcgttctctacgaggttcttgacggcggtttgcatggcctctttgtcggccttgatcatcggaccgttcgtggctgggctgcctgattcttccaaggaaccttcgccatcggccggctcctcgaccttcgtgggtactgactgtccgttgacactcagtcggatatccacatggcgggagtcggcttgggtctgattggcggcgatggcggcgcgtgccacatccagcgcggaaatgcgccgcgcatcgatcacgctttgcgggctttgggctttctgcaagtcgataagatgatgcaccagttcggtcaggcgcgcggattccttggagatacggccggaaaaataccgtacggcgtccggatcatcggcggcgtcggtcacggtttcggccagtagcgcgatggcaccggccggagtcttgagttcgtgcgaaacgttggtcacaaagtcacggcggacggcctcgaaacggcgctgctcggacatgtcgttgatgaagatggcgtacaggtcatcgccgatatcgccaatgcgcacacgcaaatacagcgtgttggacgggcgtgactggccggcctccagtcctcggccattagaggacggataggaattgcgattgaccggcagctgaacctcacgctcacgcatgccaccgtcggcggcggcctgagtgaggatgtcctcgacttcacgcgagttgagtcggtcgccggagactaggccgaatggcactgagccgggacttgaatattggaccagaccgttgcggtcggtgacgatcagggcttcgggcaggacttcaatcaggcgacgctcggtggggcgcacgggcgcatcatcaccgaatagagaatgcgtatcctcgtcgccggacaggtcctgttcggcggcgagccggcctgaaacgcggcctttgttgtaggcgatgacggcaacccacaccagtatcagcgcggcgagcaccacaatcacgacgatctgccagatatccatgatttccagagtaaaacgtgcgaggcgtagtgagatgcctaaactacgtaagttcgtctattgttcatttttggcgggacgacataacaaaatgctcccgctggcgggagcataatatggggagctctatttacagctcgtagtccttgtccttgctttccttgatcaggaacagagcgagcagagcgagggcagtcatgatggccatgtaccagcccacaccggcaacgccgaacttggaggtgaccagttacaggcgcttgacgatgtcgacagccagacgggcggcggtatcggcgtattcggagatgtcgaactccttgaatacctcgtaatcggtgtcggcgttgtcggaaagggcacgaatcaccagtgccggcacgttattgcgggcggcgacctgtgccacggcggcgccttccatctccacggcgtcagccccggtgagtcggatgacctcctcgaccttttggggcgtgtccacgaagtagttgccggaggcgatgatgccggtgatgtgggtaatgcccgcattggcaagcgcctcgtcggcgacttccagcagacggtcatcagagtggaattcctccaccggagcgtccgcagtgccgggcttccactggcctacgagccgcatgtcagtgtcgaggtagcgcagggtgccgccgagcaccacgtcgttgatgtgcaggtgggtgttgaggttgccggcgatgccgctgaaaatcacggcgtccggggcaatctcgtcaatcagcagctgcgtggtggcggccgcattgaccagtcccatgccgcctaccgttgcggcaaccttgatgacgtcagaaccgaaggagtcgaccgtgccggacacgatgtcaaggctgcccttggcggtgtgcgtcacatgcgtgagcgatttggcgatcagcgccacttcctcatccaatgcgccaataatagctacagttttcatacccatacgtaagttcctttcacaacactttcggctccccttgtcaggggaggtggccgccgaatggcaggctgaggggtagagacgtttcgttgcattgctcccgcgagagagccgatgacgcaactcagtgccaacgccgtgtggctacggcttccgcaagctcgcgcagcaaggcctcggtttcttcccagctgatgcacttgtcagtaatcgacttgccatagaccagctgatcaagcggcgcggccttctgattgcctccttcaataaagctttccatcatgatgccggtaataccctgttcgccagctgcaattctgctggcaatattgcgcacgacttcggcctgacgatgttcgtccttgccggagttaccgtgcgagcaatcaacaatcagaccatgcgaggctgcggattcggcgggcatttcggcgcgtacgtcttccatggctttggccacggattcggcatcgtagttcgggccgtgaatcgagccgcgcaacaccacatggcagtccgggttgccaagggtctcgactgcgcaggcacgccccagatggtcaatgccgaagaacgtgtgctgctgagcagcggcgaagcaaccgttgaccgctgccttcaccgagccgtcagtggcattcttaaagccgaccggcatggaaagcccgctggccaattggcggtggatctggctttccgtgttgcgcgcaccaatggcgccccaactcaccgcgtccgagatgaactgcgggctggtgggctccagaaattccgtggcggccgccaatccttccttcagcacaccaagcaaggttttgcgagcaagcaacaggcccttgcgaatattgtggctgccatcaatatccgggtcgttgatcaggcccttccagccaatggtagtgcgcggcttctcgaagtacacgcgcatgacgatgagcaactgttcaccgagctcatctttcagcttggccaatcggcgcgcgtagtccagcgcggccttcgggtcatgaaccgaacaggggccgacgatgaccaacagcctgtcgtcttggccgtacaggcacgcgcgaatctcatcacgcgagtaggcgacgatttcctgagcctgatcagtcagcgggagttcagcgagcacttgcgcgggcgtgggcagcggctccaactccaatacgcggcggttgatgatgcgactgacacccacctgatcttcccaacgcggcacatcagtggcaacgagcgggttcttcccctcccccatcgcctgacgaatggcgcgaagctcttctggggtgttcaacggctgcggaccgacttgcaacggatgcagcgaatgtgctgcttcctcctgctgctgcataacatctctccttgggtcagtatccttcccaaggataaggtgtcacgggaacaaactgacatgaccaccgttattggcaaaaaatgctcactgagtgggtctcagtgagcatttttacaaagacaaagctatttagccgagcggcgagcggtgacggcgtcggctagggtgtgcagcagttcgttggtgcgttcccacggcacgcaagagtcggtgacggactgaccgtagaccaactggtcgagcggggccggcttttggtgaccgccgaccaagaagctttccatcattacgccggtgatgccttgttcgccgtgcgccaggcgctcagcgatctcttcgatgacttcggcttcgcggttttcgtctttgccgcagttgccgtgggcggcatcgatgacgaggccatgctggctcgggccggacgctttggaaaccttgaggtcttccagagcttgacgcacagattcggcatcgtagttcgggccgtggctggagccgcgcagaaccagatggcaatccgggttgcctttggtttcggcggaaatcacgcgaccgtccaagttaatggacaggaagtgatgctcgaagccggccgcgaaacaggaatcggcggcggccttgatggagccgtcggtggagttcttgaagcccaccggcatggacaggccactggccagttcgcggtggacttgggattcggtgttacgcgcgccgatggcaccccagctgatcgcgtcgcagatgtactgcggggtgatggggtcaagccattcggtggcggcgggcaggccgaggctcagcacgtcggtgagcaccttgcgggccagccacatgcccttacgaatattgaagcgaccgtccagatcggggtcgttgatgaggcctttccagccgatggtggtgcgcggcttctcgaagtacacgcgcatcacgatcacgagtcggtcttccaactcgcgcttgacggcagccagcttttctgcgtactcgtgcgcggccttcgggtcgtggattgagcaggggcccacgatgacgagcagtcggtcgtcgcggccgttgagcacatcgcggatttcctgccgcgagtggagcacgagctcgctcatctcatcggtgagcggctgctccctgaggaaagcacgcggcgcgggaatggggtcaagctgacgaatgttgacatcgacggtctcaggaaagacggcctgctcccccaaacgacgttcatcctcggaactatccggaccacgtagtgctgccattgctcgactcctttccttgtatacgtactgtcggtatgtcgccatagacgcaaaagcccaactatagcagtttgttacggggactgcttgttgggccggcagttatggactttgggtggactcgcctgtgtggactcgcctgcggcgatgctgtgttgttgtgcggcctgcgaccgcggtctctccctctgtcagcggcttcgcgctgacagagggagagaccctagcagccgacaggctgcgagaaaacacagcattggccgtcaggccgattccgggaggctgacgaagtcaggccaaagcgcccatcggatcccatgcggggagcatggtggctggctcttcgagggccttctggtattcctcgggcaacagggccttcgggacggctacctcgtagacgtattcggtgaaccagtcgtcggacatggtgaagtagcccttgtcggcgatcttggcgccccaagagttctccacgcgccagcggcgggtggtgccgtcgtcggccacgtcaacgccggcgaaagccatggcatggttcatggcggagtcgccgaagcgcacgcgggcttccttgtccaaatcgaagtccacgtcgtacacgcggccgtactcgaacaggtcggtggcccaagcgccgttctcacggtccatgaacgggtggcagtcggcaccgaaccataccggaatgccctgctcaacgagaatctgcttgacgcagtccttcatgaactggtttggcacgttgaggtactcggtggcgtcgccgccagccacattgccgaggtgctcgatgccgatcttcttgcccttggcgtgctcggtgcgcggatcgtccaccaggcacacgtagtcctcaagatcagccggacccacgtacttcttccagaactcaaccggcgtaatctcgccgtcgcggtggaattcgccatccttgtcggtccattcccagtcgaaggaaaccggcggctcgcccaggtggatggtcagaatacggtggccggcagcagtggcgtcggcaataatcgcctcgaccttggaggcatcgccgtcagcggcgtacatgtgcgccacggcggtgtgcagcatgtggcgcagctggatgttcatttcaccggtgttcttggaggattcggtctccgggaacaggtccttgggcacagcgccgtacttcttgtacacgttcatggccatggtccactggccgccatcgcccatcacgtcggcgagcaggtgctgcatcaggcgggagtcggaaggctctccggcagccaccagagcggccacatccttaaggaagtagttgacgcgctccagcttgtcgtagtacatcgcgtagttctgggagaactcgaactccttcaagttcatgttcttcttggccacgaaacgggccacgttcagggagctgaacagccagcagcggccggagcgatcctgatgggtggcttcgccattgtcaacgatggtggagaaacgacgctgcatcagacgagcgcggtcataattgcgagccaccttgtcgatgccggcggcggtcaccgcgttcatggccagacggttggtgccgctctgtgcgaaatcgccgcgcagggtattcaacgcttcaccggtcagaggcgtcaattcactcatgtcatactccttctgtgatggtgcgcttgtggcgcagattcaaacgaatacggcacctggctcgaaagcgcaggtgccgtaattcttaccgctagtagtctaatcgaaggcctgtcattcgccgttctgctcagatacggccggattctcctgagtcggggcctccggttcgccctgtgtctggtgctcggacggctcagacgattcggactgctcattctgcgcagccgaatcagccgaatcagccgaatcagccgaatcagccggtgccgcatctgtctcattgtgatcgtcggcagccgactcgtttccactcaactcacccggctggtcatcggcctcgttgtgtacaggcttgacttccgggacgggcgcaaccaccggcaatgccgccacggcagcggcttcctgatcctggccagaggccgccgcattaccgccgaaagcgaatccggagaacgcctgcgagaacatagaacgcagttccgaaacacgctgggtgatgacggactcgcgttcctgcagatcggcgatgcgcttggacagaccgtcaagctcgctttgggcggcggcgcgacgctcctcgatctgcgcatcggcttcctcgcccgccttatgtacgattgcggcggcctggatgtccgcctcctcgcgcttggacgcggcatacgaatcggcttggtcgcgagtgttcttggcctgaccgaccaactcatcggcttcccgcttggccgccacacgacgctcttcgaggtgctgcagcagttcgttgaccttcttcgtggcctcatcctgctgagcggcgatgtcgtgacggatctgctcgacctcggcgttgacctggctcatcgtgctggtgcgcttgacctcggcctcatcagtgatttcctgacccttggttttggccgcatcaatgatttcgctggccttgcgctgggcttcggtcatcatcttggacacttgctcgcgcacgtcggcgagcttcttgttggcctcggcgagcgccgcctcaatctgatcgttggaatcagacttaagcttggtgatctcctcattggcgcttttgcgcattgcggcaacctgctgggtcgcctccgccttcatgtcggcgatttcgcgctcttgagtggagcgttcggaagccatcttcttggtgtgctcttcgcgcgcgttgctgagctcaagctcgacggtctgacgctgttcggtgatggtcttggcagtttcggagcgcagttgtgcggcatcctcgttagcggaggtggtcactgattcggcctgattgctggcgttcgtcagaatcgaggcggccttggcattggcgtcgtcaacaatatgctgggcatccagcttggcgttgttgatcagtgtttcggcctgagcctgagccgtggtacggatggaggacgcgtcctgcttggcgcgttccagcagttcggtactcgtctgttcggcggaggcaagcatctgctgggcgttcgctcccaaggaagcgaagctgttgccttccggcttcttgttcttctcttcctgaagttgggcctgcagttgcagaatacggtcgtcatccgccgcaatctgctcacgcatgctggccaacgtctgctgcgcacgcttcatactctcctgagtagcgtcgaaggcagcatcaaccttctccttgtcatatcctcgcagcaccaccgggaaacgatccaccatcgctgtttattcctttcgcacacgcataaagctcttggcacatccttgaagcactgtagcgcatcgcactagcgctgagcgttgagcgacgcgcaatcgttacaatgcgtgcgaaccatgttctattccggcgtggcgcacagcgtgctaggcgatgaggatgtcggagctggagggcttgagatagtagcgcacggcttcgcgcaccacatcacggccagcggcgatctgctggtcgagtggtagaccatgctggctggaatgcgccggaacgaccggagggaagctgacgaatccgcccagcacctgctcctgggtggcggtccagttgagcaagttgtagaacagcgaattacatacgaacgtacctgcgtccgaactcaaggtggccggaatcgaatcgtccgtgaaatcattcaggatcgagcgcaacggcaggcgggtccaataggcggccgggccattgggatcgatgggttcgcggcgtgggatcacgttgtccgcgtctggcttgatcgcgtccatcaggttggtggcgcatcgttcaagcatcacgcctcgggctgcgtgcttgagcccggtggcgatgacgatattgggcttggtggcctcaatcgtctctttcagcgtgggccaggctttggcgaagctcaccgggatgctgacagcatgaacggtgacggcgacctgctccaacggatcgtccggagcagaggagacgcccagtccctgctcggcgatggccttgggcacttcgacggcgggattgacctccacgccgtcatagtggtcgaagccggagatcacaacattgagttcacgcataatgccagtctagcgatgcatctggccggccgcttgggccagcagggcgtgcatgcgggcgcgggcctcttccttgggatcacgaccgagaatctcctcggcgatacgctcagctgtgggaatatcttccagcgtggtgatcttcaggttggtttccgcaccggagacaatggcgacgggttcatcaggcagataatcgaccactacgcgcgtgtcgtcggtgggatggaagtccgggtcggcggcagccaaatcgtaagcgtgacgaatcgtcgcgaagcggaaggattgcggggtctgcgcgcggaaggtgttcgggcggtccggcaccgacttgaccactttcaaatcgcccagatcctcggtcaacagcacggtgtcggttgaggcgtaggccacggttgcggccgtgaactggtcgagcgcatcaatcgaaccgtcgatggcggactgttccacgaacggacggacggcgtcatggatcagaatcttggcatcgtccggaatgccagccgtagccagcatgtcgagcgcggtggcggtactgtccacacgctcgtcaccgccgtcaatgatgacgcggaccttggtgtagcccatctcgccaaccaacgtttccacttcaccgcgcaccttgggattgaccaccaccacgatgtcgctgacgcggtcgcaatgttcaaaggcatcaatgctccagcacacgatgggcttgccgcccacggagacaagctgcttgggattatcggggtcgaagcgcgtaccgaagccggcggccagcaccacggccaccaccggcacggtttgcgccggtttggcgccctgagcgggggccggctggacggtaggcgtctcgacgggggtatcgaaatctctctcagtcataggcaccaccgtagggtgagggctggccgtccgtgaactgcatcacatcttctccacggaatgtgctcgcattctccgtttagtcacgcacgatgagggcgaggaggcggccttcgtgtgttttgttggcgagcgcggcgcggcggtgcgagtaccacagtgggttttcgagcgtgcacatgctgtggctgatgttgtcgatgcgctccgcgagctcggccgggccttcgccatccgtacggcacagttcggcgagttccgggtcttcctcaaggtactgggtggcggcgtgcacgcgcggcatcgaatcgaccacctgatgtacaccggcgaaagcgaggtcgatcatcgcggcttcggcgatgtcgatgccggcaccgccgaaacgggtcttcgtcttggtcagcgggaagcgcttgatgaactggtcggcgatctcgtcgcccacttcatagcagtcgccgcagatgcgcgggccgagtgtggccacgatgttcgccgggtcggcacccttgctcttcatcaggtccaccgtggcgccgatcacgccgcgctccagaccacgacggccgcagtgggccgcaccgatgataccggtgaccgggtcgcccagcagcaccggcagacagtcggccgcgaacatgcctagggcgatgccggattgtgcggtgacctggccgtccgcctcgatgacgtgcggagtgtcagtctcaccatgtgtgccggacacgtcgaagccgaagggggtgttgatgacgaacgagtcgtccacgtccacagccacgccggaatgtacttgggagaccagcgataggcgggcttgcaccgcttcggcgagtgcgatgcggttcgacagcacggcctcaggttcgtcgccggacttgccgccgaggttcaggttgccgtaatcgccggcgctcaggccgcccagtcgcgtggtgtacaccaccttgatgccgggggccagtgcgatggggatggtcaccggaatagggcgaccggctttatcggtagagctgatgctgttggaatcgaggatttcttcgctgtattcaggcataaggcattctttcttgggtgcgggcggtgttcatgattttcatgaccacccccccagtcagcgggggggcggagtggtaggttattcggctttgagggtgggctttttggtgcgcgagcggatggcggcgttgatgggcacctggtgcgggcagggcatcgagaacacgtgcgccggattattgatggcgggtactggcgcgccatcggcatcgcgcaggccggtttccggcacggtaaagaccaatggtctctcgccaggcagcaggaattcgacctgttgaccgggctcaatcttgttacggctcatcagcgtgacacgtccgtcttcgtccgcgctccagctcagcacttcgcccactaccagccatgagcggaagtaggcggagcggtcggtgttctgtgtgaccttgtgctccgggtaatagaagccggtggagtagtcgcggtgggccaccttgtcggtttcctcgagcagccattcgggcagttcgacgtgtggggccgggcgaacggccgcatgtttccaatcggtctcaatctgttcgaccgcggtgttggacttgcggcgcgtggaacgggcgtgagagctcatgccgtcgggttcgacggcggtgccggccggcgtaccagaggcagttgagtcgacggcatcagcaaccgtcacgcggtcacgttctgcggcaaccgagccggtgaccgaatcggcaaccgcagtatcagagccacggtcatatccctcatcggccacaccggcgaacgcggcatcagcattgcgcatcacttgatcttcggttccttggccaaaatcggggtcgcccgggcgaatcacacggtcatggaaaggcttcaaaacattgccatcagcgtcttcaaaaccgcgttgaatcatgtattcattaaccgcggttttgtaggcgttggtcatggcggcgatatagtaggcgcttttcgcgcggccttcgattttgaggctggtggcaccggagtcaatcaaatcatccaagtgccccagcatattcatgtcctgcgaattgaacagataggcgccgttctcggtctgctcgatcgggaagtactggccggggcgcttctcttccacgatcgaatacttccagcggcatggctgggcgcattcgccgtgattgccatcgcggccggtcagatagttggagaacaggcagcggccggagaaggccatgcacatagcaccgtggacgaagcattcgatgtcgaggtcatcgggaatgttggcgcgaatatcacgcacggcctgcaagtccatctcgcgggccaacaccacacggcgagcaccaagctcgtagaaggcgttcgcagcctgataattagtcacgccggcctgggtggagacgtgcagttccagattcggagccacctgacgggccatcatcatcacgccaatatcggagacgatcagcgcgtccacgccggtgtctttgagctggccgacgtactcgtgcatggcttcgatctcgttgttgcgcggcagcacgttgcaggtcacgtacacgcgagcgccgcgttcatgggcgtagcgcgatccttcctcgaaatcctcaaggctaaggtttttgggggccgatcgcatgccgaaggctttgccgccgcagtagacggcgtcggcaccataatcgaccacggttttcaggcccctcaggttgccggccggggacaacacttcgggctttttgcgggtggggaggttcatcgtcgtattcatcaccgcaatagtgtagtggtggccgtgtaatgcgggaggggctaccgttaggctggatgacatgaagatcgatatcgtgagcgtgttccccgaatactttgaggtgatgaacctcagcctgatgggcaaagcccaggccaagggattgttggagatcaaggcgcacaacctgcgcgactggacccacgatgtgcatcattcggtggatgatacgccagtcggcggcggggccggcatggtgatgaagcccgaagtgtggagcgaatgtctggacgaactgctgggattctcgcagccgtccggctcccccgccccatccggcgcaccggtgctcatcttcccgaacccatcggccccgttgttcacccagcgcgacgccaccgagctcagccatgccgaccatctgctgttcggctgcggccggtatgagggctacgatgcgcgcatcccggactactaccgcgcccaaggcgtcgacgtacgcgaatattcgatcggcgactatgtgctgaacggcggcgaagtagcggtatcggtgatgcttgaggccatcacccgcctgatgcccggattcatgggcaacccagattcgattgttgaggaatcctacaccggcgagggcgcactgcttgaacatcgccagtacaccaagccggccgtgtggcgcggtattgcggtgccggatgtgctgttgtccggcgaccacggcaaggtggaccgttttcgccgcgacgaagcgctggcccgcaccgccgagattcggccagaccttatcgcggcactggattgcaaggcgctggataaggccgatcgcaagaccctgatggccttgggctgggaggtctccgccgcccatccgcgccggctcgccgattaattcaccacacggtgggagattcactacgcggcggaatcgtcggaacgctctatatccgagtcgtcatccgcggattcgatgtagaagacggcggtttcgccgtagttgcggctttcggtgatttgccagcctccgggggcagtgggatcatccgagcgtaccgagcgttcgagcatgatcaccgtgttctcgttggtggcgctgcccgccgccagatcggacagtagctgattgcattcagcggtctcataggcatagggcgggtcgatgaatatcacgtcgaatggttcgccgaagccgccagccacttgctcggcttttttgaccagcacacgggccttgagcgaagcatcccacgaacgattcttctgtagctgcgccaaggtcttggtaatcagcgccgccgcaggccgggaactttccacggccacgagttctcgcgcgccacggctcagcgcttcgatgcccaacgcaccagtaccggcgaacaggtccagtacacgggcatcatccagcactccccatgagtcgaggtgcgagaaaatcgcctctttggtgcgatccgtggtaggccgggtacccgttttcggcgtagcaagcgccacacccttgaatcgtccagaaattacacgcatagctttcactgtacaggttcatctgcgcataccaatcatgaacaacaatggggtgctcgaagcgcaccaatgatatatgcacttcgagtacctcatgtacgaatggtcttgcctccactgaagcacattcgagggcttcccgaccgtgatttcctcacgatcggcatacggaaaaactatatcgtgcgattacgggggcgcagccctagcctcagctggaggtgcctcagctggaggtcaggaaggtttcgttgcctcgggtgaagtcgaggacggcaccggcgagttggacctcacctgccagttcggggtcggcggccagaagctgcccggcacgggtgcgggcgtcggcgatcatgtcggcgtccttgaccacgcgcaggagcttcaggctggacttgccgccggattgggcgtcgccgagcacatcgccggcaccgcggaattccaagtcggcttgggcgatttcggcaccgtcgagcgagtggtgaatcacttcgagccgttgctcggccggggagccgggttccgcacgggaaataaggaacgcccacgagttggtgccgccacgccccacgcggccgcgcagctgatgcagctgagagaggccgtatcggtcggcatcaaagatgacgatgcagctggcctgcttgacgtccacgccgacttcgatcaccgtggtggacaccaggatcggagtctcgccgccggcaaaatcggccatgacctgggttttgacgtcatccttgtcgcggccggtcagagtcgcaaaccgaatgccttggaactgtggaagtttctgcaaccggtcggcgatttcggccaccgcatgcaatggcgggcgagccacggtttcgccattttcgtcgaaggtttcgtaggggtcgtcgatgccgatggcatcggccgccgcgcgcgtcacacggccgcccgcagctgtgcgggcactggaaccagatgctgcggcgcgtccgcgggcagaaccggctgctgccgaaacgccggaaccgccttcgttctcctcatcatccgcatcaatgcgcgggcacacgatataggcccgctcccccgcgtcgactcgcgcgcgaatgtgcgcgaacatacgccccatggtggcggcgtcggcctcattgaccaccacggtacgaatcggtttgcggccgccaggcaattcggtgagccaggaaatatcgagatcgccaaaccaagtcatggcggcggtgcgcgggatgggcgtggcggtcatcaccagtagatgcggcgtggtgccgtcatcggttttggcgttgaggctttcgcgctgttccacaccgaaccggtgttgctcgtcgatcaccaccaaggccaagtgcggggcttggaaggtcttggaaaacgccgcgtgcgtggccacgataatgcccggctcaccactggcggccgcagcgagcgccttacgccgggcggcaagcttcataccaccggtcagcagggtgacgggaatttccgcagtcaccttggaagaagagaccgtcgaagcaccggacgcgcccatcgcgccctcaacgtcggccgcggcatcggtctccttggcacccggctgtgcaagggtcaaccccgacaccatcttgctgatggtctcgtaatgctgttcggcaagcacctgagtgggagccaccagcaccgcctgatagccggcgccgaccgcctgcagcatggccgcgagcgccactacggttttgccggagccgacttcgccctgcaacagacgctgcatgggccagtcacgttcaagatcggacgcgatgtcgtccaccacctgactctgcccggctgtcagtgtgaacggcaacgatgcgatgaagcggtcgcgcaaattgggcaaattgggcagatcaggcagatcggtcgcagaaccgcgctccgatgcttctggttgcgtacttggctccgcaaccgcttcgcccaccgacgctcgagctgtttccagcgcctcgttcagcgggcaaggatgcgccgatgacttgtgcgcgtgctgtcgagacttcagcagcgaggtctgcgaaacgaaagcctcctcatagcgcagggtttcgatggcctccttgaaccgggccgtggaggccggatcatgaatggccaggaacgcctcagcccgatgcatgaggttcttggccttgcgcaccgattcgggcagcacatctgggatggattgggagagcgcctcagcaccggattcggcggtcgtgccggacttctcttccccgttttggacggcgatggtgtcagtcgcgggagccacaatgccggctgccccagcgccagcgagttgcccgtcaggcgtggatgacgtgcgggcccccatcatccacagcaatcccagaatcgtctcatgaatatgttcggacgagatacgcgaactggcgtgatataccgggcggggccggcagacgcgggtaagcgcctcttgcacggtatcggcgtcgtatttcaacgcggccccggaaggggcagtcgcggccggcggatacgcggactgcgcactggcatacggatcggcacttcccgcaaacgcaccattgccggatgccgcgccccgagcgtaaccctcaagccccgctcctgctccggccggcacgggcgcgacagtgaggatttcgggatgggtgaactgcagctgacccatgtattcgccgggcataccggagaccaccacagacgtgccggcgcgcagtcgcacgctgacccaatccacatacgatttacgatacgagaagaacgtgagccgggccgtactgccgggtacgcgacgagaccgggcgaagtcggcgtcatcgaccgtcgcttcgagtcggtagccgcggcgagcgttcatcggcaccacgcgcatatctcgtatcacggcggcaaatgccatctgctggccgggtgcggcctcgcggatggcgcgaagcggcaccggttcggtgacgcggaaaggatagtaggtcagggcgtcgccgacagtgacgattcccagcgatttgagcgcggacacgcgacgcttgttggtgaccagcgaagcgagagtggtgcccatagtgatgctcatattggcctattctattcgcacggcctctttaggccgcagaaacaacaaaacccgccaagccgaagctcaaacgggttttgctccacgttagtacgcgattcacgcggccacgcgctgaaccttgccagccttgaggcacttgacgcacacgcgcaggcgagtgttctcgccatcaatcgtggtgcgcacagactgcaggttcgggcggaagctacgcttggtacgacggtgcgaatgggaaacggtgaaaccggtctgcggtcccttgccgcacactgcgcaacgagctgccatgatggactcccttaaccttgatgtgtcaagtctttcacgcattcgaccgccggtttcacccgacatgccgaacacacaacttcacaaatatatagcccaataccgacaaccgcaactcttgcgtgtatcatgggcgaacctcggcggttcacgcgcggttcgagcgtaacttgcgagtgggccatcagcggttcacgagcggctcggcattggttcgccagcggtccgcaagtagttcgtcagcagttcgccagcggcgaattacgctgcaaatcatagcgtttacccgataaaacacgccggccttccttttccgcatccagcaaactctcatataatctcggtataagagacggcaagggacgaaggggtcctcgtgcaacttacgacgaaggaggctgtcatgttgaatctcaagcgaggtatcggcactcacgagcccagcgtgatttcactggggcaagtctgggtggacattatgctcaatgtggacaaggtgccggcacagggcggattcgccgtggccgatcatccgaagccctccattggcggcagctatcgcgtgctgcaggcggccagccgcatgggcgtgccgaccgagcacgccggcattctgggcaacggcctgtgggcgcatttcatccgccagtcattccaagacaacggcattacgcatatcggccaggatcgtcttgatgaggattccggcttccgcgtggtgctgagctccggcgcgccgaagaagacattcatcgcttcctatggcgccgaggctcatggcgactcggacacgttcgacacgctggagccgcagcccaaagacgtggtgcacatcagcggcaacacactgatggaccacacggccaccggcgtggacggattcctgctcaaggccggtaccgacccggctgcacgcgactacacgctggtgatcaaccccaccaatacgttgcgtttggtcaacgaccatatgcttgaggacctggtgctcgcacgcccggtctggtcctgcaaccgtcaggaggccatgacgctggccgagcgacttggtgcgccaatcgacgacagcaaagtcaccattggcggcggacttgacgacttcatgcaccagttgtgcgacggcttgggcgctacactgcgcgcgccgctggtggtgcgtgtcggcgcccgcggcgcttggattcgtgagccaggtggcgagacgattcatatcgagggatacccgaccaaggccgtacacacccgttcggcgggcggttgccacaccggcgtgatgtgcgcgatgctggcaaagggccatagtctggccgaatcggtaaagatcgccaacgcggcggcatccatcgccatccagcacagcctcaacggcgtgccgcaatgccccgattacgacgaggccatcgcgctgatcggcgaatagtcgactataggtagctccccccagtccgcttcgcggccagctcccctcagcgaggggagctatttttgctctggctccccttagaaagaggcccggcattattcatccgccgttcaaccggaatggctcccctaccctagtccgcgcttctacgatagattgagttgaatactgtcgaggagtgtatatgactgatcccacgaatgtccacgaaccggtgccgcaaagcgccaaactgaccgcccgcgagaagaagtggatcatctacgacgtcggcaactcggcattcgtgctgctgtccaccgccgtcatccccatttacgccaaatcgctgatgccggcggacggcgacatcgtgtccgcctggggctacgcgcaaaccattgcttccttggtcatcgcgctgctcatgccgttgctcggctccatcgccgacgtgcaaggcatgaaaatcaagttcttccttggcttcttcggcactggcgtggtcacctgctgcgcaatggccctgcccctgacctggctaccgttcctagtcgtctacattctggcgaccatcggcctcaacggctcgctaacgttctacgattcgatgctcatcgacgccacctcgaacgagcgcatggacaaggtctcctcgcatggctacggctggggctacatcggctccaccgtgccgttcatcttctgcatcgcgctgatcttcggcggcccgtcgctcttcgactggtccacggtggcttgcacgcgcgcctcgttcatcatcaccgccatctggtgggtggcattcaccatcccgctgcttaccagctaccgccaagtgcactatcgcgccacccgtgaccagctgggctcggccgtgcgcggcacgttcagcgaactggcgggcacgttcggcaaaatcgtgaagaacaagccgttgtggatgttcatgatcgcgttcttcttctacatcgatgccgtgaacacggtgatttcgatgagtacctcctacggtgccgagcttggcatcgactccacccagctggtggtggcactgctcgtcacgcagttcgtggccttcccctgcgcgattctctacggtcgtttggccggccggttcggctgcaaagtgatgatcacggcggcggtcgtggcatacatgtgcatcgtgttcttcgccgcgttcttcctgaagtcggccgtggagttctggattctggcgattctggtcggcatgttccagggcggcatccaggcgctctcccgctcgtactacggcaagatcatccccaaggatcacgccaacgagtactacggcttctacgatatcttcggcaagaccgcctcgatcatcggcaccttcctggtggccaccaccacgtccctgaccggcaacgcctcgctcggcgtgctctccatcgccgtcctgctcgtcgcggcactcgtcttcctgctcctgcaaaaggacccgacgcgggagtgatttgccggccctcggcaactctgtgccgagggcgacatctcgcagcatagaaatcctcgacatagggatgccgccgtttgaagtcggtatgtgacatgccgcccggaatcagcatcgccagcccgataatcacgcccacgcagatgcccaggaatgtcagaaaatcgttgagtggcgtcacgccgagaatggaattatcggaatcgaacaggttgccgatgccggctcccgcgataatcgccgcgacaccgccggcaatcagtagcgcgaatcggcagcggtgttcatcgtagccggtcagatcctgcggtaaggcagccacattagccagcgtgccgggacgtgatgaactggttccgtgcaacatttcgccgggcaatgcatttgcggagctcgggccattgatgccgtcaccgccggaccgcgctgattcaccgatgttcccatcagcatccttcatatacgcgggttccccggctccctccccggttacggttctggcagccgagccatggtcgccctccgctgcgccgcgcgcggccgcacccacgttcacgctcgcactcacatcgccaagtaccaggtcatcaagcgtgcaaccgaacaggtcgcagatcataagcagcttgtccatctcgggataggccttctcggattcccatttggagatggcctggcgcgagacgccgagcaacatggccagctgttcctggggcatgttgcgttgtgcgcgcaggtattgcaggttggcgcggaagctcatcggagtgtcccttcataggtaatgctcatcatgacatattcggccgatgccctcactatgccacggcaaaccagttccgcgccaccatcttcaggttgcatattcgcgcgcaaccacaggttgcatcggcggaatcccgccattctgccggctccgcggcattctagcccgcaccccgattggaccggcataatcggaatacatcgattatgaaaaaacgctcgcggccacatggccaacgagcgtgaatctcgggtgggcgatgtaggaatcgaacctacgaccccttcggtgtgaacgaagtgcgctagccgctgcgccaatcgcccgagcctgtgatgaaaaaaccggcaacattctgccggcgattcatcgagtgggcgatacaagattcgaacttgtgaccccttccgtgtcagggaagtgcgctaccactgcgccaaccgcccgggtcatcatccggtcgaatcaatcagcatgaatcaaccatccgagagcggacaacgggactcgaacccgcggtctcaaccttggcaaggttgcgctttaccaactaagctatgtccgcatgtgttaccttcacaggcaacaggtgacaaagatacgccaatctcaggaaaaagccaagcccccgcgtgtcccaccggttttccaacgattatcgagcgccgaagtgaagttcccgaactacgccgacgtgccgtccttcatggaatcaggcacggtatgggcttcatccctcaacgcgcgataatggcggtatgacgcaacgacaactgatgcgggccacagtcgaaacgcccatcggccggatgatgatggcctccgacggcgagggacttaccgaactctgtcttgaagactggtggtgggccaccgatcaccaagccgttctcgattcgaatcgcgaatccgatagtgaacccgacgtattccgcataacccgcgaatggctgaccgcctatttcgccggcgaacgccccggctcggatcaggtgccgcctttgcatcccgccggcacgccattccaacatgaagtgtggaatctggtggccgaaatcccctatggcatgacggtaagttacggcgaactcgccgccgaattggccgaacgacgcggcggcggccgcatggccgcgcaggcggtcggaggcgcagtgaagcgcaatccggttaccatcatcgtgccctgccaccgcgtagtcggctcgggccgcgcgtttggcggctacggcggccgactcgacatcaaggccgagttgcttgaactcgagggcgtggatctggcgcgcttcgatctgccgaacctttgacgggcccagcggtccgcctcgtcaaaaaggattgagtggttaaccctcccgccggcgggagatggcgcgtagcgccggagggtggtcggctggctggcatcgcaaccctgctacccgacaattttcgacaagccgacgggaatccttccacgaattgttcgccgtcggtgcagtcttgctcgatcgcgccggccaaaaccgtacaatccctacaatggaatgcatatggttaattgctgcgcgcagccgcacggccgcacgcgatcgcaagaccacgcagcccaaggggatatgcaatatcaacggaagcaggaggtgcgcatgaccggcattatcgattacgcgcacaccgaaacgcgctccttcgccgacttgccgttcaacgaaatcgacgccttgatcatctccacgctcatctatgaggatgtggccagtgtctgtccgacgttgatgctggatgagacgcggtcaggctcgttcgccgcacgcattcgcgctttcgaacccaagcatccactgatctggctgaagggtatctggcatcccgagcttgaatcggtaagccttgacgaggccaaccgcgagctgcatcgttcgccggaaacacatgccgacgacaagccgcacgaagcccaaatggtttcagtggtcaacccggacctgacccacgacctgttccaggccgcaggcgaaaacccccgctacgccaacgttcgcctgggcgcggtggtcgagcacatcaatcagggtgagcaaacccaattcgccgccgccaccttccaactgcccgacggccacaagcgccgaaagccgacctacaaaggcacgttggttatttccttccgcggcaccgatgattcgctcatcggatggaaggaagatttcaatatggctttccagtatccggtgccggcgcaacgttcagccagcgcctatctggatatggtggcgcgactgtgggagggtccgattattctggtcggccattccaagggaggcaatctggcgatttacgcggccatgaacgccgatcccaaggtgcgcaagcgcattcagcatgtctattcactggatggccccggtttcccgccggagattgtgaccagccccgcctaccgcaccatccagccgaaggtgacgaaaatcgtgccgagttcgtcgattgtgggcatgattttcgagaccccggagccttgccgcgtggtctcttccgattcggatggcatcatgcagcattccgccttcacctggctattggatggtgaccagttcatcaccgagccggatttgagttccagctcgcagttgtttaacgaggagctgaaccattggatcgccacgcttacgcccgaacagcgcgagcgtgcggtggatgcgctgttcaccgtgctgcacgccaacggcgccaccagcttcagcgaggtgatgagcaacttccccgcttcgattccggcgatgcttggcgcgtacgttgggctgacccccgcagaccggcgtcatttggttgaggccctggcgatactgttcaaggcgtccacggccaaacgcaagccgacgcccgccccggcttccgcaccaagttctgcgacctccaaagcaacagccgagatcccagcagaaactgcagcaggagcagatagcgcagctccggccagagccgatactgatgccgatgccggcaccacagcttcgccatcagcggaggacgcaactgaaatcgccgattagctcatagacatgtccacaaataatagttatactgcccaataagttattagacagcgtgaccatatcacgctggtgcatcaggaggaagagatgccacgtccacgccatgattccgaggtgctgcccgccaaagaacgcctcgagaacgctttctgggaattgctcgccgaccgcgactatcgcaagatcaccgttaccgacgtggtgcgtgaggctggcgtgaaccgtaattcgttctactatcacttctccagcctgcccgaattggccgattcagccatcctgcatcaggtcgaatcgattccgatcaaccgcacccccgatccgaacggcaatcccgaggaacaatggcgagaccgcgtcaccgccacgctctccgatccagagcagcgtcagcgcctcgaccacctggccctgttggcaggcccgcacagcacgcttgaactgaccgaatcgctgcgcgacttctgccgtctgcaaatgctcagcacattgcaacgcgaccccaagaaccttgacctgaaaaccgatctcatggtcgagttcaccgtgggcggcatgctcgccgtgctgcaacgttggcccgaattgagcgacaccatcgaaatcaaagacctgcttaaagaagatgtggccgtgctggccatgggcatatacctggccatgagccaaaaggacatgcttaattactggaatcgcatcttcgtgcacaatgcgcaggattcgaccgcccccggcatgccggtcgccgccacgcatgccgcgccatccaccatctcatcgtcgaacggccccgcaggattccccgggtacaccgcttgaccgaaaaccagcgagtctggattgtttccgccgcacgaacctcgcgtgaggtttctcacaaggcgcaatcagcctctcatgctggcgtttccaacccacgcacaggaagatggaagcatgagcgaaacatcgaacaagacccgtctggaacatgactgcatcggccagatggaggtgccggcgaacgtctactggggtattcacacccagcgcgctatcggcaacttcccggtctccggcatcaccgatagccaacatcccgagctgattcgcgcctatgccacggtcaagcgcgcctgcgccatcgccaatgaggaattaggcctgatcgacccagccaaggccgaggccattcgcgccgcctgcctagaaattgaggccggcaaactggccgatcagttcccggtcgatgtgatgcagggcggtgccggcacctcgtcgaacatgaacatgaacgaggtgatcgccaaccgtgcgttggaaatcgccggccgccagcgcggcgattacacatacatccatccgaacgacgacgtcaacaagtcgcagtccacgaacgacacctacccggccgcctgcaaactcgcgcttatcgacgcgatcgggccgctcgccgagtccaccaagaaactcgccaaggccttccacgatctggccgacaaacatatcaatgacgtgacgattggccgcacgcagctgcaggacgccgtaccaatgacctatggtcaggaatttcatgcgtttgccacgctgttgaagtctgatttggctgcattcgatcgcgtggtgccgctgctggcccagctcaacctcggtgccaccgccatcggtaccggcatttgcgcggatctgcgattccgcaagtccgctatcaagcatctggcgcaaatcaccgggctgccggtcaccgccgcgcccgatccggtggccgccatgacggatatgggcgcgtacgtggccacgtcggctgccatcaagagcctcgccgtgcacctgaagaaggccgccgacgatttgcgactgctcaattccgggccgcgctgcggtttcaacgatctcaacgtgccggctcgccaggccggatcgtcgatcatgccggccaaagtgaaccctgtgatccccgaatgcgtcaaccagtgctgcttcacgattttcggcatggacgtgactgtgaactgggctgtggccgagggacagttgcagctgaacgccttcgacccggtgatggtgcatgagctgctgaccggcatggcgttgctgacgcacgccatggagacgttccgcgtcaactgcgtggaaggcatcgaaatcaatgctgacctggggcgttcatacgcccagtcctcaccgtcgatttccgccgcgctcaaccactacatcggctacgagcacgcggccgacatcgccgccgaagccgtacataccggccgtaccgtgcgcgaggtggccggcgaacgcaccgacctgcccgccgagcagttggacgagattctcgatccgattcgactggcccgcggcctcggccagacctgccgcgaacgccaggagtagcggaatcgaccgtaggccgattccgctttctgccaccccgtctccacgacttcaccagaaacgaccgatacagtaggcgtatgactgaatatgcagaagacatcgcacgcgggtttcaggtgaacgccggcaaactcatctggctgaccattgtattggccatcgtatttgtggccgaccgcgtcatcagccgcgtgttgcgcaagattctggacaattctcagattcccagcgcctcgattttcgtgaacctcacgcgcgtgaccatctgggtcaccggcgcagcgatggtactgcagcccgtattcggcatcaatccgaccacacttatcaccgcccttggtgttggaggtgtggcgatctcgctgggtctgaaggatacaatcgccaacatcatcggcggcttcggcctgatgctgggccgcgtaatccaacccggcgatctggtgaccattcaaggcgtcacaggcaccgtgcacgacatcacctggcgtcagaccgtggtgcgcacccgttccggagacatgatggtcatccccaattcggtactcaatacggccgccctgaccaagctcacgccggtcagcgaaggcatggccacgcttgagttcacggccaaggcctccggcgacccgtctgcgatcagtcaggatattctcgaccgcgtaaccaaagccaccgccgacgtggcgctggagggtcagccgccattggtcaagttcaccggcttctccccttacggcatgaccggccaagtgcttgtgttcgcgcgcgagggtgtgctgccttccaccatcaaagatatggcggcgcgagccatcgccggttcgggcaccgaataccttgttgaagatggcggctcgtcaggcaatctgtgatatctcccggctcgcctctctgggtccggctatgacagtcatgcgaacagcatccaaccggtaagcatcacagtcaacagtaggtacgcgataacgccgggattggcataggcggtgcgtattttaagccccgcaggcaactcctctggcgcaagatagaactcccagctcttgcgcttggtgataagcagtacgataccggcaatgcagaggcccaacatcactgtgccgtacaacatcatgatgcccatgtcgcccatgttgccggcttcagccatacgcatgatttcggcctcgctgaccgtgccgtcgaggatgcggggatcgatctgttgtatcaccaatggggcgagcactgacccgttcaggttgatcagcatgtgcatagccaccgaataccgcagtcgggaggtgcgcgtgtatacatatccgaacatcagtcctaggccaaaggcgtagaagaactggaacacgttcatatggaatagcgcgaatgccaatgcggagaatatgattgcggtcttctctccgtaccggcgcaggcgggagataatctccttgcgaaaaatccattcttcgcaaaccggtgccaacaggcctatgaacaatgcgttcacccgccagtcgctgccaagaatcacgtcgttgatgcgattggtggcctgaccatcagtggctccggcagacaatatattgccaatcatattgcccaagaacattaccggaatgcacatgacgaaaatctgaatgaactcccccgccttcatggggtactgccgggtgcgaataaccggtacgcgagtgaaggccaacatactcagcggcatggccaccacatacagcggtccggaggaggcgagcagcacagcccaagcgggcacatcggtgccaagcagcgttcgtagtgcttcagtggccagaatattcagtccgatccagaacaccatcataatggcgagcgccgagccgattgtcgaaaaccggcgatgggccgtgaaccaccaatcgcgtggagattgttgcggctgctgcgattgctgaggtgcctgcggctgctgcgccggcggcattggttcgctcatacttatcccccatagttactggccgcaaacggaccgatcacacgtgcaatactcttcaagaatacggcacggcgtttcgattgcattgggaatgggggaggaaatcatcaatgggcaaggaatgatcaacgtcaatcattcccaatgccgagaaagtcccctactctgcaagattgctgtgggacggcacgcgataatcgcccaaaaatcgccgccgtcccacacacatcattgccgataagccattcgacgatcgtacagtcacaaaaacagaacagaaccgcacgatcatcgcaacgccattcagcaggcgagcgcggcgaccggacgcggggtgacaatcacgtcatcgcccaccgccagaccggccggcagctcgctggcgggcagctgcacggtggccttgagctgttcgcccttgttccagcgctggtattcgccggaggtgatgaccgtatccacgcgcaccaaggagccaaggaagtgaatgacctccacgcgggcgcgttcgccgacgtgcgaatcgctgctgccggccaaggccagcgtcaggttctccgggcgcacgagcacggccacggaatcgcccttggcggagccggcgagcagcggcacgcgctggccgaagaccacggcctcgtcgccattggatgcgccgggcaggcggttggtgagtccaatgaacgtggccacgtactcggtggcggggcgctggtacaggttctgcggggcggcgatctgctcgatcttgcccttgttcatcacaccgatgcggtcggccacgaccagcgcctcttcctgatcgtgggtcacgaagacggtggtggtgccggtggtgagttggatgcggcgaatctggtcgcgcagctggacgcgcaccttggcgtcgagggcggagagcggctcgtcgagcagtagcacgcgcggcttgacggccagcgcgcgggccagggccacgcgctgttgctggccgccggacatctgctgcgtgtacttcttggcctgatcggcaagtcccacgagctccagctgttccatggcgatcttgcggcgttctgccttgcccatgccgcgcacttcgaggccgaattccacgttctccagggcggtcatgtgcgggaaaagcgagtaggcctggaacaccatggccatctcgcgcttgttgaccggcacgccggtgacgtcttggccgccgaccatgatgcggccgccctggatgtcttcgaggccggcgagcgagcgcagcgcggtggacttgccgcagccggagccgccgagcagcacgaccatttcgccgggcttgatgtccaggttgaagtcgtcgagcgcgtgaacggtggagccggggtagatcttgacgacgtcgcgcatctggatggagccgccgccgcgcttgacgctgtctttgagcagggccttggcggccttggtcacgtccttgccgcgcacgccttcgagggtggcggtgggatcgttcttgaaggcgtcctcggcggcagcggacgtggtggcgggtgccgaaacagaagccgcggcatcggcaccggcatggcgacgggtgaaaatcgaattgctgttcatcaggttacttaccttcccttgacttgcgcattgcgtcggagatcaggtcgagcgcaacgaggagcaccgcaccgaagagcagagccagcagcgacatggcggtggagatttgagaattggactggccgagctggtagagcgcgacctgcaggttcatacggccgagcagcgaggcgacggtgtattcgcccagcaccacggcgatggagataaaggatgccgagagaatcgactgccataggttcgggatgatcaccttgaagaacaccttgggccaggaggcaccgagcgagcgggatgcctcgaccagcgtcttgacgtcgatggagttaagccccacggcgatcgcgcggaaggcgaacggcatcacgagaatcacgtaggcaaagcacagccagattgggttggtgctcagcacgtcggcggacagccagcggtagatcgggcccaaacccaccaccagcacgatggccgggatggtcagcggcagcgtggccacccattcgatcgcgcgctccaaaaccttggagcgaatatgcacgatgaccatggtgggcaccagcagcaccagcatgatcaccacggtgaccgcgctcagggccagcgaggtgccgatgccctgccacagcacggtcaggtcggcacccagcgactcgccgttgccggtgaaaatcgcgatccacggcgcggccgaccagcggccggacagcgggtgacgcagggtgaagatgagcatggccagcagcggcacgaacaggaacgccagggtgacgaacaggatcacgaatttgatgatgctctgtttacgcgcacgagcggcgcgcagctgcggcggcttggttgcggaagtttcggtcattgccaacgtccggccctcttttccacggcgtggctcaacagcatgacgatggccacgacgatgatcattgcgaatgccagcacctgggcaaagccctgctggttggggtccagttcgttgcgcatggcaccttggatcataagcggcaccagaatcgaacgctgggagaacagggccgcggcggtcgcgtatgcggagaacgcggaggcgaacagcagcaggaacgcggagatgaagcggggtgccagaatcgggcaggccacgcgcgtccagtactggaacgtgttgccaccgagggattcgcatgcctcgcgccactgtggacggatcgaatcgaccgcgggcaggaagatgatgatcatcagcggaatctggaagtagcagtagatggtcaccaggcccggcaacgaactgagccagttcgggttcacggtgtagccggtcagtgtcttgataagcatggtgccgataccgttgatgccgatggtggcgatgaacgcgaacgcgagcatcacgccgccgaactgagcaagcacggaggagatggcggagaccatacgacgcagcaggccgttcggcttggcaccaatgaccagtgcgtaggaagcgagcgcgcccaccgctgcgccgatcagagaggatgctaaagacaccagaatcgaggtgccgaatgcggcgatggtgttggcctcgaacatcttattgaagttcgcgagcgtgaagttgccgctgcgatcctggaatgcaccgacaatcacgatgacggtgggtgcgagcaggaagcaggcggtgtaggcgaagaacgggagcgtggtggcgagcgtgcccagctcctggcggtgcttggccatcgccgaggagagaggagaagcgggagtagcggacggacccgcagccttggcggcagcaggtccgttcgatgcaatgggtgcgattgcggcggtcatcggtctgtgcctcagttgccgatcgtcttgtcccagttgttctggagccactcggtgatgcgggtggagtcgtcgttggtgtaggagaccggctcgccttcgatggtgatggcgtccttcagagtggcctggtcgacggtgccgtcttccttcatggaatcgagcagcaccgggttggcgccgcccttgaaccacaggttctgggcgtcggcggtgtacaggtactcctcccacaggcgggcggcggccgggtgcggcgcgtccttgttgatggcctggttgtagtagctgacgacctgggccttcgggaaggtcttgtacttccagttcacgcccttgtccttgagctccttcttgtaggaggcctggttgtaggtccagtcgaagaccacgccggtctggccggagtcgatggtgccgttggtcacgtcgacggtggtcaggttgccggcttccttgagcttcttgaagtagtcaaggccgggctgcaggttgttgatgtcgccaccggcgagctggttggccatcaggtagccgttgaaggcggcgccagcctcggcgggcttgccgttgagggccacggtgccggcgaacttcgggtcgagcaggtcgtccagggagctgatgtcgccgtacttgtcggcgttccagcccacggacatgatgccggtgtagtcggcgtagtaggcgccgtcggcgtccttggcggtgtccgggatcttgtcccaggcctgcaccttgtacggggcgaagtagtcggtggaggtggcggcgatggcctggccgacatcgaagacgtcgggggcggcgtcggtgcccttgttggtcttggcggcgtcgagctcttccttggatgaggcgttcgggttgagctcggtgaccttgatctccgggtacttcttcttgaagctctcgatgacctcgccgtagttggaccagtcgtgcggaagggcgatgacgttcagcgcgccctcttccttggcggccttctcgaggtcttccatggtgccgaagtcggcgagggaggtggctttggcggacttttcgttcacggtgacggccttgccggtgctttcgccggtgccatcggaggaggcgttgctcgagccgcaggcggccatcgagaacgcgagcacggcggcgagggagccggccgcgatcttacgcaggttgttcataatgttccttttctcaacatcatccagacgacagtctggggagtcgggcttggtatgcgcggcattcgcgcggcccgtgaatccaagaaaagaaactatgcgcctaatctgtcctgacactggcgcgcaagtgaattgcgttcgccatttgctgtacgcctgttgaacttaggaaaacttggcatgaattactgacaggtatgggcgatgtgtcaatagcggaaccggcctgcggccgattccgcaccacacttacctcagcacgccctcaatcaatcgcgtgatgagttcggtgtagctcactccggtggcatcccaagccttgggatacatggaaatcggcgtgaagccgggcatggtgttgatttcgttgaccatcaccgtgccatcaggcgtcacgaaggtgtccacacggctcaagccggcaccatccacggccttgaacgcgcgacgggccacgtcacgcacgtcctcaagcacgctgaccggcagattggcaggcacttccacgtggctggcggaggcatccatgtacttggagtcgaaatcgtagaactggtcgtcgttctgatgatcgagcacgatttcgccgggccagctggcctcgggctcgtcaccggccttcgggcacagcacggcacattcgatttcgcgaccatcaatcccctgttcgacgagcaccttccagtcgtgctcgccggcggtggcgatggcggcggccagacgatcctgctgggtctcgcggtcatcggctttctcgactttggtcacaccgaagctggagcctgcgcgcgaaggcttgacaaacagcggataagtaagaccggcgtcctcgatctcggcaagcacatcggcggcggtgaagttgcgcgcatcgaccgtcacaccgggcgcggtgggaatgccggcggcatccagtaccaccttggtgtaatgcttatccatgcaggcggcggaagcaaacactccgcaccccacgtacggcacacccatcatttccagcaggccttgaaccgtaccatcctcgccataggggccgtgcagcaccggcagtaccgcgtccacatggccaagggaggtcagcacatggtgcatttccgggtcggacatgctgacgaagctggtgccgaagccggaatcggcggaattgatgtggctgggctcgccgatgaagaaaccgtcctgtccgcgagaggggtcaagcatcaccgggcgcgattccggggtgatctttacggtcggcagctcgccgccgtccaagttccagccacgcggatcttcgccattgatgatccacttgccgtccttggtgatgccgaccggaatcggctcgaaccgttcagtgtccatggcccccagcacaccggcagtggagatgcaggaaatcgaatgctcgtctgcacgcccaccatagagcaccacaacacgcttcttggccataaccatccttttgttgaaactacaaccgttttcaagcctatgctttgcaccgccaaccggaccgaaccgcgctcggaacgccgcgcacaagagacgcacaccagtctactcgtgcacgtcaacgacgtatacgccacgcgactttgcacgtacaacgtatacgccacgtatacgtcgcttctctcgttattcgccggtaacctcgtgaccgaacagtccggcaagcatctccgagcaggaaatgccttcgttcagcacgcggctcatctgatacgccaacggggtcggcacatcaagctgatcgccaagagccaccaccgcatccgtggtgggcacgccttcggccacaccgttgctgaccttggtggcctcttcgaccgtcaatcccttgccgagattcgcgccgaacgtatagttacgagacagcgaagagccacaggtggcgatgagatcgcccacaccggccaagccgaagaaggtcttgggatcggcgccagcggctacgcccagcgcggtcagttcggccagtccacgagtttcgatcatggctgcggtgttctcaccgtagccggcaccacgggccatgcccacggccagcgcggtcacgttcttcaggctgccgcacatttccaggccgatgacgtcggtggtcacgaacggcttgaaataggaggtggtgcatgcctcggccaccttcgtggcattatcgaggttcgtgcaagccaccacggtggcggcgggatgacgatcggcgatttccttggacaggttcggtccggaaatggcggcgaaccggtcggccggcaagtcaagggattcgcggacgacttcgtccatacgcttgttggtgccacgctcgatgcccttcatcaggctgacgacgatggcgtgatcgggaatcagtcccttgaattcgacgagtgccactcgcgcgaactgcgcggcgatggccacgactacgatgtccgcgttcttgacggcttcggcgcgatccccagtggcggtcatgttgtccggcaacttttcgacggacggcaggcgcacggcgttgtggtggtgatcgcgaatgccctcgacaatctgctgctccttggcccacatggtcaccgtgttgcctgcgtccgccagcacttggccgaaagcagtaccccatgctcctgcaccgagaaccgttatatttttacccatatcaaattcctaccttcgcttgtcgcgcaacttcatcggcacaatcttgtgccatgctactcgcctaggctccccgtacgggaaccggtgcggctacttctcagccgggaacgggccgccggcttcaggccaaggcttacgactcatactgcggtagtcccagtagccttcagcggggaactgctcgccacgaatttcctccagtactgtgttcatgcgtttgagcacgcgccacatcagctcgttcacggcctcggcaggcggctcttcaccccatgagtccatgtcggcaagcagatcggagtaatcgagcgcatggtcatagcacatcaccacgtttttgcgcggccatggccaccagtggttgatggaggcggcaccccacgtcaccgccgggtacagcggcacctgatgccccagtctgcgcgaggattcaagggcgatatatcccacgccctccttaatgctcatcacccactttttcgggtcgcgggtcacggtgccttccggccagaccgtcagcgggcggccggacgtcagaatatcaatcgaggtctcttcgatctgcttggccttgcccgaatgacgctgcaccggctgcatgccgaccaactggaaccacttgccgatcaatggccacttcgccatctcggccttggccatgtaacgggggcggcggcccatgtggaacaggctcatcattggcacgaacacatcaaacatggtgacatgactggcggcggtgatgaacggtccggtttccggcacctgttccaagccccaggccttggtcttgcagctggcgcggaacacaatggacacccctcccagcagtcgtttggtggccttgggattctgggcgttgatttccggctgattgggcgtgcgggggccggtcgggtaatactgtgtcgagtccacaagcgtgtggcggacggccagacgcttgacctgctcatcactcagcgggcttacggccgaacgcggcgacggttttcctttggatgccatggtctctattgtggcacggaccaccgcccaacgattccagcgcaacgttcccgggaacgtgccgcggaaccacacctcgcacccccgcccagcgaaacattccccggaatgcgtcgcacaatacgcggcagcccgtctgcacacaccatgcgcgcagacgggccgccggggaaacgttcgaatcactccaccgcgatggcgtcgatctccacgagcgcacccttgggaatcatgttgttgccaaaggccacgcgggcgggcttgacggagccgatgaacgcctcagcgtaacgtgcgtccacttccttgaagtcctcgacgttcttcaggtagatggtggcgcggcacacatgctcaatgccggtaccggcagtgtcgagaatgtgcttaatattcttcagcgcctgtgcagcctgctctccagcggtctcgcccgccagttcgccggtggccggatcaatgcccagctggccggatacgaacacgaagccattggccttcaccgcctgactgtatgcgcccagcgcggccggcgcctcggaagtggctacggcttccatcttttcgctcatattgtgctccttctcatcttgggggcgcccacctgctgcggccggcgccggtacacatcaccaccggctacgaccaatcgcacgatcagcaacgattggcaatgccgattacgtagcagtctactgagcaaagtcgcgtttagcgcgcatgatgctcggcatacggccatcaacagactattccttgctattccagacgattccagacgattcggctaccgttctcgccaaaccggacggtttttccacgacccaagcgagccggcatcaccggccttgccattgccgacaccagcaccagccttgcacgcgccgaatatgcaaaaggcttccggcggttagccgaaagccatgctggtgggcttgatggggatcgaacccacgaccttctgttccggagacagacgctctatccactgagctacaaacccgagcaacttctttactgtacaccacatcacgttgcatgcggcacatacgtcgccaaaataacgagaaaatcgccattatcggctctacaatggggttatgtcggaacctacagatgacttcgaatacgaacgccgcttcttctgccgcgaactgccggcggaatacgacgacggcgacgccccgaccctcatcattcagagctactacgtgcatgccgacaattacgccttgcgcgtgcggctggtctcgcgcaaggttcacgtcgacatgacgcccgacgtaaatccggtggccgtgctggacgaataccgcgaccggttctcggaagcatatgtcaccgtcaaaggtccgtccgtgggcggcacgcgctacgaagtcgagcgcgaaatcgatacgcgtatcgcggccgaactcatcaagcgcggcggctcggtaatcatcaagaaccggtattccgtgtggattgaggaagacggctggagcgtggatgtgttcggcgggccgaatgcgccgctcatcgtagccgaggccgaacgatccgggccggttaccaatctgacgattccgaaattctgcatcaccgaaatcaccgatcaggcgcgattcaataacgatggtctcgccaaccgtccgttctgtaagtgggcggatgatttcgaggaggagctggcgctggaggggccaaggttccagcagtatttcgggaagaatcggatggtttagggggggggagcaatcgagtacgctcgtgagctcccctcagtcatctacgacgacagcccctctcaaagaggggagccaaaaccacttagtacatgagggtggctaggcgacgacgggcgcgggtcagacgcgggtcggtgggttcggggatggcgaagtattcgagcagacgcttgcgaacctgctcgatatcggccttgtgcccggcggccaaaaagtccagcaaacggtcgaaagcgtcttgaatctggccaccgatcatgtcgatatcagccacagccaactgcgcttccacatcgtccggcgctgcggcggcagcggcacgcacgtcacgtacatcagcggacccggagcgggccagcaacagcgccttcgcacgttcgcgggcggccagtgcatcggacgggtcggattcgagcacgcgctcgtattcggcggcggcaccggcgtaatcgccctcctcggccaaacgatgggcttcggcatgctccggcggcacctgctcagcacccacgccggcaccggtggcaccagcgctcttggcggcatcggaatcaggatcacccgagtacggcgcggtaccgttcacaccagactgcgcggcggcctgaatgatcttcggaatcacctcgtcggtaagttgcttgagctcgtcgtcacccggaaggccctgcaacagtggcatcggacggccggcaatcaacgcgaacagtgcgggcgcgccctgcacctgcaacgcttgggcaatcgaaggattggacgagatatcgatacgggagagctgaatctggccgttcagggcgttcaccgcgtcgcccaacgcacgggccatcgggaacaggcggtcatcggtcggtatccacaggagcagcaggatcgggaaggtcgcagaagtctgcaccattgcctggaaggtgttttcggtggtgtcgatcacgtacccaccagcggcaggagcgccacccgcctggccgggctcggccttgacctgatgcttcagcgcctccaaatcgacggcgcccgccaatgagactcccggattgaactgctgctctgccataatgcctcccgattccacgcgattcgcgtacaacaacaatcacatttgctgacattgattgtaatgccgattcccaccacgtagggattcttccactacgcggtgaaattcccaccacgtagcaaaacgcccaccacgatgtgactcaaaacggcaccattgtgcgaaaggtaaaacttaccgacatcgtggtggatgaatcatatcgtggtggggcgttaaccgcgcggtgggcggcggcaacaactacagcgcttcgacctttaccggctgacggtcggcacccacggcggtgatttgctcaccggagcttgccaacggaatgtacaaggccaccacgttcacatacgtgaccttcatggtgctggtgtacttgtcgctattgaacagcgccttctcgtcgtcggaagccggctgcgattcgcggccatcccctgccttgcgagtccattcgccgttaatacggccaaccaccagatcaccggcaccgtctgcagcacgcatcacccacatctgttcaggcacagcggtgaatttttgctcctgcgtaccgttgttgcgttgcataccttcctgcaccttggccgtggtactggccagttcctggcgcagcaaatcgtctgcgaacttggaagcgtattggctcttggagccgttctgcagcacatcggcgtattgggccaaggcatcggcgggagcggccaccagcttctcatcctttgcggtgcccatctgcgagccaatagtcggaatctcgaacttcggcagcttggcgccctcaaacagtcgagccatagccatcagcttgtaattctgctgggcggattcctgatcgaagaccagcaaacgcttggactgctgatcttcggtggtggtcgtgatggtgaacaccgagcgaggccatccgtcgtccgtaggaatcaccgtctgggcgatgtccttgggaatggtcgcatattcggacataccgccgccacgctgattgatcgtggtctggctgatgcgaatgtccagctggggcccgcccataacggtcgcatacccatcgggattcttggcctgatcggcttcatcgatcgtcttgagaatcttcagacgaatcttcttctcctgcgcctcggtcaaatccggcgcaaccttggtggaggtatcagcagccggcgtcggcagttggccttcacaggcggtcaacggcacgaccaatgccatgcaggcgagggcggacacacacagtttgttccatcgcttgttcatcagctttcctcctgtccgtcatcggccgagtcgtctccggtattgacctcttgggccaagcgggagaagtaggcctgcagttcgtcaggggtgattaccgaagtcgattcgttatcgccggcgctgaggccgggctcagcgccgctttcggcaccggtctgctggtcggcgaccaggttacgcgaacttgggtcgatgataaccggtgtttcggtggcttcagattgcgaggattgcgaggacgcacggcccgaacgccgatgtgtggcgtgacggcgacgattacgtcgacttgcaccatccggcttcccggacactgcgatgctggcgggtgcctcttcctcgattacggcgcttgccatgccttccaccatgcgcttgcggcgcttatgcggcggcatggcgaacacggaggcgcacagtacggccagcacggccagcaatccgccggacagatagaacggcatcgcaaagtccggcacttcggagcgcacccagtgcagctgcaccttggcgttggtgacattttcgcccaaatccacaatggctaccgtcgaggcgccggtcttcttgctcttcagcgaaacggacccagtgccgcatttcacggcagtccacatatcggaatccttgaacgacaccgcgtcatcggcactggtaggcgctccctgactcgtgctgcttcccttctgggtgctcagctcgctccatgatgccaatccggtgatgcgggtataggacttctcggacgcgacccatccggcaacatccttggacgaacccaacgccacgcacgcctcgtcctgagaggatcccgagtccacggttatcgtggcattctgatccaacaaggtcagcacattcggatcagtgacgacataccgggagccgctcatggttgcggaagcggtgatttcagtggagggcttccacatcgtggcattcatgtaccccaacaccacagccgccacggccaatagtccgaagataggcgtcaccactccacgcatgattttggcatgacgggatggacgcttggcgcccttatccggtcttgtagtctgttcttcagcactcataactcaaccattctacaatcttcacctgtttattacctaggagcgcagaaaatcaaggtttaccagtagggtgatgtgtcatgcgtaagtctgttaagtctatgttatctcccctcggcaaggccgttgcccttgcctgctcgctggcgatgtgcgtgtcgctggctgcctgctccagttcgagctcggactcgaaatcctcttcttccgattcctcttcatcttccgactcttctgacaagaagggccaaattgccggcgtgaccgccaagggcaagctcggcgagaagccgaccatctcctttaatacgccgatgaccgtgtccgacggctcttatgtggtgctgcagaagggcgatggcgacgtgatcgaggagggcgaccgcgtctgcgcccaaggcatcgcgctcaacgttaaagacggaaccgagctcatggacacctggaccaagaacacgccggattgctcgctgaaggtggattccaagaccctctcctcgacctactacaaccagatcaagggtgccaagatcaacaccacgattggctttggcgtcaacgctcaggattcgtccgggtactcttacattctggcgatgacgtttgtgtccaagtccaaggacttggagaaggccactggcgaggaagtcaaggatgtgccggccaatctgccgaaggtgacgcgagccaaaaacggcgagccgtccatcgacatgaacggtcagggttcggttgattcgctgatctcgcagacgctgatcaagggtaacggcgccaagctgaccgacaagaacaccgtggtggtcaagtacaccggttggcttacgaatggcaagcagttcgattcgtcctgggatcgcgattccacaatcgacgccgatctgttcagcgattccagcggccagcatcaggttatcgagggctggcagaagggtctggtcggccagaccgtcggctctcaggttctgctggtgattccgccggatcaggcctatggagataaggagcaaggtccgattcccgccaactccacgttggccttcgtaatcgatattctcgccgcgtactaaaagatatagcaggggctccctctgatgagggagcccctgctatatctagaacagcctgagactgtcgtcctcggtgcctttcatatcgtcgtaatcgaggatgaggcaggtgaagccgcggtctttggccaagacctgggcttgcggcgtgatggtttgtgcggcgaagatgccgtgcaccggggccagcagcggatctcgattgagcagttcgcagtagcgagtcagctgctcgacgccatcaatgccgccgtgacgtttgatttccacagccacatgctcgccctcggcattcacggccataatatccactgggccaatggcggtcgggtattcgcgacgcaccagcttggctcccttgccgatacgctcgatttgctcggccagatagcgctgcagatggtcttccacgccatccttgatgagacccggatcttcgcccagatcataggtttggtcggaatagatatgctgcagcgtcacttcaagaatgtccgaacccttgtcggcgctgacacgtagcaccttttccggctcaccagcggcgacactttccggggaatgcgtcgcagaatcaccatccacagccccaccagcgacactttcccgggaatgttgcgcggatttggcggctgggtcgatctcacgaatcgtgcagggcgcggtcatccagttcagcggcttgtaggagcccaattcggagaaaatcaacaggctggaatcggccttgatcagcaatacgcgcttggccaggggcagtgaggcgttgaggcggcccgaatactcggccgaacagtcggcaacaataactcgcataggccaccactgtagcgcaacacatggcatacatagcaaaaggggctctctggaaaaccagagagccccttaaggagttggttcaggtcactcggcggtgccggagtactggacgtcgtggccgcgctcgaccgccacggtgagtttgttcgagtcgaaggaaatgaatccgtcggtcacctcgaacatgtggcgatcgccatcgggctcaaccacggtgagcgtaccctgcttgatcaccgtgagcacaggctcatggtcgggcaggatgcccatgccgccctcagaggcgggaatggtcacgctcgtcgcctcgccgtgccacacagggtggtcagcggcgacgatgttgaccttcatcgtggttttttccgcagccatcacgcacccagttccttctgcatgttgtgccacttctcttcgaggtcgtcgatgccgccgatgccggagaacgcctgctccgggacgtcgtcgtacacgccgtcgcagatgcgggtgaaggcttcgatggtctcgtcggccggcacgtaggagccggggcgaccggtgaacttctcagccacatagaagttctggccgaggaactgctcgatcttacgagcacggttcacggtggtcttgtcctcttcgccgagctcgtcgataccgatcagggcgatgatgtcctgcagctccttgttacgctgcagaatcgccttgacgcggttggcgcagtcgtagtgagcctggcccacgtaacgcggatcgaggattcgcgaggtggagctcagcgggtccacagccgggtagatacccttggaggcaatgtcacgagaaagctcggtggttgcatccaagtgggcgaaggtcgtggccggggccgggtcggtgtaatcatcggccggcacgtaaatggcctgcaacgaggtgatcgagtgaccacgggtcgaggtgatgcgctcctggagggaacccatctcatcggccaggttcggctggtaccccacggcggaaggcatacgacccagcagggtggacacctcggaaccggcctgggtgaagcggaagatgttgtcgatgaacagcagcacgtcctggttctgcacgtcacggaagtactctgccatggtcagtgcggtcagcgggacacgcagacgggtacccggctgctcatccatctggccgaagaccagtgcggtcttctcaagcacgccggcctcggccatttcgccgatcagatcgttaccctcacgggtacgctcgccgacgccagcgaacacggacacaccaccgtggttctgggccacgcgctgaatcatttcctgaatcagcacggtcttgcccacacctgcaccaccgaacagaccgatcttgccgccctgcacgtacggggtcagcagatcgatgaccttgatgcccgtttcgaacatctgggtcttggactccagctgatcgaaggccggcgggttgcggtggataggccaacgctcggagacggtgatggtctcatccggcttcttgttgaggatgttaccggacacgtcgaagacgtggcccttggtcacgtcgccgaccggcacggagatcggggcgccggtgtcggagacggaggcaccacgaaccaggccgtcggtgggcttcagagcgacgcaacggaccgtggaatcaccgaggtgctgttcgacctcgagggtgatctcggtctccttcgcctcgccttcttccttggcgctggtgttgacgatcgttactttcagggcgttgtagatgtcgggcagatgacccaccgggaattcaacgtcgataaccgagccctggacgcgggtgacgcgaccgttggtaggctcggccgcagtggtctggttgtcagccatatgcgttcctactcttccttcttggtcagcgcgtcagcgctgccgatgatttcggtaagttcctgggtgatcgaggcctggcgggaagcgttgagcttgcgcgtaaggtcgtcgatcaggtttcgtgcgttgtcggttgccgtgtgcatggcgttctggcggcttgcggtttccgacgcggccgcggtcagcaggcactcgtggatacgggactgaatgtacttcggcagaatcgcatccagtaccttttcgaggctgggctcgaaagtgtacagcggagcgacatccgcagtagccggtgcctcttcatcaggatcgggcaccttggtctcgtttttcacgatttcgaccggcagcatgcgcagcacgcgcaccttctgcaccaccatgttgatgaactcggtgtagacgatgtagagttcggaaactccacccttctcagccggcttcatgtaggcgtccatcaaggtgttggagatcgtttcagcaatttccacgccgggctggtcggtgtcgccttcccacgtcgccgcgatgtcacgattacggtacttgtagtacgtcgaaccgcgacgcccgtacacgaacagctccggctgcttgcctgccgcatcgaggcgggacagcagcgactccgtttcacggataatcgaagaggtgtacgggccggccataccacgatccgaggtgagggcgagaacagccacgcgcgggttcttctcgtccttcaccgcgatcggatgcgtgatatgggtgtgggccaccaacgcttgcacggcatcgaaaatcgcatcggtgtacggcttcgcgttcagggccacatcacgggccttggcgatatgcgaagacgcgatcatctcctgagcgttgaagatcttcgccaacgactcggtggagcggatgcgtgatttcaatgcgagttgcgagcccatggcttacttttctcccgccacgatcttttcctgatcgaccggcgcggccttgtcaacgtccggcttcttctcgaccagcggcttgccggcggaagagacgaacgtcgaacggaactcgtccacggccttatcgagggcagcctcggtgtcggcggtgaattcctcggtctcgcgaatggtcttgaggatatcggtgttgtggtcgatgtagtccagcagtccctgctcgaacggaaggacgtccttcaggtcgaggtcgtcgagcttgccgtgggtgccggtccatacggacacgacttcctgttccggcgagtacgggtggaactgcggctgcttcaacagctcggtcaggtgggcaccacgggtcagctgggccttggaagccgcatccagatcggaggcgaacatggcgaaggattccagcgaacggtactgtgccagggagatcttcagcgtaccggagaccttcttcagagccttggtctgtgcggcgccaccgactcgagagacggagataccgacgtccacggcggggcgctggttggcgttgaacagatcggactgcaggaagatctggccgtcagtgatggagatcacgttggtcgggatgtaggcggacacatcgttcgccttggtctcgacgatcggcagacccgtcatcgaaccgccgcccaggtcatcggagaccttggcgcaacgttcgagcaggcgggagtgcaggtagaacacatcacccgggtaggcttcacgccccggcgggcggcgcagcagcagggaaatcgaacgataggcctctgcctgcttggacaagtcatcgaagacgatgagcacatgcttgccgttgtacatccagtgctggccgatggccgagccggtgtacggggcgatgtacttgaagccagcggaatcggctgccggggaggccacgatggtggtgtactccatggcgccggcgtcttccaggctctgcttcaccgaggcgatggtggagcccttctggccgatggccacgtagatgcagcggacctgcttcttcgggtcgccggattcccagttggccttctggttgatgatggtatcgatcgcgatggcggtcttaccggtctggcggtcgccgatgatgagctggcgctggccgcggccgatcggggtcatcgcgtcgatggccttgaggccggtggacagcggctcgtcgaccgggtggcggtgcatcacgtcgggggcctgggcttcgaggatacgacgaccctcaatgccctggatctcgccgaggccgtcgagcggcttgcccagcgggtccacgacgcggccgagatagccgtcgccgacgggcacggaaagcacttcgccggtgcgtcgcacttcctggccttcctcaattccagcgaaatcgccgaggatcaccacgccgatctcacgggcgtcaaggttgaacgccaggccgagcgtgccgtcttcgaacgtcagcagctcattggccatgcaaccaggcaatcccgtcacgtgtgcaatgccgtcaccggccgtggcgacatagcccacttcctgggtgggggtgtcgctcggcttgtacgacgacacgaagtcgtcgagggccttgcgaatcgaggcgggatcgatggtcagttctgccatgatcactccttctattggttattgttcagtcaagtctttgcttgtgtgtggtgttggacggattggctcggccggtcaggccggagtcgcctccgtctgcaccttgcgatgcaagttctgcagctgtgcgaccacggtgttgtccgtgacttcgtcgcccacctggatgcgcatgccacccagcacggtcgggtcgaccaccgagttgatgtgcacctgacggcccaccttggcggagtagacctcgaccagtcgcttgatctgctccttcttcagcggggtggcggtggtcacggtgaccatcgactcgcccatgtggcgggagaacttgttgatcagccactggatggtctccaagtagcggcggcggcgcaggttgcaagtggcgtgttcggcgagcctcatggtgaccttgttcagggtcttgccagagaacacctcgcggaacagcttcacacgggcctcgctggtggcctggtagtcgtacagcttggcgcgtacgaccggcaggttcagcagtgcggaatgcagctcggacagctcgatggatacctgcagcgtggcgtcagtggcgtccgcgtagtacatcatggcgtccacgccgaagtcttccactgcgttggcgatgtcgcgcgcacggctccaacggcgggagaccaagtcagtcatgatctccatggtcatcggatgcgcgttgtcaccgagcagttccttcaggacggccaccttgtcggcaaccgggcgggacgggtcggtcagtgcgcgctccagctgaatgctgtcatcgagcaccttggtgatcgtgaacagttcgttgccgatccgccacgcgtcctcacgggtgtcgcgcagtttcggggccagcgaatcacgcgactcgcggtctgcaatacgtgatgcctctcctcgcatggtcacctccctttctggttacggatggtcacggtcacttcttggcgcccaggtcgtcgatcatcgaatcgatcatcgaggactgcacgtcgttgtcttccagcttggcaccgaggatcttgccggccagggcggtggcaagtgcgccgacctcgcccttgagcgagacgatggcctgctggtgctgggattcgatcgagcgctgtgcggatgcggtgatctgggccgcatcggactcggcgcgggaacgagcgtcggcgatgatgtgggacgcttccgcacgggcgtcgtcgcgaatcttggcggcgtccacacgggcggtgctcagctgggcctcatacttggccttggcctcgtcggcgtccttcctagcctgctccgccttggcgatgttgccctgaatcttggcggcgcgctcgtcgaagatcgcattgaacttcggcatgaagaacttgtagaagaacaccgcaacgatgacaagaatgatcagcgaccatacgatgtcataaacctcaggaatgaacaggtcaatcccgcttgctgcttgtgtcatcaagccctcctttcagtgatggacataatcggttttcgtctgttgatctgcgcagatcagatgatcagggcagcgacgaagccgatcagtgccagcacctcgaccagagccaggccgatgaacatgatggtctggatcttgccggacatctcaggctgacgagcggtggattccatggccttgccgaagaggatgcccagaccaatgccagggccaagagtaccgataccgtaaccgatgacggacaggttgccggcgacctctgcgagggtgatgatatccattgtgtttcctttctaacgtacttggcgacgttataaatcttggggtttggtcggtctgcgattttcccagaccggggaccggaagcggcgggttagtcgcccgtcactcttccgggaagctcaggttgatgtacacggtggaaagaatcgcgaagacgtaggcttgcaggaaggcgacgaacgcctcgaagcaggtcatggcgaaaccaccggcgaaccacagcgcacccaccgggatgccctgcagcttgttgaccgcgtcaaccatccagaactgcgcgaaggccaggcaagtggcgaccataaggtggccggaaaccatgttggcgaacagacggatggtcagggaggccgggcggatgatcaacagctcaagcaggttgatcggagccagcaggaaatagaccggccacggcacaccgggggtgaacagctcgtggcgcagatagtggccgaggccctgcgagcggatggcggcgatccagtactggatcagtgtccagacagcgaacacgagcggcatgaccaccgtggcgttggccgccatgttcatacctggaatgatgccgcacaggttgaaaatgaagatcgtgaagaacagggtggtgatcatcggcacgtagcgcttgccacgggcctcacccatcacgtcatacacgaccttgtcgcgcacgaagtcgagaccgtactcgactacgccctgccaacggccggggatgagcttggcgcgctttgcggtcacgccgagcaccaccaacagcacgatggttgccacgatacgaatcaaaataatgcggttgatggcaaacggagttccctggaacagaatctccggaggaaggaagtcatcaaccgagggcagatgagcgcctgcctcgtcagccaacagcaatcctgcgctgagcgaaccgaccatatcacgcctcctgcttcttcaatgtcaggtgtcagtttaaacccaccgggcaggcaaatgtgacgtgctcgttactttcgtcttttttttgtctcctcggtgtggagtctgccgggcatggacacggagtctgcgctgggcattcggctccgaatgactgaagagtgattatttgcctgcgtctagacaatgtcaatattataccggcgagtctcctgaaatccctactgctgcaaggttttcccgggcgtttcgcgaacgttgtgcactattggtcgcattacgcggatgtgtggcattacgttcatcaagccgtccacatcgtggacgaacaaccgtccacgctacgaacgcaacctccaacagtagctccctctgatgggccgagccgtgaaggagaagcaaaggagctccccgtcgaggggagctgtcgtcgtaggcgactgaggggagatcgtaggctcagccctgaatcaccccatacccgtcatgcacaaacggcttgaaatcatcctggcgcggcccgcccggctcatgccgaatcgaacgatcagtaccgagcttcttctcagccctgagctgcggcacctcggtcaggtcatacggcgtggtctggtacacccagttgagccagttgcgccacagcagattggcgtgggcgcgccaggcgaacaacggttccagcttcggatcgtcatgcgggaagtagttcttcgggaagggcacgttggtcatgcccttggccatatcgcgctcgtattcttcggcgagcgtgtacttgccgtactcccaatggccgagcgcgaacacttcggagaagtcacgcgtggcgatcaggcccgggccggactgcggcccccaagtcaagatctgaaggtcatggttggcacgtacctcgttttcgttcacgccggcgaggcgggagtgcggctgcagatcaatctcgtcgaagccattggtcaggaagcagtattcatcctgcaggtactgcgggaatacgccgaaaatcttctcggggtaatccaccttgtggatgccgtagcggtagtacagtgcgcccatcgcaccccagcacaggtacatggtggagaacacatgggtggaggcccagtcgagaatcgtcttgaactcgtcccagtagtccacatcttcgaacggcatatgctctacaggcgcgccggtgaccacaaaaccgtcgtaatagttgtctttgaacgcatcgaggttttcgtagaacttgacgagatgatcggcggaaacgtgcgtggcctcatgcgtggaggtcttcatgaagtcgatttcgacctgcagcggcgacttggaaatcagacgcagcagctgtgtttcagtctcgattttcttaggcatcaagttcaggatcaccagtttgagcgggcggacgcgctgacgctccgcctcgggcttctccagagcgaagatgcgctccgaatcgaggatatctctggccggcaggccactggggatcttgataggcatgttcctattatgtcaatattcgggataacggttcagggcattcctataacggccatttatggcgcgttattaccccgactccgactccgccccaaacccctcgctgcgtgagccaattcacgttttaaaaccgcgggaagatgacgcgacacgccgatgttgactttctggaatctgcacctattgtagatagagctgtctgagagacaagccgacgcggggtggagcagctcggtagctcgctgggctcataacccagaggtccatggttcaaatccatgccccgctaccaattgaccgccgttcccggaatcatccgggacggcggttttttgcatttgcaggacttttgccgccgtcaaattaacgtcagtaagatcgttaagcgttacgccaagataattcgcaactttcaccatgtcgtcaaaggtccacggatagccaatcttgagcatgcgcgagaacgactgcggaaacttgccaagaatcgccgccacatccttcttggggatatgacggacagaaataatcatgttgatgttcgttatagccacatcgccggccgccatgctggcggtgctgggcattgttattgttgctgtcataggttccatattaaacacagttgtttaactttgcaacacgccgagaattgccaaacatgcacattgggctgtaatacttaacatgtgagtttagctaagaacgtcagagttacagcaaatgtgcgatacttactccggcaaaaccgagttacgcagcgcgaccttgctgccgctctcggtatgcatgagcagaccttttccaacaaaatgtgcggcacgcgaccgttcaccttgcgcgacttgacccgcattgctgatttcttcgatgtgagcgtcgatttccttcttggtcgttctgattatgcgaaaccgttggaggtggcgtgatgtttggcttcgtttcgttgggtgtttcttttgcgtccttggttatttcctgcgccgcgctttactggtcccgcatggcacgaatcgaggccgctggggccgtggagcgtagtcgttacgctttggagtcctcgcgcaagcatgtggggcttccctacgaccacaagatcgttcacgattgggagttaagaacacagttcggctttgctccgcaaatcaaggatgattggactcgtcgtaaggattccgacggcgtggctgattccgacgacgcttttgaggttttttcggacgggacgtatcggattgttcctaactcaggagtcttctctgttctgaagcccgttttctgtcgagagcatggaacctgcgatgacccagcctgtccctatgccatctgcgcaggcgttcaaagggtccgcacttcattggttctatgccccagatcgggaattgcgtatatcgacaccggtggagacgggttggagatgatacccaatgcactccaagctctagcttcgtcagatcgctcgactggtccgggcgaggattctgcggtggcgcgatcgtgatgaagaatcgcatggtctcgcctgtaagctccggcagtcttccgcagtcgttcatgacccactcgctttgcttgcccagaaccgtttcgccgatttgccggcagtcccatagtccggcatcgcagttcacgcctatcgctttgacgttgaaagctctgccgtctccgcagttcacgaggtatccgacgatcggagggtcgatgccggccttgctgaagtccgggcgcaggagtttgtcgccttcgagcatggcgaagagcggcgcggcttcggccctccatctccagccgcgcgcgaatgtcaacagcgacaccatgagcccgaaggcggctatgacaacggttatccaagtttgcacggtgaggccgagaaacgttatttgcgcgaggtctacgcccattgattcttccttcctccgtcatctgcgacggttggttttttgtgcgattcccagcttacgcatccgggggaaggaacctttttccaaccgttcgaccgatggaggttttgcagatgattgcgtatgtggttcgttgtgacgtgtgcgcggccgaggcgttcgtgccgttgaatcaggacccggatatggccatgtcggctcgtgggtggcgtatgaggccgcactcgaaggtgtgcccggattgcgttttcgcgctcgaggggccgaagattccaccgagcatggcggaggtgcgctgatgtcggtgtttgatcctgagtgcagcgggaaccgtttcagtgcggagttcaggctgaccggtgatggcggaagtccgtatgagttcggtatccgtttcagtgtggatggtgattatttcgcggttgatggcctgtcgatgggtgacatggtgcatatcaaccgcgagttcgccagggttatcagggaggcgaagcatgcacgggttgtataaacgttttctcgtgttctgcgcggtgttcgtgggtttgatgttcgcggtggtgggtttctgggcactgctgggtgtgacgtgcctgtgcgcaggcatggtgctggtcgcggcgtcgccgttgctgttggttggcttcggagtgtgtctcgcggccgtgaatcttggcgatttgctgaaggaagaatgatgccgaacggtgaactgggatatgtgttcaagagcgcggtgacggccaatggttgcctgatgctgtgcatcacgccgcacgcgcggcgtcgcgacttccacagcaaggtgtacgtgctcacggccgacgaggtgcgcgcgttgatcgaggcgctggccgtgatgccggacggtcccgagtagttctaggtatctttagacgcctctaggcgttcgtatgcgtgcccgacgctatcgggtcactgagaatggaatggccgtgatggcgcgtatggctacgcctagccctacctatgccccgctgtggtggcggggaggccggccgcattgcaactgcggtacttgcgagactaagaggttgccaccgaccctatccagccgctggtaaaggcggaatcgggcagcactaccacgcgattgtgtggggctggatttggggaccattcccggcaggcttcggcctgctcttgcaatcgacggccgaccgaccgaaagcgagacccatttgaggattctcggccgagatttcgcgttgcgcgtctcggccgagaatcttcgggtcttgacctctccagcctcactcccaaaagggacatgagaaaccaacgtaaggggattacggattatgagcagagcaacgttcgagatgaatctgaaggacgcgggtatccgactgcttccgaagctcaacgagttcatcgaatcacggaagaccacggaatcgtttctggtgaccatcgagcaaatcgcgcgttgggccggattgaccaggcgtaacgggcgcatcgacgacaatcaggcgttccatctgatgcagttggcgcaatgccccgtctctaagacccgcaagtacggaatgcgctgctgggatgcgcgcgaggccatgcaggcgttggcccggtggaccggctcgtgggcttgggtggtggactgatggcgcgcacgaaaccgagccttgccgaggcgttgagcccgtggagcgctccgcatgacgcggccgacctgttggagggcttccggctctccatcaacaccttggccgaggaacagcacactgggcttcctgattcgccgcgcgtgctgaacgccctgcgtctgtgcaagggcaccgaactggccgcgttgggaggcgactggccggcaatgggagtgcggcgcgtcggcggcgcgtggacgctggacgcacgccagttcgacctgtgggcgcaggggcagataagcgtattcaggcgcagggccgaggcggctcagccgaccgtgcagatgcagtctcgcatgagtttgatctaggagggatgatggggtatttgacgacggtcgaggtggccgaactgttgaacgtgaagccggatacggtgcgcaagtggcggcaggaagtgggcaaggggccgcgttggacgcgctggccgggcacgaggctggtccggtacgagagcgccgaggtggaaaggtggcgtcatgccgggcagaagggataggcaacgtgtgccgccagtcgtctcggccgaggtcatcgagcggtggggcaacgactgctggctggggatgcccggctgcacgaagcacagcgacaccacggaccacatcgtgccgcatatcgcgggcgggcccaccgtaccggcgaaccttcgccgcgcgtgcaagcactgcaactcgcttcggggcgaccggacgcttaacgggtatggcgcgcttatccatgcggtcatcggccctccggctggcggtaagtcaacgtacgttgacatgcaccggcaaccgggggccgtggtgctggacttcgacgcactggccaaggccatgatgccgggctcggacgccgagcacgtcaccgtggaatgggtgaggcgtatggcatcgggggcatggtacggggcctaccggcacatggtgcgcgtcacggaaccggtggagctgtggctggtgaagaccctgcccttcacgccacgaagccctcggctgctggacgagtggatagccctggactatgacatcacggtctgcgaccccggcaagcaggaggtgatggacaggctcagggcgcgaggcatggacgttggtaaacggttgcaggccggcgtgctccagtggtaccggcagggcatcactcagaccggcatcgatgtgaggctcaaggctcgcaggtcaaggctcgcggccctcgggctcgccaacggacccgatgccggcctgatcggctcgcaaccggcgcggccggcatggtgaccgtcgtttttttgagaagcgaagcgaaggaacaccccgcgcccaccgtttttggttccccacaaaacaataaaaaaagcccgaaaatagggacggcaccccaaaatcaggctatgaaaatgcttcaaacagggaatatacaccattactgtgattggagcaatttctcatggcaggtttcgagggcttggagaacgcgggactgatcgaaggaccgcaggaaaaggcgacacgggagttcatcaaggagtaccgggacggcaaggccgagaacccgatggccgacttcatctattcatcgatgctgagcatcgcccgcaacatcgacgtgcagaacgcgcgcggccgcgagataagccgcaacatgaccagtcttctgggctatatccaacagctcgagggcatgtacgacacgatggacgaagaccccgaaatcaccgaactgctgggcaaggcggcgcgatgaaccacgaccagccgccatccttgcaaccgcgccacgcgaccgcgcgtaaccaggaacgcgccaccgacggcgctctcgtggccaggttcagcgaactgctgggcaagccactcatcccgtggcaacgccaggtcatcgatgtcatcagcgagatcgacccgtccaccggcacctactggtacgacgaactcgtgctcaccgtccaacgacaggcgggcaagaccaccatcaccaaaagctacgacgtgcgcaactcgttgtgggggccggaccgcaagacctggtatctcgcccagaccggcaaggacgccaacgaccagtttcgtgatttcgtcaaatcatggcgcaaatcgagactgcggaaactcgccaaaccaccccgcctgagcaacggcagcatggccttggagttcaagaacggcagccagctgaggccgggcggcgcgaccgaggcggccggccacggcgtgcagggcgacctgatcaacgtggacgaggtatggagcctgtcaaaacaacaggcgaagaacctcaaggacggtttcatccccacgaccaccacgcgcctgaagctcaccggcgtgagaccgcagatatggtggacgagcacggagggcaacgccagcagcgagtatttcaacgaccgcctggacaggctgagggccggcgatatccccgaccgtaccgcgttctttgatttcggcataccgttcgatgccgacccggaggatctcgaaaccatatggcgatatcacccgggggccggttatttgttcgatttcgaccaattggccgggttccgccgtcagttcgacgacgacgcggagggttgggcgagggcgttcggcaacatccgcgacgccggcagcacagacagggccatcgactccctgctgtgggccgacaccatggacgagccggtcacgccggagcatgggatgcgcgtgtgcttcggcgtgggcgtgcccctggacgcgacccacacggtgatagccgcctgcatcggcgttggcgggggacggccgccgctcgtgcagatcgttgacgacctgccgggcaccggcgaatcgcccgcgagactgctggccctccaaaacgactacagggcaccggtatgcatcgacccgcgcggcccctccgccgccttggccgatgtgctcgccaatgcccatgacccgcacacgttcgagcgcgtctaccggctgtcggacatgagggcggcagatgcggtgacggccccgcaatcgttcgtaagcgcgttggagcaacataatctcacgcacgcctcggacaggctggccgacgagcaggtgtgcagggccacgaaacgcaagagcggcgacgcatggctgtggaaccgttcggccggcgacgtgagcgcgttggaggccatgacgatggcctactggggatacatgcacctgcccgaatgggaggccgacgatatccaggtcttctgacgacatgccgctggatgccgcccaatgccgctggatgccgcatcgtcatggacagaaccggccgcgccggtgcatggttggggccatgaatctcgtggaacgcctgctcaaccggatggcaccggcctaccgcgcggccaccggaccggaaggcccgctgacgaccccgccggcccgtaccccggccgaccgcgacgtgctgcactacagcaccgtgtttcgcgccgtccagattctggagaccagcatcgcggggctgccccttcgtcagttgcgcgatggcgtggagatcgtgccccaactgccgataatctcccgccccgaccccaaccgtcatcgcagcgagttcgtccgtctgaccgtgggcgacatggtggtgcggggcgaggcgttctggctgaaattgagaggcctggacggcaccgtgaaaggtctgcgcgtgctgcccgcctcgttggtgagcatcacggacctgagcggcgaccccgcgaacccgtggaagcaatacgggtacatgggcaacgtctaccgcgatgaagatatccttcacctgccgttcgtgagcattcccggcagactgcatggactgggacccgtggaggccggccgtgcggaaatcaacggtgccatggacgcgagggatgcgaaggccatgtggttcgacgaacccgcccagccgtccggcatcctctccacggacaagatgatcaacgacgaaatcgccaccaacaccaagcaacggttcgagaagaacatgaagggcgtcaaggtcatcggcgggggcatgacctacacgccgttgctgctcagcccgtccgacatgcagtatctggaaacccagaaattcgacaccaccctgctttcccgactgttcggcatcccgcccaagctcatgctcgccgaatccggttcgagcctgacctacagcaacgtggaacaggaatggagccagttcgctgacttcaccctcaacgcctacgtgcagccgatgaaggacgcgctgagcatggtgataccacgcggccagaccatcgatttcggctgggactcgttccgccgttcggacacgaaaacccgcatggagacctacaagatcgctatcgaggccggcgtgatgaccgtggacgaagcccgctcaagggagaacatgcccccgctcggaggctcacaggaaggaacaaacaccgatgaagcatgaaatcggattcaaggggcgaatgctcgcccgctccgaggacgacggtgacgggcgcaccatcgagggcgtggccgtgccgttcggcgacgtcatcgacgtgtggggcgaacgcgagaccttcgaccccgacaccgtcttcgaggggctcgactccgcgaagctctactaccagcacgacacccttatcggctccatcacatccggcgagaaccgcgaggacggcctgcacatcaccgcgcgcatcgcggacacccagcaggggcgcgacgccgtggccctgctggacgagggggcccttgattcgctcagtgtgggcttcgttcccatcgaggaccggaaggacaaggacggcgtgacccatcgcaggaaggtccggctcttggagaccagcctcgtgagctggccggcctatgaaaacgcgaaactcaccaaccatcgcaacaacaatcaggaggaaaccccaatgaccgaacaggccgagaaatggaccgaagccctggccaagctcaccaaccgccaggacgaacaggccgagattctgcgcggcatcgagaccacgctgaccagccgtctcaatcagcagcgcggcacgtcgccgctgggcgaataccacagccagggcgaactgctcaaggcgctggtgtccgacgacaccggcaaggccgaagcggctcgggaagcctacaatgcgctgttgtcccgtgactacaccggttccgtagtggcgggcgccgacccgcaacccacctggatcgccgaccgcatccgcattctggagcagaaacgcaagatcgccacgctgctcacccatcagcccctgccggcggagggaatgagcatgagctatctcgtgctcaaatccgacacgcacaccgtcgccaagcaggcgaaggaaggcgactcgctgcccttcggcaaggtcacgttcggcgacgaatccgccgtcatcgacacatacggcggctacggcgacctgagccgccagcgcatcgaacgcatgcccgtgggggacgtgagcttcgagatgcgttgcctgaccgcggcctacgcccgcgccaccgagaacgcggcccgaaccgcgctctacggttccatcgaagccattggcgacacggacaaactggccgtgggaaagaccgccgatgctctgaagcccaacgactggatcgatctcatcatcgacgcatcggccaagttcgacgacgtgaacgcaaccctggactacatcggcgtgagcccggacgtgttcaaggccatcgcgcacctgaccgacgagggcaaccgtttcctggacgtctccggccaaggctcggacacgctcggctcgctcgacccggcatcaatcagcggccgactgctccgccaggacgtgcgtatgctcgatggcgcgccgaacggcaccgtggtgttcatggacaagagcgccgtgaccatgtgggagtccaacggctccccgttccagctccaggccgacaacatcatcaacctgacccgccagttcagcgtctacggctacgccgcgttcggcaccacgttcaagcagggcatcctgcccgtcaagttcgccgccgcctgaccatgagcgacaccgaacaggacccgctcaccagcagactggcctatctcgccgggaccatggacgatgacgacaggcccacgctatcggacatgctgaagaccgcgcgcgcatacctcgccccacacatcgccggctacacactggcccaaccactgctcgatgacgtggtgcttggcatctccctcgatctatggcaggcgaaggacgcgcgcaacggcatcgtcggcctgaccgtggacggcgtggaaccgttcagaatcagcaccgacccgatgcgcagcgcatggccgaaactgcgcgccgccggcatacccgccggcatgggggtgtcatgagcgactacgacaacacggtcgccgaactgaccgaaaagctcacggggctcggcggcatcgtcacacaggtgaccgacgatcccacgctggtcaaaccctcaccgggcaaggccagcatctggatagaaccacctgatttcacatgggagggatggcacccctacccgccggaaatcaccatcaagctcatggtcacggccggcacccccaccacccagcagaaggccatccccctcatcatgcaggtgctcgaactcatgcaccaggagaacctgcccctgcgcagcgccaccgcctcaggcttcaacctcgccgacgcgggcacgctcgccgcatacgaagtcactttgaacgccatctaacacgaaaggaaacaaccatggcagacaagattcgcaccctgggaccgggaagcctggtcatcggtgccgccgacgaccagcgcaggctcgacgtggactgcacgagcgtggagctcgcccccgacaattccagcgaggaccccgacacctaccttgatgggcacgaggaaggcggggagctcacctccacctggaagctgtcgggcagcatcggcgaggactacagcatggagggcgcgcaggtgtggtgcctgaaccacgccggagagcggaagaccgccaagttcataccgaacaacaagggctccctccaactggacatgatcgtgaccatcgcgcccatcgcgttcggcggcgacgtgaagacccgcaacaagaaggacttcgagttctcggccaccaacgtgaaggccagcgcctacacggccacggacagcgcgtgatggccgacaaggcgttgtacgtggtcggccagaaacggttcgtggccacgatgcgcaaggccggcgccgacctcaaacagctcaaggaggtcaaccggcaggcggcgggcgtcgcactgccggcggtcaaggcactcgccccgcgcggcaggaccggccgactggccggcagcgtgcgaatcggcgcgacccagaaggccggcatcatccgcgccggccgcaaatcggtgccctacgcaggagtcatcaactacggctggccccgacgccgcatcgtcggacgccagttcgtcaacagtggtgtcgcctccaccgaaccacagtggacgcgcctctacaagcagtacgtcgacaagacattggaacagatcaagggagcataacccatgcgcaacatcgcgaaagtcacctacaccgacggccacaccagcgaggccccgctcaccccgcgcgtcatcacctcatgcgaggaacacgcgcagaaggaggggtgggccgccggcgacggcagccgaatccgccagtcctactacatggcgtacctcgcgatgaggttcgccggcaacacgtccaaaccatacgaccagtggctcgacgacgtggacgacatcgacgtggagaccccggaaaaccctaccgaataggcgagtggcccgacgactcgctcggcaagctcagcgtcatcctcgcccaccacttcggcggcacgccgtgggcatggcgcaacgaggccagcgaactggactggggcaccgcgataggactgctcgaacaggagatggaacgcatggaggaggcggaacatggcgcgtagcacgatcatgtcggtgagaatcaccggcaacagcgacgacgccgtgaaggcgttcagcaaggtcaccggcaaagccgccgccttcggcagcttcatgggcggcatggccgtcaagggcgtgaccgccctgtgggacaagctcaagggcttcagcgccgccgtcgtggacatgagcgacagcaccgacaagttcaagcagaccatgggcttcgccggactggacaccaccgccatagaccaggccaccaaggccacccgagattacgcggaccgcacggtctacgacctcacgaccgtgcagaacaccaccgcccagctcgccgccaacggcgtcaaggactacgtgggcctgaccgaggcggcaggcaacctgaacgccgtggcaggcggcaacgccgacacgttcaaaagcgtggccatggtcatgacccagaccgccggagccggcaagctcacgacggagaactggaaccagctgaccgacgccatccccggcgcggccggccggctccaggaatccatgctcaaggccggcgcgtacaccggcaatttcagggacgccatggagaagggcgagatcacggcggacgagttctccgccgcgatcatggacctcggcatgagcgacgtcgccaaagaggccgcgaccagcacctccaccatggagggagccatgggcaacctcgaggccgccgtggtcggcggcctgaccgatgcgttcaacctgttcaaaccgacggtcacctccgccatgagcgtcgccgccgacaaaatcagcgcgttcagcggcaaggcgaccaccggcctgcaaggcgtcatcaaactcgtgcgcgacggcgacttcagcgcggaactgcgcgacgcgttcaacgtagaggaggacagccccgtcgtggacttcctgctcaccatccgggataccgccgccagcacgttcgacaccgcgaaacagaaggtctccgatttcctcaccgcgttccagaacaccggccccgcacaggccgccagcgatatcttcgccgccgtctgggagtcatgcaaaagcctcgccggagccgccggcgacctcatcggccagttcacgcccctgctcgactcgatgggcggcgcggccggagcgggcaccgcgttgggcgacgccttcaacggcgccgccggcatcgtgggcgacgtggccgacaaactcaccgcgttcagcgactgggtgagcgcgaacgccgaacccatcagcgccgccctggtcggcatcggcaccggcttcgccgtgttcaaggcggccagcgtcatcagcgccgtggtcaccgcattgcagggcttcagtgtggccagcaccgccgcatccgtggcccagtgggcactcaacgtggcgatgaacgccaatcccatcgtgctcatcatcactctcatcgccgcattggtggccggtttaatctatttcttcacccagaccgaggccggccggaatatctggagcaaattcaccagcttcgtcggctcgtgcgcgagcaacatcatcggattcttccaatcattgcccggcaagataggcgcgttcttctccagcgccgcccagttcgcgcagaacacgtggaacaacgtggtcagctggttcagcggactgcccggccgcatcctgtccgccatcggcaacgtgggcagactgctgtacgacgcaggctccagcatcatcagcggcttcctcgacggcctgaaaagcatgtggaacaacgtgaccggctggataggcggcatcggcgactggatcaaggaacacaaggggccgcccgcctacgacgccatcatgctcgtcaacaacggccggctcatcatgaagggcttcgcacgaggcctgcgcaccggcttcgacaccgacgtgcgccgcaccatcggcagcatcaacggccgcctatccaacgtcgtgttcaacggcggcaccaccgccggcagtcaggcggccagtacgaccaccgttttcaacgtcacgttcaacgcgcccgtggaccgcgagggcgtggcacgcgaaatcaggaagattctccgcgactacgaccggaagcgaggcaactagtggcgcagcagtgtttcatgttcctcgactggggcgacggctgggttgccgtcaacgaccacgacaacgacgtggccgcgttggacggcttcagcatccagtggggcaccgacggcatcgaccagcagcccgacccgtccgtgatgacgttccggctacgcgactcgaccggctggctcaccggccgcgccctcaccctggccggcgcgcgcgtgctcgtgcagatctcggcgcaacccacatggggcatgctccgcgacgacatgggcgcatggtcggcgcagcgcatgcgtttggacgcgatgcaccaggcatacacgccctgcaacccgtccggcaagtcaagcgcggcgacgacgctgttcgatggactggtgcagaacggcggcgaagcccggccacgcggcgacggctggctgttggagctcagcgcctccagccgcatgatcctgtggaaaagactacagaaacaagggcccgtatcatccgatgcacgctacacgggcctgcattgggtcggcaccatggccgaacgattgacggagctcaaccgacgagccagggaagcggacgcgccacaggccaacgccaacggcctcgacgccaccgcatccgtggcaccctaccggaccgacgactacccatcgcagctcactttgctccaccgcctctacgcgcactcccgaatgtggccgatatggtatgaataccccgaccatgacgcgagccgactcgactacatgccgttcggcgcgcccgcaagcatcggcatcgacgacacggcgaggctcaccgtgaccgattggacgggggagacgctggacggcctcgacgccgccgacatcatcaccgacgacgaccagaccatcatcatccccgaacccgtcacccaaatcaccatccagggcaacaccgcgaaatccaaggacggcgccctggaattcgacgaccacgacaccgacttcaccggcctcggcaaactgccggccaacctgaccatcacgcaatccagcatcagcgcggaatcggacgtggtctccgccgacaactccgacggcgtatggggcagagccggcggcaccgtgtggacgccatcggacgacgaacgggaggcgttcgcgcaactgctcgtctcgatggaccggcgactgcgcccggacaccatcgtgttcgacagccggaaactcgaccccgccacgcacgcccgcctctacctcaccgccagcagcgggccgctcgtcatccagggttccatcgcctcacggctcgccggcgccgacgccaaaccagcatccggcggcgcatgggccagcaccggcggcaccctcacctaccaatggtcgaacggccggccccggctccgcaacgaggtcacactctggccactacccgtagccgccgagaccgcgattacctgggcgagcatgggagcatggccagccatatggaggcagtgcgcgctcaccctcgccgaactctctctcgtcacccgctaccagcaaccaaccaccatcacggaggaaccatgaaaaccacaccgatctacggcctgccctacatcgaggccgacgacctcgtgtcaagcgcgccagcacagttcaagaccatggccgagggcatcgaaaccgcattgaccgaggttgattcacgaaacacgcccgccggcgtgaaacccgtcatcgctaccacgctcgaggcattggcggcgcaaaccggcgtgacaggccagaccggctacgtgaccgccgacacgacgaccgcgaacaacggcccgtactactacaacggcaccgcgtggctcccttacgcgaccggcgccatgcttgacagtctgcggaaccaactgacacagggttatgagttcggtcactatgtgggttcgagcaataacaacggcgctatcgcgattccgtttgagcgcgcgcacgcgaccgctccgcgaacaattctgttgacgcaatcacgagtcgtggatgccgttgacctgaatttcacgccaatggtctggagtagaacaaaggataatttccaaattcgtctgaagaacaggaatgcaacatgggccggagtccagccgttcgagtgtagctggatggcaatttggccggtcggctaaatgtcaccatccggtgggcgcacatcccggacggcgtgacattcagctgacgcttttgccccacgcgacgatccagttcacgcgcacgttgcccgtgaacgcggtgggagacattacgtccagacgattctcggtatggcgcgtggtcagcccctcggagagtccggcggcggcatccccgttcgtgacgcccacgaacacttcgttgtcccatgcccgtccgaatcgttcctggaactgcgcgtcggtccacagcgtcgcatagacgacgccgtggccgcgcaggacagaggagccggtggaccaataaccctgtgatccatagcccaacgaaaggattatatgaacgaggacctgttgacagccatcgtcggcgtcgtcgcggccgtgctgggcgcgttcgcccagcagctcgtgaccgccgcacgcgaccgcatggaggcgtaccggctcgcccagcagatgcagacagacaacgccctgctgtggcagtggaaccgcgaactggtggacgccatctaccgccgctcgccgccaccgccgccggaaccaccagacggactgttcgaccatgattaaccaccaatgaaaggaaaaacaatgaaacagttgaccacggaacgaatcaagagcgtcggcgtgctggccgcgtcgttggtcaccaccaccaacgcggcactcgcactggccggcataaacccgctgccgttcacggacagccaggcgggtacagcggtgagcgccgtgctcgcgttcgctgtgacgctgtggacgtggtggcgtcataacgtcatcacgccgcaggccgccataggtcacgacgtgaccgtgcgggagaaggccgccgcgaaacagatcaccacggccgaccacagcgagaccgccgtggccgcgcagcggaacgccgaagcctccacgacaccggctaccgagggactgacggacggcgaactgaaggtgctcaccgccgcatggctcgccgacctgcacaaggaggaccagtgaccggatacgccggcgcgctatgggtgggctcgtcgaactacacggcgggccgcgcccaaagcgtgcaatacatcaccatgcatatcatggccggatacctggccggcaccgaccggatattccaacgccccgactatcaggcttcgagcacatacggcgtcgggccggccggcgaggttcaccagtacgtggacgagtcgaacaccgcgtggtgcgacggcaacggcagctacggcaacagcgccagcatcagcatcgagcacgagggcggctattccctcgcggccaacaccgacgcctgcgttgccgcatcggcccgcctgtgcgccgacatcgctcgacgatacggctggaaacggctcgtgcacggccagaacgtcagactgcaccgcgaaatctacccctacacgcacccggcctgcccggacaaatgcccgaaccccctgcgctggcaggaaatcatcgaccaggccaacaacattctggcgaccggctcgccggactacaccgaaggagacttagaaatggttgccgcaatcatccaaccaaacgacgaaaaccgactggtctactgggacggctcccacatccacaacctcagccaccccgacgaggtgaccgccatccagaacgcctacaagcaggccacaggcagcacgataccgtgcttcaagttcggcagcaagaccgcaccctgggccacccgcctcatcgaagccatgaaacgcatcgcctgaaatttaggcctgtttgagcagcgtggcggccacagccgcagacgcaaagctaggctcccaggataaccgcgtccagcgcctcacgcagtcgcgagtcaggcatggccacgtatatctgcgtggtctcgaccgacgcatgcccgagcagacgcgcgaccaggaacaggtcgtgcgtctgctcataggtcttcgtggcgtacctgtgtcgcaggctatggcacccccagccggccggcagcagcttcgagatatgacggttcacatagctctgttcgacatgcccgccccagcgtccgggaagcagccagccgccgcaatgctcgatgtaatcggccagatcgtccggcagcggcacgatacgctgcctgtcgcccttgccggtgattatcagcgatttgcctaaaaggtcgtccatcacgtcgcggctgtgcaccttcgctatctcgccgcgcctcaatccgcactccgccgccagtctgaccatgacccgctcacgctcggtggccttgtgcagagcggcgatgatgtacttgtctgggcacggcctcggctttggtttcggtcgtttgattttcggcagttcttcgctcggatcgtcgccacgccgtccggtggcgtgcatccacccgtagaagctgctcagcgtgtttctgtaccccttgcggctttccggtttccatttctgcgccgccatccaatgcaccatgtcttcggccgtgacttccaaaggcgtctttgccaggtcacgtgcggccttggtcatcttgcagcgccggcaacgcaccgtctcatcgctgagaccggccgccttcagagattcaagccaatcattgatgtcttccgcccatgacgccggcggtggcgttcgtttcatacccatggcgcaccatcacaccaccagcacgctacgccgctagaatataagccgataatcggccgtcatggatttgaaccatgttcctctggcacaccatgttgccagaggaacatggttcaaatccatgccccgctacgaacgtggttatatggccgctgatttcggtaccgaaatcagcggcctttccgtttaccgtggcgatatggatgaaaggcgatcaggcagctacggtgcccagggaagtcggcgatcataaacgtctcgtcattttcatcgcggatcttcagttgtctaatccacgggaggcgacaggcgtgaagtttctcaacgaagcggaagccgggcacaagtcgtatgttacgatcgacttcgtgcccagctcccgttcttctgctcagaagcggagtgtggttcaccatccagccgacatcatcggcatcatgccgcagcgggtcaacgtatcggccagcgcatcgtccagtgcttgaatcggtcatagcgacgacgccaccgaacgacgatggacagtatggcgcctatcgccagagctgacacggccagaaccgaggcaagcgacacatcgccacccgtgacgggcagtgacgggcgagggttgggcgtggttgcctccgccggcgccggcggcgtctcgggtttctccggttcgcacggtttctccgactcgcatgggggcaacacccgcacacgctcccaggcatcgtcataccggctggacgccggggaaacacggtcatccccctcgaaccgccagacgaacacgtaccacccaggccgttcggcggtcagatacataggagcgccatgcgcgtccaacgccccggcgccgattttgaacgtgccgttcatcgcgggaatctcccaggtggccagcaaccggtggttgtcgtcttccgtgggaacctctcccccggatggcttgtacgcctcatcgttggaggggttgtcgggatcgccggaccaccatacgctcaccgtcgcatacggccgatccgccgcgaactcatactcttcgttgccggcatactggccatgatccgcagggaatcccgatacggtaatggtgtcgctgagctcggcaccgatatccgccgaatgctcagtgaccgtcgacatgacttctagcttcctgcgacttgtattgctttccgtagcctccataaacggacttatccagtcgcctataaggtattcctgcgcctgtttgctctgctcggaccgccgaaacacccatacccatgtgccaaaaccgctattctgcttggtccggtaagcggcaccgtcatccggcttggtcatggcctgcacacgtgcctgctgccccaccccggtgaaagaggccttgccataggccaccggctcataacccaaagtcgccaatcgcgcaagaaaagcatcggcgctctcttgtgcattcggcgtaatgacattgcccacatcgcccgtatcaagaccatcgaaatagtatccgcgggcctgcaattccaaatcgggcacccaataactgtccgcatccgccacgccactggtcacgtcatcgaacaccggagaagccacatcaagcaccttctcggagaccttggtggataccgccggaacaaaatccttacgcacccgaaatgtcgtcgacgcgccgccagtggaagccatcgagtcaaaggccagcatgtcctgagtgctgtccatgacgtgcatccgcccatactcgtatgtggtgttcgccgtcacctcgccggcgccggtcgcctcccacgcgatcgaggacccggcgctcgtcgacacccccgagaacgtgttgccgccttggacgaaccgcgccgccccctgcaaggtgacggtgaacggcactcccgcgatcgcgtcaccggcgcggttcaccactttcaccgagatggaaccgctgcgcaaagcctcggcatcggtgcgttccaccgtcgtgcccgcaggcgtcttgccggccgattgatcccatatccgggccgccttcgccacgatctcggggtaccggccttgaatgaccgccatctgtctcgcccactcgtcccgatcgcgcccgaagtgatcctgcacgatgatgccgatcgccgcatgggtggcggcatccgtgtcgcggtaccggtcaaggatccatgccatacgccgggcgttctcatcggaggcaagcaccgtggtggggcctatcacatagtcgctcagtttccccgcttcgatgcagtagtacttgttgcccgaagcgtccagccccgcgacaccgacgtaatattccatatcgttgtatggaaacgccacgtgatatctttcgtcggcgggcgtcaacgtcgcggcatacgccgtattcgccgagccgaacaccactcccaccattattatcagaccggtcagcatcgctacgatggccatgccccgttgccgccatgtcgttatcatcattcgtcctttcctggtacgtttccccgcatactgcactgtgtgcgggtaggccacgatcatggcagattttcattcgctacagccggtttttcgacctatgtggtccgagcttgccgtttgccggcgagttgtggataactcttccgccgagttatccacctcatgcggttgaccgaacgtttacctgatagttatccacaatgcgcaacatatgttcaaaagcccttagaatagggccttatggcagcagtacaacatcgcgcgaccacgcgcactagtaataccgataacagcaccacgaaaacgaagtcaaaggcgacttctgcccgaaagagccccgcaaccaagcgcaagagagtcagcgccgaaacggcacgcgccgcagcagcgctgaaaggcctggctgtcgaagcccccgcaccgtccatcgaagcaaacgagcccggccagttcggccgcatcaatgtcatggacatcactcccgccgaggagcgcggcatcttccccgcccgtgtggaactcggcgaaccgtttgagatgaccgcccaggtgttcatcgaaggccgtaccaaggtgggtgccaccgccatcgtgcgcaacccgcgcggcaaggaaaccatgcgccgggccatgacctgcgtaaatcccggcctcgatcgttggaccgtgatggtcaagtgcggcgagcacagcgatctgaagccttgggaggatggctacgcggccgtcaagcgtcagctcggcgaatggaccgtgaccatcgaaggttgggaagacgcgtacgtctcctggctgcacgacgcccgcatcaaggtgcgtgtgatggacgacgtggacaacgcactcaattccggtgccgagttgctggcccgttgggccgaaaccccggacaccggcctgaccgcacgcgatcgcaagaccttggagaaggccgctgagaccatggccgatcagacgctgagcgccgaggatcgtctcgccgccggcgacaacccgaccatcgccgccctgcacgagactcacccgctgcgcgacggcatctcccccagccagccccagcgcttcaaggtggaacgcccgaagtccagcttcgcggcttggtaccagttcttcccgcgttccgaaggcgccaccatcgatccgaacaccggcaagatcattcagggtacgctgaagacttcgatggccggcctcgaacgcgccgctgccgagggcttcgacatcgtctacctgccgccggtcttcccgattggcgtgaccaaccgcaagggccgcaacaacacgctggtcgccggccccgatgacccgggctccccgttcggcatcggctccgagctaggtggccacgacaccgtggatccactgctcggcaccatggacgatttcaaggccctgtgccagcgtgcacatgaactgggtctggaaatcgcgcttgatttcgccctgcagtgctcgcccgatcacccgtgggtcaaggcccacccgaactggttccgccacaagccggacggctccatcgccttcgccgagaacccgccgaagaagtatcaggacatctacccgatcgacttcaacgccgacatgcccggcatcgaaaaagaagtcgaacgcatcatgaatctgtggatcgaggcgggcgtcaccatcttccgcatcgataacccgcacaccaagccggtgcgtttctggcaggacgtgattgccgccgtgaccaagaagcacccggagatcctgttcctggccgaggcattcacccgcccgggcatgatgcgcgccctgagctacgtgggcttcacccagtcccactgctacttcccgtggcgcaacaccaaggacgaactggaagagtatctgccggtcaccaatggcgacgacggctactaccagcacaacaccttctggcccaccacgccggatattctcaccgcttacgtgcgagacaacggcgtagccggccactgcgtgcgtgcggtgctggcagccatgggctcgccgtcctggggtatctacaacggttacgaactcatcgagaacaagcagcgccccggcttcgaagagcagatcgacaacgagaagtacgaggtcaaggttcgcgattggagcaaggccaagcagtacggcgtggccgagatgctcaccgcactcaacaagattcgtcgcgcccacccggccgcgttgagctaccacaacctcaccgtgctgcctacgtccgacccgaatattctggctttcgcacgccacacgccggccgaactgaccggtaccggccaagcggacacgctgattgtggtcgtgaacctcgatggacacaacgcacaccagtcgatgattcacctggaactcagcgagctgggtctgcccaccgaccgcccgctcaacgtgcgcgacgagctgaccggccgcgaattccagtggggttgggacaactacgtgtctctggctccttgggcggatgtggcccacatcctgtccgtgcagtgatgcggtactgcaacggtaatgcaacagtgatgccgttgacgtgcatgggtttatcgtgcgcgtaaaccgctagaaatcctcccctcaaggggaggatttcgtctgtttgggcatagtgtcggcataatctcagcacggtttcttgagttccgcacctgttttgcaggcgtaaacagggtattgtggtgagacgataacgtaactgtcgattttcaaggagaaatgacatggcagaaaccttcaacgtcgttgtggaaattccgcgcggctccaagaacaagtacgaagtcgatcacgagaccggtcgcgtcttcctggaccgtaccctgttcaccgcaatgggttacccggatgactacggctacatcgacggcaccctgggcgaggacggcgatccgctggacgctctcgtgatgattccgaactccgtgttcccgggctgcgtggtcgagtgccgcgccgtgggcctgtaccacatggtcgacgaggccggcggcgacgacaaggtgctgtgcgtgcccgccgacgttcgtttcgatgacatcaaggacatcgacgacgtcaacgagtaccacaaggccgaaatcaagcacttcttcgagcagtacaaggctctggagccgggcaaggaagtcctgccgggcgactactggactggtgctgacgccgccgaaaaggaaatcattgccgcgcgtcagcgtctcgccgattccgagaagtgattcgattctgaatcgttgacaggaggccccttcgggggccttttgttgtatttgtggcaaagccgctctactctccctcagtcgcagtttcactgcgccagctccccaacagagggagcttgtattttgtgatacagtaatgttttgtcttttcaactaggcgtaggcggcgtgtaggaacgctggtcgaggcccatcgcacggtaatccggcgatgaaccttctgtcacaccatgatttcgataatcattcaaatcctgcttatttctgtttccgtagctatggatgcattcgccgtatccattggcaaaggcctgaccgtatcccgcgtacgagtacaagacgccgtgaaaagcaccctctggttcggcggattccagatgctgttccctattctcggctatttcgcggcatctacattcagcaaatacgtaacccaattcgaccattggatcatcttcgccctgttggtgttcatcggcggcaacatggttcacgaagccttcgaagaagatgaggaaaactccaaggagaccgcccagttcgattggaagcatatgcttcccctggccgtggcctgcagcatcgatgcgttcgccgtgggcgtgagcctggccttcatgttcaccaaagcccatatggcattcgccatcctcagcatcggtgtggtcaccggactgttctccgctgcgggcctgcacattggccgcgcgttcggttcccgctggcagaagccggcgcagatcgccggcggcgtggtgctgattctactcggcatcaaagtgctattggagcatttgggcgttatcgcgttctgatttagtgccataagccccttcaccagaaggggctattttgtttgatttcaccgttccaatgcccgacgtaggattgggatagaaattcgattatctgagaggcgtatcatgaccgagatcacccaggagggttggaagaacaaagctctgagcatgttgttggcccaactgacgtcctatgtactgttcatcgcagccacggtcattccctcccctggcaccgtccccatcatccctttgattatcgccgctctgacgttggccgcatttgtcgtattctggccgttccgtggcagcatactggatcgtatcgtcactttggtgtttggcgcgatttctctgattttcgtcatcgtacctttcccgaccagcgaggttccgccggatcagaccgctgcggatggctcggtacttccttggtattcatgggcactggccatgggcctgctgctggtggtgctggtggtcttctccttcggacgccagatggctcgtgagaagcgcgaacatcttatccgcgcactctctcacgccgtgacttccggtgtggcagctctcgccgtggccggctggtgcttcctacctgatttgggcgcgatgctcgccaagggcaccgttgcgggaaccgttgccctgatcatcctcatcgttttgggactggctttggccgtggcttccacgttgtgggtgcgcgacgccgatccggacccggatatccgttatccgtggatcggtaccggcctgatgccggtaatgctgatgggcgtgaccatcgccgcaaccgcactggtgctcggccgtatcatcggttgatggacgtccaccgttccatattccgcaaacttgtaacctatgtgtccactacaagcgcgtagaataatgaaaaccgtgcgaaagcggcataacgccgctgacgactcgtacagccacaccgagcaattgcgtaacacattgcaggataagggggattagcgtgacggatcttacgttgatgactttcgccagcgaccccgccaccgttttgccatcactcgccctgctttctcatcgcgtccgcgtactgccgatggatgcagccagcttggtgaagatgccggagaacaccattctgtttctggatgcacgcgatgatctggcgaccgccaaaaccttgtgccgcctcatccacgcttccggcctgtccacgccaatcgtgctggtgctgaccgaaggcggcttcaccgtggtcaactcccagtggggcattgcggatgtggtggtcgccaccgcttccccggccgaagtcgagggccgattgcgattggtctccgagcgcggcaacgctcccgcagccgcagcagccggttctcccgccgaatccaccaccacggtggaagatggccagattcgctccggcgacctcattgtggacaccaacggctataccgcctccctgcatggacgccccatcgatctggcatacaaggagttcgaactcctcaagtacttggtccagcaccccggccgcgtgttcacgcgcgcccagttgctgcaggaagtatggggctacgactactacggtggcactcgtacggtcgacgtgcatatccgtcgtctgcgcgccaagctcggcggcgaatacgaacacctcatcggcaccgtgcgcaacgtgggctaccgattcgacccgccggagacggataaggaaactgccgccgcacagcaggccgccaaagcatcctctgccgccatcgacaccgatgacgatactcccgatctcaacaccgtcgcctgacagaccagcggcgctgcaaactatcaatcatcgatattacgccgcttaggtccatacgatgagagaaaccaaatccgcgcgtctcacgcgcatgcatgacgaatacgacattctgcgccaggtgattccggcacccgcttgcgcactgcatttctcgaatccgctcgaattgctgatcgccaccgtgctcagcgcccagaccaccgacaagcgtgtcaacacggtcaccccggaactgttcgccacctaccccaccgcccgtgacttggcggccgcaaacccggcccaagtcgaagacatcattcatccgctggggttctatcgttcgaaaacccagcatctcatcggactggccacggcactggacgaacgattcggcggcgtggtgccgcgcacgatggatgaactgaccagcttgccgggggtcggccgcaaaaccgcgaacgtcgtgctcggcaacgcgttcgatatccccggattcccggtcgatacgcatgtgatgcgcgtaaccggacgactgcgttggcggtcggattggcggtccgcacaccccgatcccgtgaaaatcgagaaggaaatcacctcctgttttccgcccgaagagtggacgaatctcagccaccgactgattctgttcggccgggccacctgccacgcacgtacccctgactgcgccaactgcccgctgtccgacacctgccctagctatgcgccgcccgccggcaagagcacgtccaagcgctaactcatgcctcatcatggtgaattgcggattctaggctgaatccaccgctagactgaaaaccatgcagcacagcaagcgggacaatacatggtccaagtgggggatttttctcggagtcgccgtggcactcggcgcactcgtggttgtgggatggacgttcatgcaaaaccggttccagccgggatcatccctcgatgccgatgtgaccattggcatcgacgatatgccgcaatccttggatattcggtccgattcctctgcggcagccgaacgcctgctcgtcgacaatgtgtatgagacattagtgaccgtcgatcaagacaacaagcttcagccgggactggcgacaagctggaagacttccgatgacggactgaccgtcaccctgacactgcaatcgggcgtcaccttctcgaacggccatacgttggacgcctcggacgccgtgtggtcgttgcaacagaacgtgaccaacaaggtggcggacgtcgacgaattgggcgatctggcgtcggtcgccaatccgaacgccaccacggtggtcattacgcttgccaagcccaatccgacgctgctgcgagcgctgtccggcagactcggcattgtctacgattccgagtcgtccagtgccgattatcaacgcaaggccataggttccggaccattcaccgtggccgatttccagcctggccattccctgaagctggcgcgcagcgatacctaccatggcaccaaagcggccagcaatgtcgttgaatttatgcaatactccgacgccgatgcgctcagcaaggccctgaccgacggcagtctcgatatggcggcaccggtttcggcttcgacggccaccggtttgaacggcaaggatggcctgaccgtcaaggagggggccactacggataaggtgctgctggcctacaacaacggcaccgattcgctgctctccgacgaacaggcgcgtaaagccttccgctatcaaatcgacgcagccggcatcgcctccgcccaacccgacgcagccggagcattgggcggccccatcagcctgctggaacccggatacgaagatttgaccggactgtacccgcatgacgaaaaccaagctgggcagatgttctcctactttggtgcgcaatacctgactacggtgaatctggtggttcccgaagaataccggtcgttggccgaaaccatcaagcagcagatcgagcggcagccgcgccccacggtgaaccttgaagtgctctccgatgaggattatgccaagcgaatcaaggacggcaaatgggaactgaccgtgatgagcatggacggcacggatgatgccggcatattcgccgaccccgattccatgttccattacgaccataccgaagcgcaacaggcctatgcggatgctcgcgccgccactaatgacgccgattatgaggcacgaatgaaggcgtacgcccggctgatcagcgaggatgcggccagtgattggctgtatacccgcaaatgcttcactgtggcgtccaccaaggtctccggctacccgacctcgatgatcaatcgccgcatgccgctggccgggttgacggtgaagtaggcaaccttcagtcacggacgggctacgcccgatagtccttggctcactatcgttcgatcgttcgtacctcgcctgcgaacagcctactgggctgtttactgtacagttcggcttgtcatgcaacgtgcataaactttggccttatgactgaaggcaaatccatcatcaacgccaacctcaccccgctgcccgacaaggtcggcgtggacggacttgaggacaagtggcgcaccgtctgggatgaagacggcacctacaaattccgcaacacccgcgaccgcaaggccgtctactccatcgacaccccgccgcccaccgtctccggttcgctgcacgtgggtcacgtgttctcttacacgcacaccgatgtgattgcgcgctacaagcgcatgcgcggctacgacgtgttctacccgatgggttgggatgacaacggcctgcctaccgagcgccgcgtgcagaactactatggcgtgcgcgtggacgtgtctctgccttacgacccggacttcaagccgccgtttgaaggcactgatggcaagaagattgacgccaaggatcaggtgccgatttcccgcaagaacttcatcgagctgtgcgagcgtctgactgctcaggatgagaagctgtttgaggccctgtggcgcaagctgggtctgtccatcgactggtcgcagacctaccacaccatcggtcagcacccgcagcgtgtggcccagaaggccttcctgcgcaacctcgcccgtggcgaggcctaccagcaggacgcccccggcctgtgggatgtgaccttccagaccgccgtggcccaggccgagctcgaatcgcgcgaataccccggcttctaccacaaggtggccttccgctttgaggacggcaccccgatctacatcgagaccacccgccccgaactgctggcggcctgcacctcgctgatcgccaacccgaacgacgaacgctacaagcagtacttcggccagtacgtctactcccctctgttcaaggtcaaggtgccgattctggcgcacccggccgccgaaatggacaagggtgccggtatcgccatgtgctgtacgttcggtgatgtaaccgacgtcgagtggtggcgcgacctgaagctgcccacccgcccgatcatccagcgcaacggccgtatcgtgatggataccccggactggatcgaggacccggccggccgcgaggtctttgccgaaaccgctggcaagaccacgttctccgcccgcaagatcatcgtcgacaagctgcgcgagtccggcgatctggacggcgagccgaccccgaccaagcgtatgacgaacttctacgagaagggcgacaagccgctcgagatcgtcacctcccgccagtggtatttgaagaacggcggtaccgacgccaagctgaacgccgagcttatcgagcgtggcaaggaactcgagttccaccccgacttcatgcgcgtgcgttatgagaactgggtgcacggcctgaacggcgactggctgatctcccgtcagcgcttcttcggcgtcccgttcccgctgtggtacccggtgaacgcttccggcgagccggattacgatcacccgatcactccgtccgaggatcgtctgccgatcgacccgaccatcgacgtgccggagggctacgacgagtcccagcgtgatgtgcccggtggtttcaccgccgaaaaggacatcatggacacctgggccacctcttcgctgaccccgcagatcgtgacccactgggccgagccggacgaggcctccaaggccctgttcgcttccaccttcccgatggacctgcgcccgcagggtcaggacatcatccgcacctggctgttctcgactgtggaccgcgcgcacttggagaacaagtgcctgccgtgggcccatgccacgctgtccggctggattctggaccccgaccacaagaagatgtcgaagtccaagggcaacgtcgtggtgccgaacgagccgatcgagaagttcggcgcggacgccgtgcgttactgggccgccgccgctcgcctaggcctcgatgccacgtacgacatcggccagatgaagattggccgtcgactggccatcaagctgctgaacgccaccaagttcgcgctggccatcggccgtgaggacgagaaccatcacgtgggcgctgccgccgaggccgcgtggaacccggccgatgtgaccgaaccgctggatcgcgccgctatggccaagctggctttggtggtgcgtcaggccaccgaggcgctggaatcctacgagcattccaaggcgctggaagtcatcgagtcctacttctggcagttctgcgacgactacatcgagctggtcaagaaccgcgcctatggcactccggacgagcacggcaatgtgccgtccgagaaggctgtgaagtccgcccgcaccgctctgggtctgggcctggacgccttcgcacgtctgctggccccgtacctgccgtacgccaccgaggaagtgtggagctggatgcacgccggttccggttccgtgcatcgcgccgcctggccggtcgtggacccgtatgtcgaggccgccaccggtgcttcccccgagctgctgacttgggccggcaaggccgtggagcagctgcgtaagatcaagtccgaggccaaggtctccatgaagaccccaatcctgtctgtggcactgtccgctgcttcggaaggtgtggaagcgattcacgccgccttgggcgatatcgcgcaggccggtcgcgtggtcggcaagttcgacttggtggccaagcacgccgaggaatccgccgccgaaggcacgcccgaaaccgaggtcgccgtcgaagccagcgagctcggtgagccgccagctaagaagccaaagcactgaacgttacgcacaacaacagtaggtctcacggcaatgccgctcgttccgagcctacgggaagcccaccgggcttcccgcttaacggctcggccagctaagaagccaaagcactgaacgttacgcacaacaacaaaagaggggaacctattgaggttcccctcttttgttttttgacgttcggatgacacgactgtgggacggcacgcaaatatcccgcatacaccatcacaccgtcggaatcacgatgagatatcgggtttcggcggttttttgttgcgtattggggctgtcgagctgcgcgacggcctgcgccaagagcgtgccagcatcactgattttcacggtctcattaatcagcgcgttcatatcgtgcttgaacagcgtgccgccagtgccaaagccgaacagtactggagcggtgtcaagattgtcgccggaatcgccagtgtcgctcgacttggctgagtcgttcgttcccgaaccagcgctcttagacgagtcggacttatcaccaccaccgatggccgaagtaagaccacccgcatagttcatcacatcgccagcagacatggacatggtgtcatcgaccagtgaggccttggaatgctgcgactgctgctgttgcgcggctttggcctgcttacgggcggcatcggccttacgcttggcttgggcgacccgggtcttgccgtagaacgattgcgattgcgaatcgaccaggccggtcagtgcctgagcctcggtcaccggatcggaagagacatcaccggacgaaccatcaccatcactgccggaagccgaggacgcgccgccttcgaactgatcggagaatcgcaatacaatctggcgcaaggccgtggctttgcccgtatgctcggaggcggtggcaagcgtgctcatcgcggcatcgaccttggattgagcgtcggcgagttcatcgctaccgttggtttcggcgatggcttggctctcgtaagcggtggcgcccgaggacgtgccgccggtcagggcgctcaaattggccgtgtaaacgtccgtgtatttcatcgaatacggaatcattgcggcggagagctggctctggccatcggcgtattgcttggagccttgagtggcttcctccgaagcctcggcgatcagatcatccaccagtccggtggtgccttgctgctggatgcggcgaatcacctcgtccaacgcatcgaccgcaccggcatgctgatgtgcggcactgacgttgttcaccgcgttggccaagtcgagtacggcttgagccaaaggcgtgtccccggacagttcgccggccgtgcccatcaacgccggcaactgggtggaggtgccaatcgatccagacaggtgcgtggtatatgagcccacatacgcggccatatagtcttcaaacgtccgcttatgggcggtttcgcgttcggccactacagacttgttcagcgcacgttcgttatcgcgcagggtttgaagctgctcgatgagctgttgctgttcaccagaaccggcgtcggtcagtgaatcgaccagtgtggcggcagaggcggtgagttgggcgacatccgtatcggcagcaggctgtgcggcagcattcgcagcattcgcggcatcgggattagcaccaactgccggactgctggaattggaaggcaatacggcgagcgccacggaactcatggagaagtctttggcgttcatatagcagctgaattccaagccggttgcggcttttccagctgcggcgactacggtattggaaccttgcgtggtcaccgtaatggagttgtcagcggaaacatcatcggctacctgcgtaggcacggtaaaggcgacaaccgggatcgtacggttggcttccttggtttgcggcttaatatcgatatacacgccgatcagtccagacgcgccggcaacctcgtttgcctcgacgttcggaccgtcaagcgagtaggtgacgctgactttccatggcagggtggcggcggaagcggggatacgagaaaccttggacgtgccggaattactattggcggaatcggtatcagtggaaccgctattgccggaatcggcactggcgccattgccggcgccgcccttccctaccacataccaacggaccggctccccttcggcatcggtgacggcgtacatatcacttgccgtagcgagcaccggaccgtaatcaaccggagtcggacgagacatccaagcaccgccgagaatcgaagccacgcacaatgcgcaactgaccagtgcggcaccacatctcatctacgtatcccattcatacagtcgaccactacgggcattccattcccgtattaatgtagtcgctgcaggcaacttgccctatagacgaatatccgaaaggtgcccattcgctgcgggcgaatcaggcgaatacgtcgagtacgcccggggcaccaccggcatcggctatgcgctggtggcgcttcttggcttcggtaaccacgaattcacggtacatttcggcaatttccggatcaagcccggcatcgatggcgatgcggtggaggcgttcgatctgatagtcctcacgcttggtgtcttcgggcgcgaatccggcgttggctttgagcacgccgacctgcgaggtggccttgaaccgctcggccagtaatgcgatgaccgccgaatcgatgttatcgatggtttggcgcagcgctttgatgcgcgccaccgcttgtgcggtttccgggtgggccgccgcctgggcggagtcgatggtggtcctttgccagtcgctgctcgtttcgctcatagattcgaggatactcccgattacggctttgcacgatgcgcaaagtcagatatctcagatgtcatagtcgccggtgaggatatggctggcatccgcatcgccgaacatggccgcaccactgcccactcccaaaacaatcgaacccagtgatgcctctttcatctcatatatcgtcagcgtgcatgtgaacgttgacggcaatactacaactgcaatgtgatagttgatgtatttgcatcagatacgacaagggctgcaccccgtatcaatcagggtgcagcccttacactattgttcagcggtctgatcagttgccgttgaccgcgttgccggtgttggcctgctgcacgatggcggcgaggaagtcgcggttggtggcggtcttcttgaggcgcggcaccagcgtctggtaggcctgctcgggctccatgccgcccagcagtcgacgcagacggtagataatcggcagttcctgcgggttggtgatgagctcctcgcggcgggtgccggaagcgttgatgtcgatggccgggaacagtcgcttgtccgccagctcgcgggacaggcgcagttccatgttgccggtgcccttgaactcctcgaaaatcacctcgtccatcttggagccggtttccaccagcgcagatgagatgatggtcagggagccgccgttttcgatgttgcgggccgcaccgaagaacttcttcggcgggtagagggcctgcgcgtccacaccaccggacaggatgcggccggaggcaggggctgcgatgttgtaagcgcgagccagtcgggtcatggaatcgagcagtacgaccacgtcctggccgagctccacaagacgcttggcgcgttcgacggccagttcggcaaccgtagtgtgatcggaggccggacggtcgaaggtggaggaaatgacctcgccctggaccgtgcgctccatatcggtgacctcttcgggtcgctcgtccacgagcaccaccataaggtggacctcggggttgttggcggcgatggagttggcgatgttctgcagggtgatggtcttaccggccttcggcggggagacaatcaggccacgctggcccttgccgattggggaaacgatgtccatgatacggccggtgagcttgttcggggcggtctcctgcttcaaacgctcctgcgggtacagcggcgtgagcttggagaactgcggacggttgagcgcttcttcaacgctttggccgttgatggaatcgatggcctgcagcggcacgaacttctggcgctggttgcggcggtcgccttcacgcggggcgcgaatcgaaccatgcacggcatcgcccttgcgcaggccgtacttcttgacctggcccatggaaacgtacacgtcgttcgggccgggcaggtagccggaagtgcgcacaaaagcgtaggagtcgagcacgtcgacgatgccggccaccggcaccagatcctcctgcggctcttcgcggcggctatcacggtcattgcgatcgctacgattatcgcgatcatcatagcgacgatcatcatcggcgttgtcgcgatcacggccacgcatgcgacggttacggcgatcgctgcgatcattacgggtatcgcgatcgttgcgatcgctacggtcgcggcggttacgacgcacgaactcgtgatcgtcgttctgctcgccgtcttcggacgtttcctcgtgcttctgcgtgggcagcgtggccaggatatcgtcgaggtcacgcacggtttcttcgctgttttccgcagtgcgacgacggcggcgaggctgctcgtcctcatcatcacggactcggcgaatcagcggaacttccacgtcctcgtgacgctcgcggcgacgctcggtaggcgctgcatctcccaaatcgagcgtggccagcagatcgccggcctcatcggccttcttgcgcggcttgcggcgagcgaaatcgggctggtcgtcatcgcgacgacggcgggccgcacgcggttcggatgcggcatcatcggcggccttacgacgggtgcgtcgcggttcggtctcgtccttcttggcatcgtcggccacgggaagcggcaaatcgagctgcggttccgtggcagccggagccggagccggcgactgggtggccacgtcagcattgtctgtggtgttggcctcagcggcatcggactgcggagccttgacgaccttggcggttttggcggccttgggggcgcgcacggtcacaccggccggcggctctccaccattgcgcgccgcctgcagggtggcgagcagctcgggcttgcgcatggtcgacgtgccgcgcaggcccatctgtttagcgagctctttgagctcaggcagcttcatatcctcaagattctggctatttgccactggttgccctttccataccgaacagacccatgcctatccaggcgttaagagtgattattgcggttgcaccgctcatgaatgttcgctgcgtctctgagtctctgcgaacttcgttcactgtacaacgccaactcgaccaacgcaaaacggcccgccgaaaaccaaaaaagctccctctgtgacgagggagctcaacaaggtttattcacttttcttcgtggtaggacttttcggtgttgacggaccacacgttcttcttggacgtcttgccggtcttgatgttgccgacggcctccatggcggtggccatggagtggtccatgttgttgtagcggtgctggccgttacggcccacgcagtacaggttgccgaagccgtcgaggtactcgatgagctcgtccatgtgctcataggtgtcgaagtaggcggggtacgccttcctgacgcgctcacgatgggagtcgatgacctcgtccggaccgttgatcacacgcatgcgggtgagctcggaaatcgcgaacttggtgacatcctcctcgctcatgttccagaacgagtcgccctcctcgcagaagtactcgagaccgatccacacggtgtcgtccacgtccttgaccaggtacgggctccagttgttgaagatctgcagacggccgaccttgtagcccgggtcctgcacgtagatccagcagtccggcacgatcggcggattgccgagggtggggatgctggtggtgttcttgagcttcaggtgcttgaccagcaggcccacggtcacgaaatcgcggtacggcaggccgttggccacctcggtcatatcggccggggcgggcttggaatcaacggcctcgggatcggcgccggccgcgtcgatggcgttgaccaggtccttgaccggcatcgaggagatgaactggtcgccggaaagctcggtgcggttgccctcggaatcctcgtacaccacggaagacacggcaccatcggtctggcggacctcgaccaccctggcgtcggtcagcaccttgacgccggcggcctcgcaattggactcgacggtctcccacagctggccgggaccgtacttcggataccagaactcctcgatcagcgaggtctcgacctccgcgttggagcgcttcttgggcagcagcttctggaaggcgttcttgagcacgcccatgatggacaggcccttgacgcgctgggcgccccagtcggcggagatctgggaggggtggcggccccacagcttctccgtgtagccctcgaagaacatcgaatacagcttgcggccgaaacggttgatgtagaagttctccagattgtcttccggcagcttgtggaacatggacttcaggtagctgaagccggccaccatggtgagcttgaagcccatggccttcaacgtgttggggctcagcgaaatcgggtaatcgaagaagtggcggttccagaagatacgggacactcggtggcgcttgagcatcaccttgtcctccgtctccggatcggggccgcccggctccatgtcgtggtcgcggccgagcttcttgtcatcataggagggtgcgccctgcaacggcagaacggtcttccaccaatccatgatgcgttcgtctttggagaagaaacggtggccgccgatatccatgcggttgccgttgtgcttcacggtgcgcgagataccgccgaattcgcgggtcccctccagcacggtcacgtcgtacttgtcggcaccgccgtccttgatgagttcccatgcggcggtaagtccagccggaccgccgccgataatcactacggattgcttgtcggtcattatgctccttataaacgcaaaatcagagacagtctactagaagccccggaatcgcacaccgaaagatgagcgaatgcttacagaattctcccgatatacgaccgatgcgccgtctttccatcagcagaaaggcgacgcatcgaatcgtgaggtaggggtattcggcaacgttgcgtcacacacagcgcggcgaatcggtttggtcttaggctaattcgtcagcgacgaactttccatagattcagcgagatgcctgcaagtgcaagcagcatcataatccccgcaacaccagtaacggcaacaccagtacgactcaactcgttttccgtaccattagcctgagtgttgctgggctgatgagttcccgcaccattgttattcggagtggtactcgttccttcaccagtgttaggtcctgtgcccggctgcgttgtggaatcatcagtcagatgcgcatcgtcgcctagggtttggtggtcggaggccaagcaacttttaagctcagtgagcttgtaccacgtggaaccatcggcaatcggcgtgcattcggagcggaaggcgatttcctgctcgttgtagagcatacgaacgagcggcgtgtaggcacggccggtcttcgggtcgttgccggatttgacggcaacatcccactgcacattagcggccatcggagtcaccgattcaccgcgccattcattgttggcgtaggtgtacacgtcggtggtgctggcggccgcctgctgggtggaaccgggaaggccaagcagcgcggcgaacggcatcatcgtttcggcatgggcaaagcggaaagtagcaacggtggatccgccgtttacgcgctcatcaatcgacgagaagaaatcgtcaagcagcggctgtgcgattgtgtaggtctcgtcttggccggcatagctcgggcccttctcatagtagtcctcggcgtcaagcgcccaggcgaacaacttggcgtcgtctgcctgctcaccttggaagtactggttgaagtcgaaggtatggctgccggtgttctcgttctccatatcagcggcgatgatgtacaggttgtacagatccatcgcggcatcgtattcggaggcgatcttcttcttggcttcgccgcaggcgtcggcatccttgctggggtcggctcccggcgcgcagttggcctcgccgcccttggtgccatcggcagtgttgtaccaagtgtatgtgccgtcggccagtttggcgaggaagtcgtcggtgaagatctgcgcaagcaggtcgtgcgaggccgttttcacgtcgccgttctcggcgatggtcttttccgcgcccgcgatggtctcgtcgttctcgacgaagttctggtagttgtcggcgagctgtttggcctcgccggttttctcggtgccgtccgggttctcggacttgtggaaatacagcgtattcggcgttttgtcgaaggccgccgcctcaccggtgccggcagggtcggcgggcgttacggtgctgttcgccagctcattgttcgaggccgcgttgaagccgcgtgcgaagttttcgccggactcggtggcgcgggcttcgccagaggactgataggcaatcttgccaccgtccttggctgcgttgtcgaacagcgtcttgttgcgctcgtaggcacgtgcgccaatgccctgatgttggtcagcaccctgaccggtgagcataccgtagccattctccacatttgcggcggtgatggctttgagattcttcatgaattcggacttgatggcatcagacttaaaaccgttatccgcttcggcggcttcggccatcttcacaagcaatgcgtcgtatttgtagctggacaggccgcgtgaaccgtggcgagccatcgactcggtgtataccgtttcgtagccttccggcgcctggctatagctggcagtggtcgcttcgctaggggccacatatggctgcttgctgctgtaatactggccatcggcctccaaagccatggcgtgcggaacggtcagaatgccaccggccagcaatgtggtggcaacaaccacgcccgcaatggagcccttaatgccctgctgcatatggtgtgtgttcatgcagcattttctatcagccgcaagcaaacaagacacacgatggcaaggttacgaatctgaacttttgctatgcgttgtatgaacaatgcgcgacgccccgccgtaagatgacggaatgccgcgcattgtcaatacaggctgtatcagacgattgcctgtcagtgaatatcgtcgggaatgtcgatatcggttttctggacttcttcgacgttcacgtccttgaaggtcacgatgcgcacggacttgacgaaacggctggaacggtagacatcccatacccatgcgtcagtcagctgcacatcgaaatacacgtcctgaccagcggaacgcacgttgaaatcgaccttattcgccaagtagaagcgacgctcagtctccaccacataggtgaacagcttgatgacgtcacgatattccctatacagcgcgagttcggcgtcggtttcgtaattgtcgagatcctcggcactcatgcttgtttactcactcactttccgtatcgcgtttgcggccgcggcccagcgtacgccaccatgcttcctttgagggcttgcgttccgcctggccgtacggccagttgctttcctcttcgagactgtggcgcgtgttcttctgcgtatcgtcgtggtgctcagcctgtggctcgactggctgtgcggccgccggcgtctgggcctgggactgcacgtcactcgtcgtgacggcggctgcctcaccacgctgtgccggctcgggttccggcttgttctgctggatggcgatggaatgctcacgcgcggacagcgcttccttgacacccgggttgtcctcaatcaagtgcataccaaaagcgtcaagcgaacgaatcggatcgtactcgtcgaccaacgtgtccatgacgataaggtcctggtatttgttgttttcgacatcccacaacgcgtcgcgcgaggtgccggacggcacgaagccgagcgactggtagaccgaaatcgaacggctgttcttttccggcacgctcacccagatgcggtgcatgcccaagccggccggttcgggcgcgaaaccgtaggtcatcacacgcggcatggcgtcacgggagtagccgcggccacggtattcacggcccaagatgatctggatgcgggcggacttggaccagccgtcgatgtcgataaggaaaatcatgccgatgacattatcggtactggccgcatcgagctgaccgtcatcgtcatggtcggcgtcagtcaatacggcccatgcgatggtgcggcgggattccggatcacccacaccggattcggcgggtgcctgaccggcttcccaagcctgggagcggcggacccacgtgtgtacgatggcgcgttcggtgaccgcatccttacctgtgatcttggatgcgccatagaaggcatcaagttcatccaaacgaggcaggtcctcgacggtggcggggcgcaggtgcaccatttcgccacggattggcggaatgacgatgctctgtggcagatcgcgcttcagttgcgcttcggtagccatgctcagcgtctcgttggttgcggtcatcggtatacgtcccccggttcggcttgtttcggctcacggtccagtgccgaacatatcttactcgactgggtgaacgctggaaatgctctgagtcgactttcttacagaatcaataaaggctcccgctggcgggagctgtccgcgaagcggactgagggtggtcatccgtacatggcgaccaccctcagtctcactccgttcgacagctcccaccagcgggagccagtgaatctaatcagcccttgatcttgcccatgacgaccttggtgacggccttggcgtcggcctgaccgcgcgtggccttcatcacggcaccgatgattacacccatcggcttcatgttgccgctcttgagcttctcgacaacgtccgggttggcttcgaacgccgcgtcgacggccgcctcgatggcaccgttgtcttcgacgatcttgtagtcgtgcttcttgacgacttcatccggagtgccttcgcccttaagcacgccttcgacggtctgcttggcgagcttgtcgttgagcttgccggaggcgatgagcttctcgacctcggccacatcggccggggtgatcggcagctcttcgagggacacacccttggcgttggcttcgcgggaaagctcgcccagccaccacttgcgggcaccggcagccttggcaccggccttgacggtttcctcaatcaggtcgagggcgtcggcgttgaggatgtcgcgcatctgcagatcactcaggccccactcggacttgaggcggttgcggcgctcgcgcggcatttccggcatctgggccttcatctcctcgatgtgctccttggtgatgtggagcatgacgaggtcggggtccgggaagtagcggtagtcgtcggcatcggacttcagacggccgccagcggtggtctgcgtagcctcatcccagtggcgggtctcctgcagaatctccttgccgtcgtccagacgagcggcctgacggcgaatctcgtactggatggtcttctcgatgccgcggaacgagttcacattcttggtctcggaacgggtgccgtacggagcgtccgggctcgggcgcaacgagacgttcacgtcagcgcgcatgttgccctgctccatacgagcgtgggagatgttcaacgcgcgcacgatgtcgcggatggcgcgcacataggcaccggcgatttcgggagcgcggtcgcccgccccctcgatcggcttggtgacgatctcaatcagcggcacaccggcacggttgtagtcgaccagcgagtggtcggcaccttcgatacggccgtcggcgccacccacgtgggtgttcttgccggcgtcgtcctcgatgtgcgcgcgctcgatcggcacgcggaacacggtgccgtcttccagctcgacgtccaggtagccgttgccgttggtgggcttgtcgtactgcgagatctggtagtcgcgcggcatgtccgggtagaagtagttcttacgggcgaactggctccactcggcgatttcgcagtgcagggccagacccagcttgatggcgtaatcgacggcggtcttgttgatcaccggcagagagcccggcaggccaaggctcaccggggtcagctcggtgttcggctcgccaccgaactcgatgtgggccgggcagaacagcttggtgttcgtggacagctccacgtgggtttccagaccgaagaccacatcgtacttcttggtggcatcggcgtacttcatcagtttttcagccatgatgttgtttctttccttccgatgctcacttgcccagaccgtcaagccacggggtcttgaggtcgttccagatcgggccgttccagctgtcttccagcgcggcttcgagggccgcggccggcttgtacatgacttcgtcgcgctgctgcggggcgatgaactggaagccgacgggcaggccgtcgtcggacaggccggccgggatggacatggcaggcacgccggcgaggttggccggaatggtggcgatgtcgttcatgtacatggccagcgggtcgtccatcttctcgccgaacttgaaggcggtggacgggctggtgggggccacgagcacgtcgacctgttcgaaagccttcttgaagtcttcgataatcagcgtgcggaccttctgggccgagccgtaccaggcgtcgtagtagccggcggacagggcgtaggtgccgaggatgatacggcgcttgacctcgtcgccgaagccggcttcacgggtgtaggccatcatgttggcggcggtctgcggcacgccggtcggcggcatcacgcgcaggccgtagcgcatgccatcgtaacgggccaggttggagctgacctcggacggcatgatgatgtagtaagcgcctagcgagtagccgatgtgcggaaccgagacctcaacgacctcggcacccatctccttgagcttgtcgacggcctcgttgaagcgggcctcgacgccgggctggaagccgtcgccgccgagttccttgatgaggccgaccttcatacccttcagatcgcgcttggcgccttcgcgggcggcggcgaccatcgggcgcgggccttcggggatggaggtggagtcacgcttgtcgtggccaccgatgatctcctgcagcagtgcggagtcgagcacggtgcgggagaccgggccgatctggtcgagcgaggaggccatggcgatggctccgaaacgggagacgccgccgtaggtgggtttgacgcccacggtgccggtcagggcgccgggctggcgaatcgagccaccagtgtcggtgccgagggcgatcggtgcctcgaatgcggcgactgcggaggcggagccaccaccggaaccgccgggcacgcgctcggtatcccacgggttgtgggtggtctggtaggcggagtgctcggtggaggacccctgggcgaattcgtcgaggttggtcttgccgagaatcggcatgccggcggccttgagcttttcgatgacggtggcgtcgtacggcggcacccagccctcgaggatcttggaggcggcggtggtttcgatgcccttggtgacgatcatgtccttgatggcaatcggcacaccagccagctcaggcagggcggccttgtcttcggcggacttggcgtcgaaggcgtcggcctgctcgagagccacatcgccggaaaccttcaggaaggccttgatggacggctcggcggcctcgatcaccttgaggtgggcttcgacgagctcgcgagaggtgacgtcgcccttcttgatggcagcggcctgctcggcagcagacagtttgacgagagttgcggtttcgttgctcatcgattactcctcgcttcccaggattcgcggtgccacgaacatgccggcctcggtcttcgggccaccggcgagcgcctcttcctgcgtgagcggggtttcggcgacgtccgggcgcaggtaggcttccagcggaaccgggttggcggtcggcggcacatcgtcggaggcgacttcctggaccttgttgatggagtctgcgatgacgttcagttcgccctgcagacgggtgatttcctcatcggtgagcgcgattcgggccagatcgcccaaatgcacgatttcttcgcgtgaaaatgttggcatggccataactatatgagccgtatgtgacacgcagttgtcgggaaaccgcattttcctaccctttgagaccatttcagcagggcaggcactcgggtcattatttgatatccgcttttctggtgacgatgagaccgccgatccatgcggcaggattgtcgacgcatggctacacgcctgatacggcgtgttgggcaatccatgcgtgcatggccacggccgccgcagcgcctgcattaatggagcgcacggaaccgaattgagagatgtagaccacatcgtcggccaatgcgagggccttctcgctcaatccggggccttctgcaccgaagagcagcaggcaccgcttggggaaggcataggcttccatcggcactgcgccgggaataatgtcgagggcgatgacgcgggcggcttgaagctccttgatgcgtgcatcacaagcatcgatttcggccagcagctcatgaaggtgcttgttgcctccatccacagccacatcatgcgcatggacggcggcggcaccggccttggctcgttcataggcgatttcaccggcgatgcgatgatgccagctttccaccagttcggcgatggaggggtggtgttcgacgtgctggtacagttcggtcatcaacgcgcccttgcgattccacttatgtggaccgacaatgtgtacgcgcttggcctggaaggcattagcggtgcggaccatggaaccgatgttaaaatcgtgggtccagttttccaccgcaacttcgaagtcgtgacgccctcgagcgtcaagatcggccttaatggcagcaacggtccagtagcggtaacggtccaatacgttgcggcggtctccgtcgttcaacagcaccgagtcgaaacgaccgtcataattcgaagaagtcggatcatcgggacgaggctcaccgggatgggtctcagaccacggcccaaggccgatttcacggaattccggttcacctgaagccttggcagccaaagaaatctggttgggtgcgtgcaatctttctcctcgataacgctattcaccggttcctcttagtcagcttcgctgctcagcccggctgactttatgcgagggacgtcaaaggtggatttaccgcagttcggattcgtcgaagacctggatgaaggggagcgtttgctcgtcgccggtggaggggttgaccacattgatgtctttggcaccgccaccgaccagcgaggcgatggccacgaccttggcacccagctgctccactatgccaaagtcgaggctcagctcattgccgttgcgcagggtgaccagcgagcttgtctgcacgtacgacttttcggacagccaagcatccaacagcaccacacggcggccttcgatggaggggcccttgatggacgggtagacgaagtccatcacgaatccatctaggtcctcgccacgagaggcggcggcctggatcatggcagacaccatgggcacagatgctgcggtcaaggcaccaacagcatcgaagtcatcaatcgaatagcccgcatcttccaaagcgtcaatcagtacatggcccatgacagtggcggcacggtggtcgaaagtcaccgcggcaagttcggagaacggacggcccaccacatgctccttcagcaaggtggctagctgttcacgcggctccagcatggcaaagtcattatggctcttcgcgacggcaaggtccggggtaccagtggggcggaatccagattcagtcatgactccagactatcgcctgaggcagtcagatgagtatcaccttcatcggccggcaccacttcaggggcggacagttcgctcacattgcctttatctgattcgatgatcggtacttcctcgatgatcttggtcggttcgattttttgcagcttgcgagcggtgggcaacacacggcgttccaaactggacgcgaacttgttgtaggcgctgaccgtcttagtaatctgggtgcccaatttgatggcataatcacccagcgtggagaaccgttcgtacagttctcgggacaaatcgaacagctgcttggcgtcatcggtgagcgactgctgctgccaggcataggccacggatttcagcacggcccagagcgtgaccggcgaggtgagcgccactttgcgagagaacgcatcatccatcagtgtgggatcggcttcgagcgcggcctgcagtagtgcctcattggggatgaaggccaccacaaaatcaggtgctacatcaaaggcattccaataggccttttcgccgagagcacgtacatgctcgcgcaacgccttggcatgggaccgcagcaaatcatcgcggcgggcaatatcctcggggctggcggtgtccgggatttcgcaggcacgctggtaatcggcataaggcactttggcatcaatcggaatggtcttgcctcccggcagatgcacgatcatatccgggcgcaacgtacgcccatcggcatccgtgaccaccacctgggtgtcgaaatcgacatgttccagcaatccggcggactcgacaatgttcttgagctgggcctcgccccacgcgccacgcaccttgttgttgcgcaacgcggcggacagggaactggtttccttgtccaaacgggcctgctgatcgttgagccccttgagttgggctcccaatgcgcccatttccctcttgcggccctcttcgatctgcgtgaccttgttctgcaaggtatcaagattcttggcaactggcgcaagcgcctcgagcaccttgctctgttctttcaaacgtgcttcctgttcagcacgcttggcctcggcggcctgagcatccgcctgacgcttccgttctgcctccgcagctgcacgctcacgttcccgctgaatgcgaatctgctcagcctgctgcgcctgggcaagttgtgacttggcgaaagccagttgttgattcacaccttcaatctgagcttgcgcggcagcattgcgagcactgagctcagcgttctcgaatcgcgcattctccagcgaggtcttggcctcctccagctcctcgcttttgacgcctcgagccatctcctgacccttatgacggcctagcacgaagccggcgacgaggccaagccctgcaccaaccactagcacgacgatgacgataatcacggttcctatttgctcaaacatggtacccagtatgtcatcgatggtgaatgacggtaaaactcgtcacgatttgacgagacgtgcgatggccgcggaagcctccgcaagtttttcatcggccacctcgccgccctgaatcgacgcctgccgcacgcaatggttgagatgatcgtccagcagcaataacgccacggatttcagcgccgaattcgacgccgaaatctgcgtcagaatatcgatgcagtatttgtcatcctccaccatctgcgtgatggcacgcacctgtccttcgatacggcgcaatcgtgcgatgaccttggccttgtcttcgtcataaccatgcatcgcaaaccccctgatacttatccgtcagctgaacacaccccattatataccctctaggggtatagagtatacactgttgttcagtacaacaaacaaggggaaggaacggttatggagttcagcatcttctcggccgccacggcgctgatagcggcggccgcattgacatggctggtactgcggttcttcttcggaacgcagaaagccacggccggggccatggacgcctctggcgaacgccaatccgcaacgatcaccgtcaagggcgggtactcccccgccgtgatcagcatgcgcacgggtacgccgatcacgctgactttcgatcgacaggagaccggcgaatgcacttcgcatgtggtgttcgcggatctggggcttgacgccatgctgccgggcaacgccaccaccgacgtggaactaccggcgttgccggcgggcgaatatccgtttgcatgcggcatgaatatggtgcatgggttgttgagggttgagggagaggagagtaaggacggtgcggataaggacgggcttcgcccgcgtgctgacggctcggccgaagccgagggggtctctccctcagacttgcgggttggagctccggttgtggatgcggcggaggccgagcggcgagaggcggctgaacgcgccaatgagatcaaggcgctgacgaagctggtgattgtgggcgcggtactgacgttgccggtattcgccgtcaccatgctgcatatggccaatcccgcgctggcgccgcattggatggtgaacccgtggctgcaggccattctcatcacgccggtgatgttctactgcgggcgtccgatccacacggtcggcttccccgcgctggcgcaccgctcccccgacatgaactcgctggtctcgctgggcacttcggctgcctacctgtattcgctggtgacctgcatcgccccgtgggtgttcccggagggctcgcgcgagccgtatttcgaatcggtgggcgtggtcatcaccctggtgctggtcggccgcctgctggagaccaaggcccgcgaaggcaccggcaaggcggtgcagtcgcttatcaaactgcgcccgcgcaccgcgcacaagctcaacgccacttccgcagacaatgtggacggcatcgaatggcgtaatccggcgcatttcacggacaccgacatcgacgccatcgccaccggcgacctgctggtcgtcaagaacggcgagcgcgtgcccacggacggcgtgatcgtggccggcgaggcgcgtatcgacgaatcgatgatcaccggcgaatccaagccggtctccaaaaccgcaggcgacccggtgaccggggccaccgtgctgctcaagggcgactgcgtgatgcgcgccacccaagtcggcgcggacacggtactctcgcagatcgcggcgatggtggcccgcgcccaggcgaccaaggcaccggtgcagcagctggccgataagatcgcccggtatttcgtgccggcggtgatgatcatcgccatctggacgttcgccatctggaggtcactgggcccggcgccgcaactggcgcacgcgctggtcaccgcggtcagtgtgctgatcatcgcctgcccgtgcgcgctgggactggccacgccgctgtcggtgacggtctcgctgggcttgggcgccaccaacggcgtgctggtcaccagtgccaaggcgctggaacaggcgcgtcgcatcggcaccgtggtgttcgacaagaccggcaccatcacgcgcggcgtggtggacgcggccgccgactgggacaagccgagctacgagcaggacacggtcaaggaaggctcgcgtgaggccatcgcggcgttgcgcgcacgcggcatccgcacggtgatgctgtcgggcgacaaggccgaggtagccgggcgcatcgcccgcgaagtcggcatcgatacggtgatctgcgaggtcaagccggacggcaaggcctactggatcgccaaactgcagcgcgaacgcgacgaggccaccgccaagtccgcgtacggcacctcccgcacggccgcacaatcccgcactctgattgcgatggtgggcgacggcatcaacgacgcccccgcgctggctcaggcggatctcggcatcgccatcggcaccggcacggacgtggcgatgcagtcggcggacgtgaccttgatgagcggcgacttgcgcggcgtcatcaagaccatcaacctgtccaatgccacgatgcgcaacatccgcgagaatctggggtgggcgttcggctacaacgtcatcggcattccggtggccgccggcgtactctacccgttcaccggctggctgttgagcccgatgatcgcgggtctggcgatggcgttgagctcagtgtgcctggtgctgaacgcgaaccggctgcatggagcgaacatcaacgtgggcgttgccgatggtcccgccggttcgggcagcagcatggcggatgtcgaatcagccggatcggccgaatcagccaacgccgccaacatcaccggctccgccacatccaacgcgcctcacgagccgaccgtcatcatcgatgatcgcaccacgctgaatcaaaccaatcacgtatctgaccaatccaataatccaaccaacaaggagaacactatggatacgggaatgcacatgcaccacaccgcccccgcggacggcgaaaccgccaccgacccggtgtgcggcatgaccgtggctgtgaacgccgacgcgatcacgcgcgagtatgagggcaagtcctattacttctgcggcgaacactgtgccacgaacttcatgaaggccccgcaggtgttcctggagcagtagtctctgcgtttacctgattcaacgacaatggcctccgcccaaaacgagcggaggccatttgcatatatgaatcaatcaacgaatcagctggcgaagaagaacacgaacagccaagcgccgataatggcgccgacaatcggggccacaaccgggatccaggcctcgccccagcgggaggagcccttgtgcgggatcggcaggatggcgtgcagcagacgcggcatgaggtcgcgggccgggttcaggccagggccggtcgggccacccatggaggtcacgaggccccacacaatgaagccgacgacgatggaggcggcggcgtaatcctgcttgccccaagccagggacaggcagcacagggcgccgaagacgagcaccagggtgccgaacatctcgttgaggaagtagttgaccttctggttgtccgcgtcagtggtgcagaaggtgcccagaatcgcctcggcgtcctcggtctccttgtagtgcgggtagtaagtgatgtagacgatgagctggccgagcagggcgccgagcagctgggcgacgatgtacggcagcacgtcgctccacgggaacaggccgttgacggcctgggcgatggtcatggccgggttgatgtgcgcgccggagacgctaccgaacatgagcaccgggaacatgacgccgaagccgtagcccatggcgatgttcagccagccggcgtggtggcccttggtgttcttgagctcaacgttggccacggagccgttgccgaagatcatcagaatggcggtgccgaagaactcggcggccagcttggtaaagagaggataatccactgcttcttcttttctcttcgccgcgcaacaggcatggctgactgttcacggcattctgtgtgactggaaatccgttcgcggagccggcgacgcgatttacgctgggcgcgaaagcaaacgtggtgattgtacactttgccccacgacgaaatgccggcaagatgcgatgtcgaatgtccagccgaatgcaatgcccaaaaagccatcggaatcagccgaagcgaccttgaatctcagtggttgcgaatgacgttgcgcaggggcaggacgctggtgggcgagacggacagttcgtcgattcctaggcgcaggaacgtatcggtcaggctcaagtctgcgccaagctcgccgcagatgccgcaccagatgccatgacgatgggcagcctcgatagtcatctggatcatgcgcagcacagctggtgaatgcgggtcggcaaagcgttcgagactcgggttctgacggtcacaggccagcgtgtactgggtcaggtcgttggtgccgatggagaagaaatcgacttcggcggccagctcgtcggccataatgaccgacgcaggcgtctcaatcataacgccgatctggatactctcgttgaagtcgatgcgctcgccgcgcagctcgcttttggcttcttcaagaatccgcttggcgtcgcgtacctcctgcacagaggtgatcatgggcagcataatggcgatgttgccgtatgctgaggcgcgcaataatgcgcgtaactggactttgaaaatctccgggcgggtcaggcagatgcggattgcccggtaaccaagcgcgggattatcctcgtggctcagattgaagtagtcgacctgtttgtccgcgccgatgtcgagcgtacggatgatgaccggacggtcgcccatctcctgtgcgacttgtccgtatgcatcgaactgaaattcctcggtcggccagtcctcgcgttccagatacaggaactcactgcggaacaagccgatgccctcagcatcgttggccagcacggcggctgcgtcagagggacggctgatgttggcgtacaggtggacccgctgaccggacttggtttcggtgggcttgcccttgagcttccgcaggaggcttaggtgctcctcagcctcggccttcctgcgccggtattcggtcagcgtggcctcgtccgggtcgacgaataccgcaccgctggtgccgtcgattacggcaacgtgaccatcatcggccgggtcaaaggcgtcgccgatacctgtgatggcgggcaggcccatcgtgcgcgccagaatcgcggtgtgcgagttcgctgagcccttggcggtcacgaggcccaaaaccttagcgcggtcgagctgcgcggtatcgctgggagcaagatcttcggcgaagatgatgtggctttcgccgttctgcgcgatcccgttctgcacaataccgttctgcacagcatcgccttgtacactgccatcctgcgccgtgctatcgcgtttgccttgcagcacgttcatcacgcggcgagaaacatccttgacatcagcggctcgagcctgcatggtcgagctatccatcgcagcgaacatggcggcgaactgttcggcggcgctcttcaccgcgaattcggcgttcaccttgtcttgcgcaatcaaaccttcgacgcattccgcatagtccgggtcctggagcataagccgatgggcgtcgaacagttcggccttgttttcgccgaactcagcggcgacgttgtcacgcagttgcttgagctgagcgacggccgtgtcacgggccgcgcggaatcgatccatctcggcctgcgggtcgtcgattaagcggcgttctacggcataatctacggcggcgagcacgcggaccgtgccgatagcaatgccagcggatacgctgacgccctgtatcgttctcattacaggtgctccttgaggaatcgctcgaactctgcagcagcgacagcttcatcgttgccctgcacccgaaccgtaacctcgtcaccttgttgaacatcaagtcccataacaccgaagatacgcttggcatccacggattttccaccgtaggcaacggtgatgctcgattcatattcctgcgctttggcaaccaaccggccagccgggcgggcgtgcatgccttcggggtcggatacggtgaacgtgaatatctgaggcatgacgttgctccttacacgtccggccgtcacgcgcgaagacggcctttccgcaccagctacggactgatactggaaaaaacaaaaaaccggaatctttcgattccggttgtctgtgcccccgcagggattcgaaccctggacacgctgattaagagtcagctgctctaaccaactgagctacaggggcttggttagatgttgaagtattccttgcaacaggtgataaatatactcagatttgaagcgaatgcaactctcggcgtgtcgcgcctatttccggcgtttttgctaatacaaaaatcccccatgcggcgcaaaccgcacgggggatgatgcttaagctcagactcttggtctgtgtgattccagcactaggccggaatgactcactcggccacgaccttcacgaagaaggaagcggtgatctccgggtggagggccaccttggcggggaaatcgccggtggtcttgatggtctcgacctcgatggccttcgggttcaccgcagccttgtcggacagagcgacggcgatggcctcgttggagataccaccgaacagcttgccggactcggacaccttggcggcgatctcgacggtagtgccctcgatggcggccttagcggcgacggcgtcctcgcgggtagcgacggccttggccagacgagcgcgcttcatagcgacgatctgagcctcagcgcccttggtccacgcgaaagcgaggccctgcgggaacaggtagttgcgggcgtagccggacttcacgtcgacaacgtcaccggaatggcccaggttggacacggtcttggtgagaataaccttggtttcagccattgttcaaagcctccctaactcagcgacccgaggtggcgtacggcagcagggccatctcgcgggcgttcttgatcgccttggacagctcacgctgctcctgcacggtcacgccggtgatacgacgggaacggatcttgccgcgatcggaaatgaacttacgcagcagcgcaacgtccttgtaatcgatctcggtgaccttggcggccttcagcgggttcggcttcttcttgaacggcttgaccggcggttgcggcctcttacgtgacatgatgttctccttataaatcttgatattgattgctgctggcagcggggaggcaagtactgatcagaactccgggtcggaatcgtcgccgccgaaatcggaggaagcgccgaacgtggagaagctaccggcatcagatgcaccggcattactccacgggtcgaccgcaggagcggacgggttggcgggagcggcagactgctgggagtatccagcgccaccaccctgatagccaccgttgtaaccgccctggccaccggcataaccaccttggccaccctggttgccatagccctgattggactgctgaccaccctggaaaccaccggaacgaccctggaagccgccctgaccggacgactggcgagtcacctgtgcggtggcgtagcgcagggagggcccgatctcatcgagctgcatctccacgacggttcgctgggaaccatcctgtgcctgataggaacgctgctggaggcgaccggtggcaatcacgcgcatgcccttcttcagggactgggcgcagtggtcggccagatcacgccaagcggagcacctcatgaacagcgcctgaccatcctcgaactggttggtctgacgattccaggttcgcggggtggaagcaatcgtgaagctcgccacggtcgcaccgctgccaatagtgcgcagctcggggtccgcagtgaggttgcccacgatggtgatgacggtttcacctgccataacggtccttcttacttaccttgaataccagctgttcagctgactaaacgcttgattcagcccttacgaagaatcttcgtacggatcacggattcgttgaggttcagaacacggtcaagctcatcgctggtagcgggctcggcggtgtacttcaccacgacgtagttgccttcggtcttaccggcaatctcataggcgagcttgcgacggccccagtaatcgggctcatcgaaagagccgccttccttggtgacgagttccagatactgctcggtcagcttcttcagaccgcgctcatccagctcaggatcggcgatgaacatcagttcgtacttgtgcgcagacatcacccacctccttcggactattcggccacggacgttccgtggcaggagtgtgtatgcgtgttagcccatgacgcagcaccaaaccggcaccgcctcttcgggcaacttggacagtctatatatgaggcgggacagggtatgcccatattcttgccggtttcgcgatgcccaccgttttggccaagcccacgcagcccgcggctcccatcactcccggagcggcaccggtagccgcacctggcgcgacctccaccaccatgaatgagcaacagaagaaaatcttcatcatcgttggtgccgtggccggcttcctcgtgctgttcggtatcgtgtatggcgtgctgtcttccgccgtgttcagcgcgaagagcgttgcgaacagctatgtggccgccatctcctccggcaactacgacaaggccaacaccatcgccgatcctcacgtgaatacgaaccagcgcgcactgctgaccagcaaggcatcctcgggcgagaacacgcgcatcaccaacgcgcgcatctcgcagacctccaataatgccgatggcaccgtgagcgcccagctgacgtacacgcttgaaggcaaggaggtcaacggcaacttcaccatcaaagacaataaggtcagtgtcgagttctccgagtgatttcggcaatctcaacactcttacgaaataagcaccccgccgtggcgttcgctgcggcggggtgcttgtacactggttaaggcgtaaatcacacagcgactcaaacaaaggatgcgaacgcatgtcggcgattcttgaaggcactccggataaacgactcgtattggtcacgggccgcgcctaccccgagctagctgagaaggtggccgaatgcttgggaaccgaaatcctcgaaaccacgtcctatgactttgccaatggcgagatgtacgtgcgtttcaccgaaccggtgcgcggtgcggacgtgttcgtgctgcagtgtcattcgggcgatatcaacaagtggatcatggaacagctcatcatgatcgacgctttgaagcgcgcctccgccaagtcgattaccgtggtggcgcccttcctcggctactcgcgccaggataagaagcaccgcggtcgtgagcccatcaccgcccgtctgattttcgatctgttccacgccgccggtgcagaccgcattatgacggtcgatctgcacgccgctcaggagcagggtttcttcgatggtccggtcgatcatctaaccgccatgccggtgctgctcgattacgtgcgttccacccttgatctgggcaacaccaccatcgtgtccccggatgccggccgtatcaaagtgtccgaacagtgggccgccaagctaggcaatctgccgctggcattcatccacaaacagcgtgatattactcgtccgaaccatgccgaggcacatggcattatcggcgatgtcgacggccgcgactgcgtggtcatcgacgacatggtcgataccgccggtactatctgcgaagccgtgcgcaccctgaacgaatccggcgccaagtcggtgacgctggtcgccacccatggcctgctctccggcccggccgtggagcgcttgtctcactgcggcgcgcatgaaatcgtgtttatggacaccgtgccgattcccgaagagaagcgcctgccgaatatgaccgtactgtcttgcgcaccgctgctggccgcgggtattcgctccgtgttcgaggaaggttccgtggcgattctgctcgacggcctgcccgaggacatgcgtccgcgcaatatctatgcgtgattgatacgccgaaaatccttacgaaaaaacgccgcttggctattgatcaagcggcgttttttcgtatagctccaatcagatgaaggcgcgctcgccgaagatggcggtgccgacgcgcacgatggtggagccttcttcgatggcgtaggccatgtcatgggtcatgcccattgacagttcggtgcagtcggccgtgccttcggcaccggaggcaagaatctggtcacgagtgcggcgcagatgcgcgaagcccgcacgaatcgtgcgctcatcatccacatgggcaccaatagtcatcaatccctgcaagcgcagtccgcccatcgcaccgatgcgctgggccaagtcgatggcgtggctgggtgcgcagccggacttcgattcctcgccggattcgttcacctccagcaacacgccgaccgtgatgccgcgcatggtggcacggcgggcgatcttttccgccagttcgatggaatccacggattcgatggtgtccactaccggcagcaccttgccgattttattggcttgcaattggccgatgagatggaaaggaatatgcgttgcagctgcggcattggccgtgtcagcctcagcggcatcaatcacgcctagcgaataaccacgctcccccagtcgttttgccagaccgtcagccttgacagtaatctcctgtggacgattctcaccaatcacgcgaataccagcatcgatagccgccagaatctcgccgacatcgcgcgtcttggtggcagccagcaattggaccgaaccggcagcacgcccggctgcggactccgctgaggcaatccggtcaagcacgcgatgcacaccatcagtaatctcttgtgcgcgcgcctgatcgataacttcgttggcgagatccttatggtccatgtatgccgtcattgctgcccctgttcgtagattccccaccatcgtagtctcatacgcgcacataatgcttgttattgaacaaaagtgaagcccccgctgttcatgcgcgggggcttggtgatgctaggccgagcgagtgggactagcaggtaccggacttgcggcgcttgaggatgattacacccgcaacagcaagtaccacggcgaggatgccaacaccaagcacggctgcaccggtgtcaggtatcttcttgtgcttgccggagtctgcatcacccttgttctggttggaatcgttgccttggttgggcttgtccgtgccggaaccgggcttatcgccaccctggccaggcttcgtggtgctcttctcaaccagacccgcgatggcatcgctgattgcctcagtcgcagcctgtacgtcagactgggcggcctgaccatcactcgtcagcgcattcgccgtagcgactgccgaatcaagcacggccagcgattcatcagtccactttgtgcgatccacggcagcagcggcatcgagctgagcgctcagcgcggcacgatcttgcaccgtagctacaagcaccagcttcttcgctgcctgcttcagctgggttgcggcatccaccaccgcagcttcggtggcatcctcagccttatacacctgctgcgccgaatccaataccgccgcgtactccgcccatgaagtctcggtgtacttggaggcatcgtcagccttaggcgagtcagcgagcgcctgcttgagctcggtcttgtcgatcggtgtgggctcaggcggctcaggcgtactgtcgtcaatggcatgaacctgccattcggcaacagccggagaagccgagccggacgtgataaccatacgcaacttggtagtcttgaccggagtgttccacgtgccatcagaccaccccttggcatcgccggtggcccagccagcagacggtgaattggcggtcacagtgtaggtggcgtcggaaatatccacgaagttgccggcaccgttgttcgccaaggcgtcccagtactgcaattcccacgatgccggaatacccaatccgccatcatccgaggtgaattgcacgcggctagagtcgatagtcacttcacggtcccactcgtagtcgaggcgcatctcaccggtgttgggccaagtgccccagacatcctcgttggcaatggtgatatcgggaatgatcttgccgtcgttcaacgcggcggcacccttgacccagccggatgccttgccgtccacatcggtggcggtggcatcgccctcaatgtagccggtcagcggcacggaagtgtcggatggaatgtcggttttcgccgaagcggacacgttgccggccttatcggtggcgcggtagtacacggtggcgcgcgacgcgctcggtgcagcaatcggcttgctgtacgtggcccattgaccgtctgtgccaatgcggtattcaattgatgcgacaccggaaccggtgccgtcatcagcggtcaaggtcagcgtgcgctcctccttatcggcggcggcggtcacggttggcgcggcggagtccaccttgccgccggccttggccacgtcggaaacgttgccggcctgatcggtggcgcgagcccacacttcgacatcgccctgctgggaaagcgtggcaatggccgcgtttgcattcgcggcgatggtggtccagctcttgccttgatcagcggaaatctccagcttggcgataggtgcggtgtcgtccgtggcctgcacggtggcgaacggagcggtggtgagccactcgctattgcctgcgttagcagtaacggcaacggttacagtcggcttcgtggtatcagcggcaggctggtagccgtcctgcacggtgacatttaccgacacattgccctgctcgcttgcctcaccgggcacgccggcgaccacgccgtaggccgtaaacgaaccgaccttggcatacgaggaagcatcaactggacgccaaattactggggaggcaacggttgggttcccgtacttcacatccactgtggccggcagagtaggcgcagtaccggtggcggtggtcacgctcttcggcgcggtgattgccggcgattcgctggagtcggagccgacttcccattcagcaacggccacggaggcatagccgccatccacagcttgaccggtcatgtcgagctttaaggcagtagtggtcaccgcatcgaaggtgacggcgttggggttggccttgcctgtggtcgttgtataggcactcgggttggtgacatccttccatgtgccgtccgcgtccaagtactgaatcttccacgaggcgggcgcgcgcagagcgttggaatccacgtcgaaccaaaccttagacgagttgacgcgcacagtgccatcccattggtagaccagagaatcgccggactgcgattgcgggatagaacggtagttggtccagtgattcggcgggaccacagcggtttgcaacacacggccgtcgttcaccgaacccttccaagcaggcgtttcagtgaacgtggcgctcacctttgcgtacggagccacgttggtggagggctgcgttttctcggccttggttggatgggcggtggaaaccatctggccgtcggcggtccaatcgacttcatcaatgcacacggcacggcggaaatcggtgccgccttccttgtcgccggtgtgataggtcacataccatttgtcgccgaactggagcaccgaggggtgcatcgtggtggccgagccagaaggcacgattacgccttggtacttccatgggccgagcgggctgtcggaagtggagtactggatgcaagcttgatagttcgattccacgcaggtggccgtgcccgaaccgggcttaccgccgtcgtacacgttgtaataggtatcgcccttacggaacacccacgccgcctcgaagaatcccttcgggccgttcgcgttgctgtccgcgtccttcatggtgtggaggttcggcgtggtgccatcagccttggtttccacctcggtgtatgaggtgcggccggttgtggcgtccttcttcatcttgatggcgagctgagtgccgaacgtaccaaagtgcaaatatccggtgccatcctcgtccacaaagaatgccggatcgatggtttcaatctgggtttgcgatgtggtgagcagcggcttgccgatggcatccttccacgggccgagcggactcttcgacttggccacgccgatggcgaacgggtcctgtccagccgcctcagaagccttgtccttcaccggcacgtagtagtagaaccaatcatcggaagtgtcgctcggggtgccgttatcgtcggctacgacttggccggcgtacgcgccatcgccggtggcccagctgaacaggtctgccttggcgatggtcttgtaatgtgtccatttgccttgattcaggccgtcttcatcggtgacgtatacgccccagtccttcatgttgaaggagccgtagtcgggcgaagcctcatcgtgaccggtgaagacgaagagtttgccgtcatagctcagcgcggatgcatctgcagagtagtagttctgcgaaagatcgttcggggtgtcaataccctcgttctgcccgatggggttgcgcatgtagctgggcagtgcgctattgtcgatttgggtgacggtgacatcaggattgttatacggcagttcgttatacgcgtgaccggcaacgctgggcgcgttgtcagcggtggctgaatcggcggccattgcggtcggcgcaagggcaaggcctgacagcaatgtcgctgcggcgacgagtccaccggccaccgcgcgaaccgattgcgcggatacatggaaactcatagtgctcctcattgagtgagtgaaaagagtaatgatgggtagaaggaaaaggctagagccccctctgtgagggggctcactcggcagaatgactccgttgcgggtcaggccgagtggcgagccgaaccgtggtcgccggactggcgacgcttcaggatggtcacgcctgcggcggtgagcagcacggcagccgcagcaactacggaaaccgcggcaccagtcggaggcacacgatcacccttgttgtccttatcatccttatcagtgtcggtcacaccaggctgctgggagccgggcttctgctcaaccttggtggcccaaaatgccttgtcaagggcatcctgtgcggcatcgacgtcggcctgcttggcgtccttgtcgtcgtacaccttctgagcggcggcaatctggctctgcagagcctgccatgccttctcggtgtacttcgacttgtcagccttcttggcctgctcgatggaagccttgagagactccttcttcaccgtttcgacggcgggcttctcttccaaggccttgacggccttgttcagcgaagcggacgcttcctggacggcggcctgagtgacctcaccgacctcaccgaccttgagcacaccttccgcagcctcgatggccttgttcaaggcctcgacactcttatccgtgtacttgccggaagcggcctcggccttggccgtgtcgatggccgcctgcaacgtggacttctccacgtcggtggcgagcgcaacgagcaccttctggccgtcctcgagcttggtcacctgctcggcgacctgttcttcggtggcattgacatcgtcgtacacagcctgggcagcgtcaatgatttgctggaactcagcccatgaagcggcggtgtagcggcgtgcatcgaggccgttggctgtgtcaagagccgacttgagcgcggtcttgtcgaccggggtaggttcaggctcggtgccgtcaataccatgcacgccccactcggccacggcggccccgaaggtgctgctgccggtgtacggagtgagcacgagtcgcagcgacttggtggtgaccggcttgaaggtcacagcgctccaacccttggcatcggtatccgcacgagaagccggcgaattacgcacgacggtgtaatcctcggtgggctcgacgtccttccaagaaccatcctcggcgaggtactgaatcttccaagcgtccgggacttccagaccacccttcgaatcgtcagtctcagcgaagttggcccagaactgggcgcggctctggtcaatggtcacggactgaccgaagtcgtactgggcgtacatgccgtcctttgccttgccccaagaaccccagaccttgtcgttgacgttctgatcatccgtggtcggccaagtatcatcgacgactacgccgtcgttgagcttgccttcggccggcgaccaggtcgcctcggaatcaggcgaaatggtggtcctggtcgccttgccttcaatccaaccgaccaacggctcaggctcaggctccggagtggaggaaccgttcgggtcggcaaccacgtggacagtgagcttggcagctgcggaagatgaaccgtcgtcgacggtaccagccacctcgtagtcaccaaccttggtcaggtcgatggccttgatgtcggcatccttccacgtgaccttgcggtcgtcgttgtatccgttcgggaacttcaccggaaccgtggcgggcaggtcgatggacttggcgttctggtagacggtctgctcaaccggctgcgcattacccacggtctgcgatgcggtatcggaacgagccgcgatgtgtgcaaccgtaccgttcagcgcaccggcgacggtgcccttgacatcgaatacggcatcggcggccagctgagcgtcggtcaccttaccccacgtgacggcgaggtcacggcgagaaccgtcggtgtatacggcgctcacggtggatggcagcttcagatcatcagccttggaaccggtctgcaccagtcggttgacttcgtccacgctcaccggctcgatggcgtacgcctcgaactcggaagcacccacgatggcgcccttcgggaagaccacgcgcagcttgtcggtttcgacggcgtcggcgaacttcacttcgttgccttcgttccggttgaccgtgtaggactggccgtcagccagtttcacatcctgccagttaccgtcagcgtcagcgtactggagcttccaagatgagaccatcggcacgccaccgccatcggtccagaagaagaccttggccttcttcagcggcaccttgccggcccacttcagttgcagccacggctccacaccagtggagtcgccccagttgttccaggtctcgttcggcgtgttggcgtataccacctgaccgtcgatgaccttcttggcgttgtccttcggctggtagccgttggtgtagctggcagaggcgctcgactgcggggttacgttcacggtaccgtcagaggggatgccgtgaacggtgatttccttggagccttccttctcgccatcggaagcggtgagcttcaggacgtagtcaccctccttgttgaaggtgacggtggtgctggcagcggaggcgtccacgaacttcgcagtaccgccttccggaccggagacctgggaccatgtggtggtgacgtcgccttctgcgggcagaccgtcatccttcaccgtaccgacgagcttggcaccagatgaggtgctggaagacacgtaagcatccacctgcggagtctggttctcggaagtgccgtcagccttgataccggtgttgtaggcttcgatctccttgacaccgacggccatgccggcctgcggcgtgaaggtgacgcggatggtcgtggtctccaccggagtgaactggatacggttgtagttcgcgcccgcgtagttcggggtgcgcacctgatccgcaatcggggcccatgtgccgtcatccttctggtactccaacttgtagttggcgggctcggcatagccggagatggtctggctggacgagctctggtagaagtacaagcggatgtcgtcgatcttctgcttgccgtccttgaacttgatattgagcgtgtcggtcttgttctcagagcccttggtaccccagaacgattccatcacggtcttgccgtccaccgcgttcttggccgggtagttggtgtccttctcggcgtaggtggtaccggtcacgtccgcgtccttggccacgttcgtggtggacttggaggcggagtcgacgttggtgccggacttggcgaacaggtcggtcacgcgctgatcggcattgaaggtaacctgattggcggccttcacgttcttgacggcttcggcgccgacggtaacctgggcactggaatcgtccttgacctcgaccgttcccgcagccgggtcatagatgaggtgcgccagcttgtcggaggtgaaggcgagcttgccgcccacgtacaggctgtagccagcaggaccaccgtagtggctgccgtccttgtcccatacgatggagacatcctgatcgtggtagcgcaggttgtttaccgtgaagtagttccaaccggggatttcgatcgggtttagctcaatcttgttgtcctcgcgcggcaccataccggctacgtcctcgaccatcgtccagttcgtggtgccgagctgggtgtggtggatccaggagcggtaggtgatcttgccgccgttctgtgcggcgtcaaggttcttgtcgaggttgttgatcacgccgtcaccgttcacatcgccgacgttgttgttgtcctcgttccagaactcgttctgatcagggtagttgttatcgccgccctggtagtgcgcgaacgccacccagtacagcagcttcttgaactgctcattggtgatgtagccattcttggctgcatcgtagttgcgaataccggccgagtagacctgcagcagcggctgcgcattaatgatggagaagttgttggaaccggggaagttcaacgcggccttgtccgcttggttggcggtgaagaacgggaagatcgggaactcgttggaatcctcgaacaggcgcagagccttgttgtaatcttcgttgccggtaggcatcaggccttcggagtacgggtagtagttattgatctccttgtacttggcgaaagcaccgtcgttcagccacctgtgcttgagcaggttgtcggacttgtcccacagttcagtggtgacttctttctggatcttgtcggcgatggcctgcatcttctcggcgttggcggtatcgccagcagccttgtatgcctgagcagccgcgttagcgttggcccacatattggcggaaccatcggcgcgatccatgcgctggccggagcgacccggctcagagaaggaaacggcgtcggcatcgttaccggtcatcgaccaccaggaccagtcaatcaagctgttgtcattgttgttctggttgtcgttgttgtccggctcgctcttggaagcgagtagaccttgcacgtcctcggcaccctggtcggccagcttctcggccacggtggacggaccgccgtgcaccttgtaggagtcccagccggcgcgcgtgatgtactgcgtgtagctatggttccagttggccgggtcgcccggattgtcgtggtagtagtaatagcccgccttgctcttcttggcggtatcgccggcggaaagccaggtgccgtaggagtactcggggttgcggaaccacttggtgtccatcatgaacatgccggaggtgagcacgatctggttgttgtagccgagcacaccctcgatggaggtcgggtactggaaggtgttgccaggtatgttggcgtcgagcatgttgaaacgactcagccaccagcggtagaccacggtcttatcgatgttgtcttccggagtgtccacatagggagcgttatcgacccaccacttgttgtaggtggtcacggaatccttgtaggaggcggcagcatccttaaagtcgccggtgtaacgggcctcatattccttggtggagtcaggcagttcgttggcgatcaggccgagctgaatcttgacggtctgcggttcgttggccttgaggctcaacgtgctggtgagtttgccaccgctgacgatccagttggaaccgtcctggttgttggcggagaagcgcggatagatggtcgtcaggttgttcttgacgttcacgcggccagtaagttcggtggcaccatcagcaccctcggcggcgaacggcgaggccgtggtcagtgtgacatcgcggtcctgcgtgctttccacggtgaggttcgcaaccatcacgttgttgtaggtgatgtacttaacttccttgatcttgaggctcttgccaccggtctggaacagggaggtgaagtagctcggtgtctgcttgcgctgggaggcgtcttcgttaagggtctggtttgcaccgtcagcgtttacggtaacggtaaagccatccctgttggtctcatcccagtaggcggtgttacccacaaaaccgagccgattaggcgtgtgcgtgtacatgtaggcggcgcgaccacgggtgaacaggtagttgttgccgtcggagccttcatacgagtaagaacccttgtcgttcgtgcctttaccagttggctgtgcaccagtacgggtgagaatcttatcgatccagaagtcatggtcggtgtcggtgccggccaggttcttcacgtcgttatcgaatgtctcctgcagatagctggcggcagggttatatgtggtgttgttcgccgccgtcttcatcggatcatcagatcccttgaacgacggatatgccacatccgcattcttgatgacgggcgtatcggctgcctgcgcggtgactgcaccgccggtggccagtgtggcgaccgctgcaaccgcgccgattgacgcaagccaccgctttcgtgttgattgatgcattcctgcttggacctctccgccccggtctttcgcgtcttcgctcaggctacgtcgcgtctatgcgaccaggacttcttctgtggatgctgggccgcagagcccgttctccatcagtttcctttattggttattgggttcaccggaatgagtgtcttcagtaaatctggtgtgatatccgccatggatatcccggttggagcaattcaccgaagctgattccacatcataaccgagcgaatacggtttcacaactttccctcagtgatatcaaccatcttatacaacaaaaacccggtaatttctcagctttcgcatttattttcgcattagagcattgctgcgtttcgccgtgtcgcagtacctacggcgcaacgattcagcctcgctgaatcaggaaccaacaggctcccgctggcgggagctggctcgcaaagcgagactgagggtggcttacacggtaccgcttatgaccgccctcagtcgactccgccgacagctctcacagcaggagcatataattaaaaaataatctcctgcacgggtattaccccgcacaggagacctcattccccggatgtgttttcggctccaatcgatactgacatccggcctatgccgtcatcgacttattacagacgatggcggcataagtatttttttgccggccagttgcgcgcaggccggcatatcgccgatatttatcgacgctggaagacacgcatctcgcctatctcgcggttggcccacgagtagtacggcaccaagcgcagcgtcgcgggttcgcccgcacgcggttcgtcggcatccacgtacagcggcgcgtcatcctcgtcggcgtgctcgcgcactgccggcaaatcaacggtatcgacgccacccagcaagtcggcctggaaagccacagcggcatccgcaccggtgacgccatcggccagacgatagttccacagatcaccggggttatcgacctgttcggcgcagtagaccagcggtccgcgcatcacggccacctgaccggcatcggagcgcacgcgggagttggcgcgcacgaacttcacggacatgtcgagctcgagcgcaatctccaacgtatcgccggcgttgaccacaaggtatacgaagccgtcttccagcgaacccactgcgggcttgccgttcacggtcagcgtgtaggagccccgcgaccagccggggatgcgcagtccgaaacggaccgagctgtcagtggcgctggcgggcaggctcaccgtgtattccacatggccatcccacgggaagttcgaacgctgctcgaccgtcaggccggaagcgaattcggctgtgttggcgatgaactggtggctcagcacggtcttgccgccgtcgcgctcggtgtagatgtagcggtccacggaggcgatgagtcgggcgatgttggccgggcagcaggcgcagccgaaccagtcgacgcggtgggagagcacgtggtgacggtccgggttatccagtccgtcaggcgtggtctccagtgcattgacgtagtagtactgcttgccgtcgagcgagatgccggcaatggaaccgttgaacagttccttctccagcacgtcggcgtattcgcccttgggctcgaggtcgagcatctgctgggcgaacatgctcatagccacggaagcacaggtctcaccgtacatcgtgtcgttcggcagatcatagtcgtaggtgaacgactcgcccacgtgggtggaaccaatcgcgccggtgacatacatacgacgggtgacgatgttcttccagaaacgcttggcggtgtcgatcagcccctgatcgccgagtagtcggcccacgtgagccacgccggtgcacaggtaaccgacgcgcacggcgtggccgtccgcggtctgctggtcgcgtacgggctcggcagcctggaagtaggtgggcttgtagaagccgagatcatggaagatgttgtcgccgttcatcgccttgagctgcttggcgtagaactgcggatcctgaccgcgcacgtcgatgagatactgggaaagcgtcagataacgcttctcaccggtctcttcatacagcttggcgagggcgagctcgatctcaggatgaccatcggcgccgtggatcttgccttcttcggggccgaagttggcatccaggcagtcggccatctttttggcgacttcaagggcctgctcgttgccggtcacctgatggtaggcgacggcggcctcgatgtagtgacccatcacgtacatctcgtggctctgctgaatcaggctgaagcgcgggcggtcggcccatacgccggacttgatctggtacggggtgtccaaatagccgtccgactgctgggcgcgggcgatgagatcgaccgtgcggtcgcacagcgccttgagctcgggatccgggtggtatgccaatgcgtaggcggcttcctcaagccacttgtagacgtcggagtcttggaagaccatgccatggaactcgtcgtccaattcgccggcggcaaccttcaggttggcaaccgcatggctcttgttgtcagccagctggttgccggctgggtcgtcgggcaccgtggtgtcgatctcgtcgttcatcacgccccactggtaggggatgacggattcgacgatctggtcgcgacgccgcttccagaacggggaagtgattgtaacgttcatgattgtccttttttaaggcccttgaccacaccgcctccggccctgcaattaaggaccggtttcagccgggctcagtattggcttcgacgctgtcgcgtctcagcacggagcttgctgggagcccaccgggctcccagccaagggccggcggcacgagccgtcagcccttgacagctccggccataaagcccttgacgtagtacttctggagtgcgaggaacaggatggcgcagggaatcagcaggatcacgacgccggcctcggtggcaccgtaatcgatgacgcccatggtctgctgacgcatgttcaccatcgccagcggcagcgtggacttggacgaagagctcaagtacagcggaatcatgaagttgttccatgcctcgaggaaggcgagcaggccaaccgtaaccatcgaaggcttgaccaccggcaccaggatcttgaacaaggcctggaggctgttgcagccgtcgaccatggcggcctcctccatgtccttggggatcgcgtcgaacgcgttgcgcatgatgaacgtgctcataggcagctggaacagggtgatgaccaggcccacgcccagcaggctgtcgttcaggccgatctgcttgtaccagaccatcagcgggatcagcagcgaggcgtacggtaccatcaggatcgacagggtgaccatgaagccgaggttgcggcccgggtagtcgaagcgggagaacgagtagccggccagcgtacagacgaccacggagaacacgaccgcgaccagagtcacgattaccgagttgaacaggtacttgggcagaccttcctgataaccgaacagggtcaggtagttggccacgccccagcccttggactgggccgaaccggcctgcgggctgaacgagcagatgatgacccagaccagcgggctgatgaagatgatggccagcagggcctcaaggatccgggcgatgatacgcttccacaatggggtagtcataatgtgttacctcccctttctcacttggtgttgtcgcgcatgccgcgcatctggatggagttgatgatgaccaaggccaccagcacgatcagcgagagcgccgcggccatacccagatccttcttggaatcgaaggcgaagttgtagatgagctgcaccacggtcatggtggagttgttcggaccacccttggtcagaatgaagaactgatcgaacgcgaggatcgagccggtcacgcagtagaccaggcacatcacgatggtcggcttcatcagcggcagggtgatggagcggaagatacgccaggaaccggcgccgtccatgcgggccgcctcgtacagatcaccggggatggcctgcagaccgatcatcatcagcagcatatagtagcccgagaatcgccagacaatcacgataatcgtggcccacagggccgactggccagtggccagcaccgaaccgccctcctgcatcaggcccaacgagctcagaatcttggtgacagggcccacctgcggggaatacagtgcgtagaacagcagggacgcggacgccaggcccgtcgcggacggcagcaggaagcaggtacgcagcacgttgttccacttcgagctctcctgcacgatcatggccatgcccaggcccaggaccagcaggaagaccgtgacgatcacggtgtactccaacgtgaaccagatcgagggccagaacaatttgttctcgaacaccttgacgaagttgtccgggaagttcacgccgcggttgccgcccagcaggctccaacgcgagcaggccatcaccaccagcagcacgatcggcacgaagaacaggacgacgatcatcagccagtccggcagcgagtacaacaggccgcgacgcgtctcggccgccttcgccttggacttatgcacgggcaccaccccggcgctcttggaaacactcgacatgtttctctctcctttggggaataactgtgaaatggtaatcacggaatccgaatgcaatccgatgtcagggcttcgaggaaggaggactccgaagccccgccaacacaccgcattcataaggtatgtagtgatgaaggaagagaaggaatgaagaagaagatagaagttcgattatgtggttgagccggctcctgccctcacaagggagggaccggctcaatctgttcagttattattcagttattgctgtgatttgatgagtgatggtgaggagcatcaccaccgaatcactgggcagacaggacgtcggtgacggccttgttgtcggccttgaggtcaccggaaccccacacggcgttctgcacgagcagctgccacggggagccagcggcgttgaaggcttcgttgaaggccggggacttcggggtctggccgttgccgtcgataatcacggagttgatggtctggatgcgtgggtcagcgtctttgtaagcggtcttcagggtctggatgttggaggcggtgtcgccttggtcagcgaagacttccttctgagcgtcagactgcatcagccagtagaggaagttccaggcctgagcaacgtgcttggagtccttggagatacccatggcatcgccgccgaggaacgtggaggtcttgccttccttggtgcccgggatcggagcaacgccgacctcgaagccgccgtccttctcagcatcgaacagagcagtggtggaggtgttcgggtaaggcataacgccaatcttgccgttcgcgaacggagcggtccaggtggcgccggtctcttccttggagcctgcacccaggccgttggtggtgttggccagctccttgtaagcgtccaagacgcccttcatggagtcgttgtccagggtggcctcggagccatccttgttcatgacggattcgccgtcagcccacacggacgggaagaggtcgaagaccagagcaccaccggactgaccggcgaggtaggagcctgcgacgccatccttgttgagggcggcgaccttcttggcctgctcgacgaactggtcgatgctcttcggaccctgctccgggtccagaccggcttccttgtacaggttcttgttccagaccatcacggaaacgtcagtgatgaacggcagggtgtactcggcgccgtcaacagtaccggcttcgatgtggccctgctgcaggtcggccttgttgtccaggccatcgatttgcttggtgatgtcggtgaagatgccctcggaagcccagtacggaatacggaccacgtcgccggcgaggatgtcaggcagggagtcggtctgcgaagcgccgccgaccttgccttccatatcgtcgttcgggatgatctcgagcttgacctggttcttgtggctcttgttgtaagcctcgaccacgttcttggcctgacgctccagaggggaacgggtccacagggtgatctcggtaccatcgtcggtgcccttggccgggataccttcggcggtggcagtgccaccattgccggagccaccacaggcggccagcggaacgatcaacgcggcggcagcgatgccagcaagagtacgggtcagtttattgaaagacaccatgttcgcttctttctctatatatccgctcaactatgagaggcggtggcggacggtccgcctccttggtttcgccctgctcgctcctttgcccggagcaggtaacactgcgaaagccttttctcaatataaacaaacatggaagtttttgcaaaagcgctttcgcattttcgcgttttttctcacatcaaacgggttcgagactgtgattcgactatgaataacgtgcttgaattggcttaatatcaatgattattccggcgtgtcgagcaaatcaaacaaaagcgaacatggaagtaacgctttctttcacttaccttgcacttgaacaatttccctgactacgccacgccgaaaaaaagatgtttgcgaaagttttcgcattgaagctacaattattcccagatgcaattgcgcaccacaccgtatgaggtatttcatcgcaaaacaatgcgctatatactgctgaagaaccaaggaatcgaggcatgatgacccagccagcaaccggacgggcagcgcgacttgaggatgtggcggcattggccggagtctcgacggccactgcatccaaggcactgcacaacaaaccccgtatcagcgaagaaaccaagcagcgtgtactggatgccgccaagcaactcaactactctcccaacaaactcgcccaatccctagcccgcggcaccaccggcactatcggcctggtcacctccgatctgcagggtcgtttctccacaccgattcttatcggcgcggagaacgagttgcgagcccaatcgacctcagtattgttggccaacgctcgtggcgacgccgccttggaacgtcagcatgtcgagaaactgctgtccctcaaggtcgacggactgctcatcgtgcagtgcgagaccaaccccaggcccacgcttggccatgactggggcgtgccactggtctacgtctacggcccctccaccgatcccaaagactgctcggtcacttgcgacaacgtggacgccggccgcatggccatcaaccatctcatctcgtgtggccgccggcacatcgccattatcggcggcgacgaaacctataccgctgccaccgaccgcaccaagggagctctcgaggcgctctccgaattaggtattgaacccgccggcccaattcgttacggcaaatgggacgaaggctggggccgtgcggccacccgtctgctgctcgaccaaggggtcaagttcgatgcagtggtctgccagaacgatcagttggcccgcggctgcattgacgtgctcaagcagcagggactgcgcatcccggatgacgtcgccgtcatcggccacgataactggtcggtactgacctccagctcgaggcccgcactgacgtcgatcgacaacgaaaccgaaaccatcggacggcgtgcggcacgatacttggtcgatgccatcgacggcaacccgcatcacggtgtcgactacgtaccctgccaccttatccagcgcgaatccaccctcccgctggactgataccaatcgataccctaccgcttcttggttttgcgcccctttaagtagatgtcgatgacgatccatacgccgagggcgaaggccacgacgtagcccatgaagccgatgaccggaatgccgaagataatcggcttcatgccggcgtagtagacaatcgacgagccaacgaacaaaccgaccacaatcagggccatcgtcagacgattcaccatatccgaaagcagctggaacggctcttcggagccgaccagttccatgttgacgcgcaactgaccacgggtcagcatacgggccacggtcttgagttcggtcatggtgccgagcgtggcatgcaaagcctgatgtccctcaacgcccagcgacttgatctcgtctttggtggcgttcttcagcgatttcgacgtggcgatatggtcggaaatgatttcgatcatattcacatcaggaatgaactcgtccagcaagccttcgagcgtaaccaacgcgcggccgacggtggtcaccgtactgggcacctcgatgttgtggcggccggccatctgcgtcagtgcggtcaggaaggcggcaatgtccagttcggccagatccacagtgccgaattccttgacgatcacgtccagatcagccagcagtgctgggtagtcctccggatcggcctcggtgccggcaaatcgcagcagcccctcggccagagcgggcgaatcctgtttggcgacggcgaaaatcatttctttgaggactgcacgggtgcgctggtcgagccgaccggtcataccgaggtcgataagtacgatctggccgccccggatgatgatattgccgggatgtgggtcagcgtggaagaagccgtcgtcgagaatctgcgtggcgtaattgtcgacgagcttggtgccgatctccttcaagtcataaccagcatcgacgagccggcccgggtgggagacggagatgccgtcgatgtactccatgaccaccacatgctcggtgcacagttcggtgtacgccgtcgggcagtccatgtatttgaatcgggcggcgaaacgcttgaattcggcgaggttgcgggcctcaatcagaaagtcagtctccgattcgaaggtgtcccacagctcctcgaccacgcccttcaggtccacgatctgtgaggtgcgaatcaccttagtggcggccttggctatggagcgcatgatggagacgtcctgagccatggtttcgcgcacacccgggcgctgcactttaatggccacatcttcgccggttttcagcgtggcgcgatgcacttgcgccagtgaagcagagcccaacggcttgggatcgatatgcgcgaacacctcgtcggcgggacgcccgtattcggcggcaagcacatccaacaccgtggaatacggcatcgggtcggcgtcggcgcgcagtttggcgagttcgtcgcagaagctttgcggcagaatctcggagcgcatcgacagaatctggcccactttgacgaacgtggggccgagcgcctcgaacatgaggcgcattttgaccggagtcaggccgtgcagcacgtcgaattgctcgacgattctggtgatctgccccagtcgtttgatcttgccacggcgcgtcagatggtagcgcgtggcgaaatcgttcctgcgtccgaacagtgccagcgtttcgtcggatacgctcggagtcgccttggtaacggtctgcttgagcgtgtccgacgtgtcgacggaccggttcgccgccgcctcacgttcggctttcgcaggcgtcagaatagggtcgaccctgctggaaagcggggtcgaccctgattccggcgtagcgcgtgtgggcttggtcactcggccttgccctcgtcagcgggcttgtcggcggcactggtgtcggctgcggcagcagctttgtcgccggcttcggcggcggccttcttggcgtcatccaccgtctcgctcaccttgcgcttgagctcggtgttcagcgccttgccctgctcgaccgtaatctcacccttcttgacgagttcgtcgacgagctcgctgctcttctcgtatccggtggcaagggctccgatgcccgccagcaggaccttgcgcaggccatcacccagaagatcaaaatcagccatgatacccctccttcgaggtccgacatggcctggtgccatgtctcgtaccaccaagcctagcgcaaacaacagggcaatgtactagaccctcagactgatttcgactgatttttcgctgattggtacttaccgaggactcaccgagaattcaccgaggacgttcggcggcagccttgcgcgcgttggtggctacttgatcgagccgggcgagctccttggcttgttcgggggtctgatcggacgtatcgaacgtaccgtaacgacgagtcacggcagtttcgataaggaaatcgctgatggcggggtttttaggcagcaacgagccgtgcatgtaggtgccgatcacgttgtgcacgcgcgcgccctcggtatggtcttcgccattgttgcctcggccgtcctgattgacggtgccgagtggctgaacgccttcgcgcaggaaggtctggccggagtggttctcgtagccaatcacatcgccgaactggtcggaatgctcaacaagattgccgatcatacgcacgttctggcccacggtataagcaccgataacgccgatgccgtccagacgggtgccgtccacggtttcaaagtactcgccgaacagctggtacaggccgcagatcatcagcatcggcgtaccgtctgcggcaagcgaacgcaacaggtcggcgcgatggtagaagtcgtcgatgattttcttctggccggtgtcttggccgccgcctcccagaataaggtccacctggtcgggccagtcgtcgccttgattgtactggtggacgaccggttcataaccgtacagttccagacggcggcggatagtcagcacgttgccggaatcgccgtagatgttcatgtctttgggatacagggacaccacatcaattgttctggccatgtcacgttctccttgtcgatgtcttcccgctgacgggaagcgtcttattcctcaccatgtcctcccgcaggcgggaggtggcgcgcgggcgctagaggatagttacttgcccacgcccgcgtcccatacttcggtgatgcggcccagtacggcgcgggttttgagcatggcggtgtaggtgcagtagatgtgcttgcgtgtgccgggattggcgttgacgaatgcggtgacggcctgttcgaggtcggtgttcgtatcggcgactggcacttggtcataccccaggcgcaatgccatgtcccaggcacgcacgccggagaccatggcgacaccggacgcgcgcagggaagtgaagtccacgtcccacagccagctcatgtcgcggccgtcggcatattcgtcgttgatggcgatcatggtgtccgcgttggccgggtcgaagctggcgagcgagaggcggaagcccatcgggttcttgaccagcagcagttcgaccggggaaccgttgacgtcgatgacctcgccacggccgaaagccggcgtgacgcgggaaacggcggcgataagctcgtcggcggacacggcgcaggcgttggctgcggcggtggccttggatgcggcggcattgtcttgcatcaccgcacgtaccacagcgagcgcggcggccgcgttgtacaggttgtagacgccttcaagcttgacgtcggtggcgtagccctgaccgtccatctggaaggtggccttgtggtcgcccacggcggtaagtgtcacgtcggcgggaagttctgccgtgcctgcggaagctcctctcagttcgcttcgcggactgagaggagttctggctgaggggagcggcccggccgcaccttccaccgacacggtcgtggccatgtcgtcatcggacgggaaatagtggcgcaaatcgtcggcgaggccgaagtatcgcacggtggtgccagccggggccttcgcggcgagcgcggcgatacgcgggtcctcgcggttcagtaccacagtgccggtagtcgccgcagccacatggctgagcagtttggccgtggtgtcgatttcaccgaatcggtcaagctgatcgcgcatcacgttcagcagcaatgcataacggggcttgacctgcttgacgaagtggacggcgtacgcctcatcgagctcgagcacggcgatgtccgcgtccaatttgccgccgagcgtgacttcggtaagcagtgcggagaccacgccgcgcacgaagttcgagccggtcggattggtgaacaccttcagccccagatcggagagcatcgaggcgaccatgcgggtggtggtggtcttgccgttcgtgccggacaccaataccacgccaagcggcaactgcccgagcgtacgggtcaggaagccggggtcaatcttttctacgactttgccgggcaaagccgaaccgccatgtttggtgacgcgggatgcaaaccgcacgaagcggcctgcggccacggtggcgaacgcataccacggtttgcaggtctgcaccacggacgattggtcttgcgaaacatcgcgtgaaacgttgcttgccatcatcacaccccctgattggcgttgtagtcctgcggcatgtctttgaatttggacgtggcaccgaggaaggcgaggtggaaggtttcggtcgggccgttacggtgcttggccatgatgatatcggcctcgccggggcggtcttccttgtcgtagaagtcagggcggtggaccaggaacaccacgtcggcgtcctgttcgattgagccggattcacgcaaatcggagagctgcggcttcttgtcgttacgcatttccgggccacggttcagctgggaaagggccacgaccggcacttcgagttccttggccaagagcttcagggcacgggagaattcggacacctcttgctggcgggattccacggccttgcccgaggtcatcagctgcaggtagtcgatgactacgagtttcagatcgttggtctgcttcagacgacggcatttcgcacggatctccatgaggctcatgttcgggctgtcgtcaatgaacagtggcgcgttctgcatcttggtccagaactggttcagggtgttccagcgttcgggggtgatgtcgtcggcgcggcgcagggcggccatcggaatattggtttcggcggagataatacgctgagcgagctccaccttgctcatctccaagctgaagaccacggaagtcatgttgtggtgcaacgcggcggcgcgggcgaagtcgatgccgagcgtggacttacccatggccggacgtcctgcgacgacgaccatctgtccgggctgcaggccctgggtcacgtcgtcgatgtcgcggaagccggtcggcacgcccttgttgacgaggccttgctgcagtttgtccagctggtcgagcgcgtcgtggaccaccgggccgatggcggcatagtcctgacgcaccttgcccatcgacatctcgtagatctcggactgggcgaggttaaccacatcctcagcctgcgatccctcggcggaataaccgagctgggcgattttggtgccggcggcgatcacattgcgcaaaatggcccgctgatggacgatctccgcgtagtacatggcattagcggcggtcggtacggatgcgacaaggctgtgcagatagtccgcgccgccgaccttgtcgaggttgccatccgccaacagctggttggccacgagcaccacgtccaccggctgactggcggaaaacagatcgatgatcgcgttatagatcgtctgatgcttgggctggtagaaatcggtgacgtcaatggtctgcgagacctcgccgatggcatccttactcatcagcatgccgccgagcacggccatttccgcgtcgtcatcatgcgggggcacgcggtcgaaaatcgggtcgccggccgccgccgacgtctgcgtgccgccccggcccgcgcggtcgccacgatcgccacgatccaggccaccgccgaacccattctgatacgagtgttcacttccttctggcatagcctccaagtataggatgtggcgtggcaggtgaacgatatcgtatggaaacgaaacggttgcccgcatcggttcattccttattcacctatgagtcagcgccacgacacgcagaaagcaaaatgtggatagaaaaataagttatccacattttggggataattctggggataatccactaagttatccacatactggggataacttggtggatagtctggggataacattccgcgcccacaacaggtgcttgcgcaacgcagtcaggcgtgatatgcgtgtgagcgtgcccatagactcttccgacgccaaagccaccagttccggcgatactacacgccgcgatggcttcggcaccccgcatgccggcgcaaacacaaacgtcagcaacggcccgaccgacgcccgctccaccaaccgccggatcatggcgctggccctgccgaccttcggccagctcatcgccgaaccgaccttcatccttatcgacacagccatcgtcggccatatcggggatgcggcgttggccggcctgtcaatcggctccaccatcatcctcacggcagtcggactatgcatattcctggcctactcggccactgcgcaggtggcacatctgctgggagcgggtcgtcgtcgcgagggactgcaggcaggcattgatggcctgtggctggccttgagcatcggcaccgtactgggattgggattgttcgcggctgccgagccattatgccgggcactgggcggtcagggcgaagtattggaacaagccgtgacctatacgcgcgcaatcgtgctgggtgcgccaggcatgctgatggtatatgcggcgaacggcattttccgaggattgcagaaggttcgtatcacgctgatcgctgcggtgggcggcgcggtggtgaacacggtgcttgatgtgttgttcgttattgtgctgaattggggcattgccggctccggagtggcgacgctggtagctcagtggttcatggggctgttcctggtaatccccgccattctgtggtcccgggcggatggtgcgagtctgcggcctcgtttggccggtattgcggcagccgggggcgacggactgccattgttcattcgcacattggcgattcgtgcggccatggtgactacggtcgcctgtgccgcgcgcatgggtactgccgtgttggccgggtttcaggccgtgaactcctcttggaattttgcgatgaacatgctggattccgtgggcatcgccggccagacgctggtggccacagcgctgggcgctggcagcgtgcagcaggcgcggcggctgacgcgggcgaccgggcgtgcgggactggtcaccggcgcggtaatcggcacggcttttgcggtagtcggcctgttcgccgggcacttcttctcccctacgccacatattcagacgctgatcgccgtgggcatggtgacgatgggcatcttcttcccactgcaaggctggatgatggcaatcgacggcattcttatcggcgcgcgcgactaccgctatctggccgtcacatgcacgctgaccgccgtggtgtatgtgacgctcatactcatactggccaatatggtgacgccggcgctgacgagcgacctgatgcgtaccgccgtactctgggccgcgttcaacgtggtgctcatgggtgggcgcggtctgtccaacggactacgcgtgcgctcggacgcatggatgaggtaggtatcggccgcgcgaagcgctgggcgattccgtttacatagcggcgcgggcggcggaatacatgccgcggacgatttgttcgcgccacttggaccagccgtattgcttggtgatggtctcaccggcggtggcaccgagcgaggagccgtcggcccgggtcaggtcgaacagcatatccagcagcatcttgtcgtggtgcaagcggtcggccaactcctccgccacggccggatcataggggtccttacccgtggcaaattcggatagcgtcaaatgctcacgcaccagcacggtagcccagtcgacgatgtccggcgcgtagcccatacgcttgagaatcaccggcacatggcgggcaccctcggcggcgtgatcggccacgaacgcgcgcttgccgatgtcgtgggtgataccggccaacagcaatgccttgaaatgatcgtcatcgtaccgtccaccggacggtgtctcacgacccagacgcgacgtgacctccaccatatgccgatcgatggtgtaccggtgggcggccgaggcggacggacggttgcggacgccgagccattccggcatccatcgacccggaatgtccacgaaatcgatgctctcccacacttccataagattcgatccgcacgcaagcagacggataaacagctcgcgcgattcgtcatcccactggttgtcgtgaatcgggcagcgcttcagattaaccaaggtagacgggttgatgggaagaccgaattcgccggccgccacggccatacgcaacgccagcttggcatccttggcaggctcggcaccgggcgccaacaccaattcgccttcgtgcttggccacgccgggagccaccacgtcgaattgcggggcttcgcgcttgccaccagagcgctgagagaacatctggaagaacgcgaatcgcggcttttcgtgggtcagcgaatgttcggcgcgggaagcggtggaatcaagcgagaaggagatgcgccgaccgatacgggcaagcagtgtctgcagatcgtcgatcgagtaggcggcacgctcgttttcgggccaagtcggatcggcaaggccaagcatggcagccactttggcctgatagggcgtcagcatcaggttggtatccttgccggccaccagatggatgcagtcgcgtacgtcgagcagacgttccacagcttcgtcgtagatgccgtgcgggcggtcggccagccatgaggcggcgagcgcggagacgagcaccgaatcgcgcaaccccccacgggcctctttgatgtcgggctgattgacgtattggagccggccgaattcgtcgagtcgggctttggcggagtcgagcagttcgggcaggcgcttgcgggcggccttgcgccagcgttcgaggatggacgtggcggtggtggtgatcagagcggtgtcgccggcgatgggtttcacgtccagccagcccatggcggcgggaaggtcatggtcggtgacttcctcgcattgggcgcgcgtgcggatggagtggtcgaggtccagaccgctgtcccatagcgggtaccagagtttgttggccaactcgttgagctgctggtcgctcaacgtgcgaggctcgtagatgatgaccaggtcgaggtcggagctggggcccagttggccacgtgccagcgagcctaccgcggcgaagccgatgccggagtcgggcacggggaaagagacatccttgcaggccgcattccacagctcagtgaggcattgcatggccagttctgtgcgggctttgcgcttggtcgcaccattccggtagacgccgtcgtcatccggctggctcatatccatgaatcgttgtttcaagccatctactgctgaagtcattgcttcatctttcattgctaaaaaaagtccccgcacggcgtcaattcgcggcgtgcggggacctttcctatgcagtccatccccttctaagcatggacgtctgtgttatcagatcgcggcggaaccggtctcaccggtacgcacgcgggccacggagtccagcggagcgacccacaccttgccgtcaccgatggtgccggtgccggcggacttgatgatcacaccaaccagcgtttcggcatccgcgtcatcggacagcacttcaacgcgaatcttcggaatcaggtccacagtgtattcagcgccacggtagacctcggtgtggccgcgctggcggccgtagccgttggcctcggacacggtcagaccgtgcacgccggcggccgcgagggcctccttgacatcgtcgagcttatggggctgaatgatagcggtgatcagcttcatttcacttcacctccttgagaacggagctggcagtaccagcaaaatcgtaagcacgttcgccctggtcggcaagatcgatgccgccgacttcctgggcctcggtgacgcgccaaccaatggtcttctccagagcgaaggcgatgatcgcggtgatcactgcggagtagaggatggcgacgagagcgatgaccagctgaacgacgagctgcttccagtcgccaccagccagcagaccggtgccttcaccgaagaagccgatgaggatggtgccggtgaaaccaccaacgccatgcacgccgacgacgtcgagggagtcatcgtagccgaacttgaacttgagaccgcaggccaggcaggtcaggacaccagcgatggcacccatcacgatggcccacagcggggagaccacatcggcggccggggtgatggcaaccaggccggcgaccatacccgaggcggcacccatggcggtgtagtgaccggagcgaatcttctcggtgaagccccaagagagcattgcggctgcggtggcggcggaggtggaaacccaagcgtagccagcagtaccgttggcggcgaaggcggaaccagcgttgaagccgaaccagccgaaccacagcaggaaggcgccgagcatcacgaacggcacgttgtgcgggcggaacggctgcgtgccgaagcccttacgcttgccgatgatgagcacgatgatcagggcggcgactgcggcgttgatgtggacgacagtaccacctgcgaaatcgtgggcggccgcgccgatggccttggagatggcgccgtcagcagacagcagaccaccgttccagaccatgtgggccataggagcgtagtcgaaggtgacccacagcgccacgaaaatcatccaggtgctgtacttcacacgctcggcaatggcgccgcagatcaggccgacggtaatcatcgcgaaagcgacctggaaggcaacgtccacggaaaccgggtagttgttgccgttcagaccggtggcggtgaacacgccgtcctgggcgaccatggagtccttcagcaggaagccgctggccgggtcgccgaagatgcctccgatgtcggaaccggcgtaagcaatcgaccaaccccacagggtccagataatcatggtgaccgacagggcggccgcctcaagcatcagcatgttcaggacggccttggcacgaaccataccgccgtagaagaacgccacaccaggcgtcatgaggaaaaccaaggacgcggatgtcaggatccatgcggtgttaccggaatcaatcgctcccatgtctacctccctctctttcgttcagggcaccgggggctttgcgcggccggcgtcgactttgtctctacaatgccgtcccccttgtgggggctaacagttcgtcagtaaaagccggtctcgttttggtttcgttacggcaagttacgcgattgttaagcgcacctgacagttaggttggcatcggatgggctgattccggcatgattccaacggatatgggaaagccccgaatcatgtttcgaatatgcttcggggctaggtttggtgcgttgcgggcgtttcccgcgcccacaacgtggacggacgcagggctcccctcgctgaggggagctgtcgagcaaagcgagactgagaagaactcgaccgtctacgcgagaatgccgtccacgaaaccttcgggatcgaaaggtgccaaatcgtccggaccttcaccaagaccgacgagcttgaccggcacgccgagctccttctgcacgctgaccacgatgccgcccttggcggaaccgtcaagcttggagagcaccacaccggtaatgccgatggcttcggcgaacaccttggcctgggccatgccgttttggccggtggtggcgtcgagcacaagcagcacttcatccaccggcaggttcttttcggtaacacggcgaatcttgccgagctcgtccatcaggttcgacttgttctgcagtcggccggcagtatcgatgatgagcacgtccgcgttcgcttccttggccttggcggatgcctcaaaggcgacggatgccgggtcggcaccgtccttgtcggagcggacgacgggcacattgacgcgtgcgccccaggtttcgagctggtcggcggcggccgcgcggaaggtgtcggccgcgcccatcatgacctgcttgttttcggccacgaacagtcgagccagtttgccggcagtggtggtcttgccggtgccgttgacgccgaccatgatgatgacgctgggcttggcggcacccggcttttcggcattgaggcggcggtccgtatctcgaccgaccagatcgagcagcttctccttgagcgtggcgcgtacttcggctgggtcggctttaccagtgatgcgggcgtcggttctcaggtcatcgaccagttgggcggaagcatccgcaccgacgtcggcaagcagcagtgtgtcttcgacgtcttcccaatcggcctcggagagattgtctttggcgaggatgtcgaacagggccttgccgaacgggttgccggacttggcaagttttgccttgagtcgggtcagtcgagagccgaccgattcgggggtttcaggtttggcgggagtgggcttggaggcaggttgggactcgggcttgggcgcagctgccggttcgggttcggcctgcgcggctggcgcaggctcggctttggccgattcggctgacttggccggctcggcggcagtcgcagccttagcttcctcggcttcggcggccagccgagcgtcggcggcggccttggcgtcgcgggtcttcttgttgtcgggggcaaccttgcccatcgcacgatccaaatcgcgcttgcgggacttgcccaaccagatgctcagggcgattacgataaccgccgccacaatcacgccaagaacggcgagcacagtattcatatccatacctgtcaagtctagcccgcagatggaatcccctacgaattcggcagtctcaggccgacaattccacccggcgacttaagctgaaccgcatggcacattcttcacgtatgacgtcgctgcagcgccgcgagcagctgattgaagtcggacgctcgctattcgccgccaaaggcttcgaagcggtaagcgtggaggaaatcgccgcgcacgccaaagtctccaagccgattgtgtatgagcatttcggcggcaaagagggcctgtatgccgtcattgtggatcgtgagatgcgcgcgctgaccggtacgctgaccgccgcgctcgacgatccgaccgtgcacccgcgccagattgtggaacgcacggcgcttgcgctcctcacctatatcgaagagaatgccgaggggttccaggtactggtacgcgactcgccgagcaccgacccgtccggctcattcagctcgctgatgggagacatcgccgtacgcgttgaagacattctttccgaaacattcaaacggcagaagctgtctgccaagggcgtgccgtactacgcgcagatgctggtgggcatgaccgtattcaccgggcagtactgggccgaccggccaaaggtgagcaaggagcagctggctgcatacattgtggatttggcctggcatggcctgagccggcttgactccaagccccagttgttctttgagggcgccaaggcgcggaaggaggccgagcgccgagccaagcgcgagtccgattccggcagcccggattcagaccagacgagttctgcccaatcggatcccgagcacgccaccggggaagattcagggttgcagaacatgagttcaggggcacaggttacgcaacactctgccgagtcgggagacgaagtgctacggtttgaacaggaaactgaacataacgactaaatatgtgaggacgtaagactttcatggccagcacggcaaagacgctcacctttgtgatccccgcatacaatatggagtcctaccttgaccgttgcgtgaactcgctgctttcggcaagcgacatcagcgacctcgaggtgctgattgtggacgacggttcgaaagacggcacgctggagtacgcgcgcaagctggaacgcaccaatccgggcgccgtgcgcgcgattcatcaggagaacaagggccacggcggcgcggtgaacaccggtatcgcggcggcgaccggcatgtacgtcaaagtggtggatgcggatgattgggtcgacccgcaggccatcgacacggttctggccacgttgcgtgcacagcatgacaccgacgaaccgattgacatgctggtgaccaattacgtgtatgacaaggtggccaagcgtcacaagaccgtagtgaacttccgccgtgtaatggaggccggccgcgtgctcggctgggatgacctgggcaggttcggtctggcgcagtacatcatcatgcatgcgctcaccttccgcacgcaggtggtgcgcgattccgggctgaagctgccggagcacacgttctacgtcgatttctattactcgtaccagccgttcccgtgggtgaagcgcatccagtacctcgatgtgccgttctaccactacttcatcgggcgcgagggtcagagcgtgcagaccgacgtgatgattaagcgtgtggaccagttgcggctcgtcaatcggctgatgaccgaggccacgcccgaacgcggtacggtgccggaggggctgtaccggtacatgattcacttcctggcgatcgaatcgtgcgttacctcgacgttcctgattctctcgcgcgatccggccaactacgttaagaaaaccgagctgtgggatgcgattgacgcctattcgccggccatcggcaaggatgtgcgctcgcagctgatgtcccgcgcgctcaatctgcccggcaaaaccggccgctggatcgtgcgcaacggctatctcatcgccaaacgcatcgtcggctttaactgattcggattgtggttttgccctgctgacgcgttatcagcagggcatccctattacctccccagtcgaggttttgctactcggcccaacggtcggacatcgcgaagctgttgtgcatcaggttgctggaggtgtatagcacgtcgttcagcagcttggttgtgtgctcgcgcaggtagtcggccatctcgtcgttggccgcttcgagcacatccgccacgccctgcacatccttctcatcgccgtggccgccatcgagcggccatgcattcgtatccgtcgattcggcatcgcttcgagcaagcaactgctcatccgtgcgctcgatgagccggtgtccgaacgcgcgcacgccctcggcatacccttcgatgaaccggttcgtctcataccagtgtgcgtcggccacgacggcgatcaggcggttcgtccaatacaggttgccggtggagacttcgggcgtggtgtcgcgcaggtaggcaggcgtgtcgttgacgttcgcgtagaacggcgcggcggcggtgaacggaccagagccgaacgatacccacatcaccgtgcgattggccgccggcacatacggacggacctgaatcgccaccatatggccggtgcggttcacgccgatcggacggtaacggtggcgcgattccgccgtgccggtcgtgccgtacgggtcgtacggcgtgccttcgaagtgcgaggacagcaggaaatcaacgtcttcgaggctcaccttgtcttccggcacgcggcaccacgggatgtcgtcggattcgggcgtgtagcgggcggccggcgaatcccagtcctcgctggggttgaggcggcgttgcatgtaccaggcacgcggcgtgttgtagatatggtccttcggcgtcgcggtgccgaaggccttgcgcgggttgaaacgggtgggaagggcaacggttgttccgaatccggcgctatgcgcgtgacggccgttggaagagaccggcgttcccattgtgcggtcgaggtgatgcgtggccatgaactcgcgcaggtcggcgctgcataggtattcgcgctgctcgccgaacgcatcggcgaggtcgaagtcgtcgatgccgagctggttggggatcgtggcatagcagtcatcgggcactcggcgggcgatccaatggtggccgccgatggtctcgacgtaccagatctcgtccacatccgaaataatcacgccgttcgattcgtaggtgccgtaggtttcgagcagttcgcccaaccgcgcgacgccctcgcgcgcggtggtgacatacggcagcacaagggtgatgatgtcttcctcaccgataccgccgggctgctcggcctgataatcggtgctgtccggttcgccgacagccggccgcaactcgaccatcgggtccgcaccgagcacgcgctcgttgacagcgatggtttcggtggcgctcatcgccacgttgtgttcgttggcaccggcttcggccagaatgccacgattattcagcacgttcggtgcgatggtgtaccggcaaggattgtccggtagttcgatttcgacatggctcagcacgctgcggtagtggcgcggctggtcgtcgggggcgacagcgacgaagcgcttgggatcgtaacggcccgagcccgaatcgtcatcgcgggcgatgatggtggaaccgtcgtaactggcatttttgccgacaagaatcgtggtgcatgacatgggacaccactctaggagccaggctggtcgaaacaaaaaaatccttggaaccattgcgattccgaggatttgttgtgccccctgtgggattcgaacccacaacccacgacttaaaaggacgctgctctaaccgttgagctaaaggggcaactcttctaaaatacacaccgttttgggatatttcaactacggcgttgcgtacacgtttgcgtacgcgattggcccaacgcacggcacagcacacgcaatgtggcccaaatcgcagcccaaatcgcatatcgcctctagcgatagatagccgccggcgactacccttgtacattatgagtgaatcccccaattggagcaatcccctgcgcgactcgcgcgacctcagactgccccgtatcgccggcccatgcagcctcgtcattttcggtgtcacgggcgatctggcacaaaagaaactactgccagccgtctacgacctggcgaaccgtggcctactgccgccgagcttcggtctgaccggtttcgcccgccgcgactggacacaggaacggttcatcgaattcgtcaaggccgccgtccaggcgcattgccgtacgccgttcaaggagtcgacttggcgcaatctggccgccggcatccgcttcgtgcagggtacgttcgacgacccggaggccttcgagcgtctgagcgccaccgtgcaggagcttgaccgcgaccgcggcacgcagggtaaccatgccttctacatgtcggtgccgccgcgcgcattcccacaggtcgccaagcagctggccgcctccggcctgtcgcgctcgtccgagggcgcatggcgccgcgtgatcatcgagaagccgttcggccatgatctggccagcgccaaggaactcgacagcgtggtatccgaagtgttcgacccgagctccgtgttccgcatcgaccactacctcggcaaggaaaccgtgcagaacctgctggccctgcgtttcgccaacgccatgtacgagccgatctggaacgccaactatgtggaccacgtgcagatcacgatggccgaggacatcggcatcggcggccgcgccggctattacgacggcatcggcgccgcacgcgacgtcatccagaaccacctgcttcagctcatggctctgaccgccatggaggagccggtgagcttcaccgccaaggacctgaccgccgaaaagaccaaggtgctttccgccgtgcgcctgcccaaggacctcgccgccaacaccgcgcgcggccagtacgccaagggctggcagggctcgcacgaagtggtcggctacttggaggaaaaaggcatcgaccccaagagcaccactgaaacgtacgccgccatccgcctcgatatcgacacccgccgctgggctggcgtgccgttctacctgcgttgcggcaagcgcctcggcaagcgtgtaaccgaaatcgccgtggtgttcaagcgcgccccgcatctgccgttcgagcagaccgccgtgcgcgaactcggcaagaacgccatcgtgattcgcgtgcagcccgacgagggcgtcaccatgtgcttcggagccaaggtgccgggcggctccaccatggaggtccgtgacgtgaacatggacttcagctacggccgctccttcaccgagaactcgccggaagcctatgagcgactgattctggacgtgctgctcggtgatccgccgttgttcccgaccaccgaagaggtgaacctcagctgggagatcctcgatccgattgaacaattctggtccacgcttggccagccgcaggcctaccgcgccggtacgtggggtccggcacaggccgacgaaatgctggcgcgcgacggccgccactggaggatgccatgatcatcgatatgccgaacacccgcacccgcgagattgcgcacaaaatcgaacagctgcacgaggagcgcggcgaatcggcgaccggccgcgtgctgacgctgctcatcgccaccgaggacgcggacctagagcatgcgctggaaatcgcgaactcggccagccgtgagcacccgtgccgcgtgattgccgtagtaccggataccaatcctgccgatcagtccggcgaaggcgaaccgaacgcggccgaagtggccgccgaggtgagcgcgagtcgcgataatccggccgtcgatttgaccgacggcccgaacgatccgaacgattccaacctgaacgcccaagtgcgattcggcgcggacgccggtgccggtgagatcatcgtcttgcgtccgcgcggtggccttatcaaccacccggatacgctggttatcccgctgcttgtgccggatgcgcctgtagtggcgtggtggccgaccacaccgccgtcgaacccggccaaggatctgatgggtgcgatggcccgcagtcgcatcaccgacgcgttgcactccaataatccggaggccacgattgagcgtttgcgccgcaattggacaccggaagatatcgacttgtcctggacacgactgaccgtctggcgcgcaatgctcgcctcgatgctcgatcagccgccgcacctgcccatcaccgccgcgaaggtgaccggcaaggccgacttcctgcctatggaaatgctgtgcgcatggctgcgtctgaaactcggcgtaccagtcgaaactgagttcgtgcccgacgcgcaggccgtgaccggcgtgtgcctgacccgtgaggacggtgtgatctcgctggaacgcccgtatgaggaccaagcgctgatctcgctgcccggccagactccgcaggaagtgtccgtgccgatgcgcaccatcgaggactgcctgaccgaggaactgcgtcgcatcgatcccgatgagatctacgccgaggtcatcaacgaaggctgggatctgattcgtcactgaagtcggtagaacccgttgccacagcggcgttggaatgagttcggcaattgtggccgagccatgccaacgccgttgctcatcgtttcctacctcatgcgatgccgaagctcatgcccgcggagtaataaagtgacatatgcgatgtcgcacaatgtggattgtgttgtcaactgacaacacaatccacattgcaaagtacgacacataccccatacaaggaccatacatggcaactcgaaaactcattgtgtatccgaataaagatctgatgattcaggctggcgcgcaacgttttgtcttggcgctactcgatttgctcgccgaacgattgcctgatggcacgcatcgcacgcgtgtggatgtggcgctgtctggcggttcggccgcgcagccgctgggcttggtgctgaacgatccgctggctgacgcgattgattggtcgcgcgtgcatttctggtggagcgacgaacgttttgtgccggcttacgacaccgatcgcaatgctttggaggcccgtcgcctgctgcttgaccagctggtggcagatggcaagctgcctgagtcgaatattcatgagatggcggccgatacccgttcagccgatgacatcgccgatgtgatggatcaggccgacagcgatgatgcttccgttcgcgccgccgccgatgccgcgaatgatgcgttgctggacgatgtcgcgagcgactatgagcgcgagttggtgaatgaattggggccggaaccggtaatcgatctgatgattctcggcatgggaccggacggtcactatgcgtcgctgttccctggtcatgatgaggtcaaggttactgataggctcaccgtgggtgtgaaccactcccccaagatgccgccgctgcgtgtttcattgaccgcgccgctcatcgcgcgttcacgccatacgtggttcttcgccgccggtgccggcaaagccgaatcgctggcccatgtcttcgagcagcccaacaaaccggattacccgtcctcctacgccaacggagtggacgagttcatctggttctccaccgaagaaaccgtcaccgagttgtgagtgaattaagccccctctgatgagggggcttaattcgtctatggctacgcctcaatctcggacttgccctcttcgccgccggcccctgcaattagggactcgcctgcggcgaggctcagtgttggctcggcggcatagccgcctcgctccgaagagggccggggagcccaccgggctcccctaagcccgagatcgcgaggctacgcctcgatctcgggcttgctgttttctcagctcggctatcgccgagcctgaagaaggccggacagcccacagggctgtcctaaacctgaaatcacgaggctacgcctcgatttcaggcttgccttcttcagcccacagcgtgtggaacacgccgggcttgtctacgcggccgtaggtgtgggcaccgaagaagtcacgctgggactgggtcagagcggtaggcaggcgcttggagcgcagaccatcgtagtacgccagggagctggagaacaccggggtcgggatgccggcctccaccgcgcgaacgatcacgcgacgccatgcatcctgcgattcgccgatgatcttctcgaagtacggatcgaacagcagggaagccggcgggttatcgcccctgaaggcctcggtgatgcggtcgagcaggaactgggcgcgaataatgcagccgccacgccaaatgcgggccacttcggacaggttgatatcccagccgtattccttggcaccgtcctgaatctcgttcaggccctgagcataggccacgaccttggaagcgaacagagccttgcgcacgtcctcgacgaacgcggccttgtcttctccggccagatcgatggtcttgttcggtccagccagaccttccttctgagcgtcttcacgcagctcaccgtgcgaagacagtgcacgagcgaacacggcttcaccgatggcagccacaggagaaccacattccagaccagtctgcacggtccacgtaccagtacccttcatgccggcatgatccacgaccacgtccacgaacggcttgccggtctcggcatccttgtggtgcagaatctcagcggtgatctcgatcaggtaggagtcaaggtcgcccttgttccattcagcgaacacgtcgccgatctcctcggcatccatgccgagtccacggcgcagaatgtcatacgcctcaccaatcacctgcatatcggcatactcgatgccgttgtgcaccatcttgacaaagtggccggcaccatcggtgccgatgtgggtcacgcacggttcgccgttcaccttggcggcgatggactgaagaatcgggcccaaggtcttccaggattccgcagtgccgccgggcatcagagacgggccgttgagcgcgccttcctcaccaccggacacgccgcaacccacgaagtggaagcccttggcacgtacttccttctcacgcttgatggtgtccttgaagaaggagttgccaccgtcgacgatgatgtcgcccggttcgaacacctcttccagctgcgcgatggtcgcgtcggtcggagcaccggccttgaccatgatgatggcggtacgcggacgcttcagggacgcggcgaattcctcgagcgtttcggccggcacgaagttgccttcggtgccatgctcgttcatgagcttctcggtacgcgagtagtggcggttgaacaacgccaccgtgttgccatggtgcgccagattacgcgccagattggagcccatcgtggccagtccaatcacaccaatgtttgctgtagcttcggccatgtgccttgcctttcgtttgattgtcccatcgtcatcacgcgcgtcacaaaacagcgcatcagcggagggaatcattccttcaacgcttgaaagtgtatcccgcttaccacccacacgcgagggctgtcttaggttctacgcaccttctgcccgcgaagcgtaattacttgccggccattcacatacgcccggccttggaagggtcgatatgcatggtctggaagcgattggccatgtaagcgtcgctgtagcgttcgctgaaccacatcgcgaccggtgaatcctgcggctggccggccatgcgcccataccagcaatccaaggccatcagcgtgaaggcaatgtcgatcaccatcagcaccgtgcataccgcagtcagcgaataccgcactttccatggaatgcgattaatcagagccagcagtcgcggtaacagccacttgacccacaccacaccaatcagtccccagaagaacatgaattggcccgaagtacgtccgtcgatggacagccaacggccggtgtaatcccacgcggtaataccaaacgccgcttccatgaaccagctggtgcaatattcgaacgcgccgccgatcaccgccgaagcgcagaaaatcaagaacggattcgccttccacagacgattcaggcacatggttaccaataccgcaccacagccgtaaatcggcgagaacgggccccacagcaaaccagcgcggtcctgaagttcaccgttatacagcgccatatggtagatcgtctccacaatcaggccacccaccgaagcgatggtaaacagccagaagatattgaaaaagtccagcgcaatatagcccttgccggactggtcgcggcctagcatgccggccgccacagccgattcataatcatcgcgatcgtccatacgcctgagcgcgcgctgcagacggcgttcctcgctcagggagggatcggcggtcaccgaaatcacgacgagaataatcatctgaatcagcggcagcagcaggttgaagccaaggccggtcagggccagcgacagcatgccgtcggccaacgtcaacggcatcagcacgtaggtccagcgcgcggcataccggcgatgattgcgcagcagcatcacgccgagcacaatcaggcatgcggcactgactaccagcaccaccgcatgaatcgcggacaggatgaaggtcaggctcatcgcatcgacgtgcacatgaccatccagaatctcgcgcacggcatagaggatggaaatcaccataatcggcaatgtggcgagtccgtccagcagcacgaccgcgccatagatgcgcgccagaatcggtaatcgcttggcgttcaggttcaagccggcgtcgtccagttcgacggccaccagatcggccacgactgcggactcggcgtcacggttctcccgcggcttgccgggggtagtggccgtgccatcgtccttgaattcaaccatggtttcctccccacatagcgtcccctcaccctatcacccgattgcggttttgctgaacttgatgggcggtcggtacatgtctgtctacattgccgagcaccgagcctatccatcgcgttcaggaaacgtccaaaaaccatccagaaatcttgtcaataagttccagaacgcctttcgctctgcccagcgacacacgataagccgctgggcagcggtgttattccgccaaaaacatcatcaatcaccccattaatctccggcagccgtattacgctactacaaacgtagcgctacgattaacgtatcgctacggaaaacgtagcaaccaagcaacaccaagctccggaggtatcagtgggcaatatcttcaaggtcctcagacgcgacttcctgcgcctgttcaaggtgccggccgcatgggtgatcctgttcggcatggtgttcatcccgccactgtattcgtggtacaacatcgtcggcttctgggacccgtacggcaataccaaaggcatcaccgtcgccatcgccaacaatgacgacggcaccgacaacgcgctcatcggcaagcagaacctcggcgatcaaatcgtcaagcagatgagaagcaacgaccagctcggctggaccttcgtcaccgaagccgaggccatggaccaagtggaatccggcaaggcatacgcagccatcatcattcccaaagacttttccgacgatctcgccggcgtggtgaccggcggcaagagtcggcccactctggagtattacgtcaacgaaaaagccagcgccatcgcccccaaagtcaccgacgtcggcgcgtccactgtggaccgcacggtcaattccacattcgtctccaccgtatccgaagtacttaccgaagtcatcaatacggttgacggcaaagccatcagtaccgaagacaccaccaaagccaaggccctcacggcccttgccaaggcctccgacgatgtgcagcacacacgcagcaccatcgccaagctcaccaccaaactcaccgacaccccagagcagacacgcaccgcacgtcaggcgctggacgacgcgcgcacacttggcatcgacactgcagaaggtctggccggcgtctccaccctgatcggcactacccagaccagtctgaacggcttcgtcacctccacgtccgaagcgcttgaccaaggctcaagcctgctgagccaagccgcagcacaggccaaccaaagcgtgggcacggtaaccggaaccatcagcgccgccaatcagcaggtaggcggactgatcaatacggcggaagacatcaaccaagcgaacgccgacatcatcgaccaactcaaagggctgccgaacgccaatcgagaaccgctgcaatccgccattgccacactggaaagccgcaatagcgagcttgccggcgcactgggcaacctcgatagcctgaacaccactatcggcaatgcctccacagacaccgccggattggcgcagcatctcaataccgccacccaaaccacggtgcgcgaggccaataccgctcgcggcaccatcacctccggcgccattcctcagctcaacaccggtctcaacgccctcagctcgaccgccagcactctgtcgaccggcatcacgtcgcaaggctcactcatcgatcagtcgaagcataccctcgaccaactcgacaaagcagcctccaccacggtgaccgcgctgcgcgacaccgataaggcgctggccggcgtacaaaccaagctcgatacgctggtcaccgacatcaaagccctgagcatctccagttcactcagttccctgatcggcaccgacggcaaactggatgccgccacaatcgccgacttcatgctctcccccactgttatcagcgaacaggccgtctatccggtcgcctcctatggttccggcatggcaccgctgttcaccaccctgtctttgtgggtgggcgcgttcgtgctcgtggtcattcccaaactcgaaaccgatgatgagggcatcgacgatctcacaccaacccaaggctatctcggtcgcttcctgctactggccacgctggctgccgtccaaggcctggtcacggccatcggcgatcttgtcatcggcattcaatgcgcgagcgccccagtgtttctgctcacctgcgtcatcacctcactggtgtatatgtcggtgattttcgccctctccaccacgttcatgcacgtgggcaaaggcgtatgcgtggcgctggtcattctgcaggtgccgggcgcctccggcctgtacccgattgaaatgatgcccgcgttcttccgcgccatctacccgctgctgccgttcacctattcgattgacgcgatgcgtgaaaccatcggcggcttctacgacggcctctggttcgcctatatcggcaaattgctggttttcgtggttctggcctttgcgcttggcctcggcgcccggccgaaactggccaatctcaaccgcctgttcgcgcgggaaatcaaggaaagcgacatgattatcggcgagccggtgcatctgcccggcagtgaataccgtgtcactcaggccattgcagcactggccgaccacgacgaataccgtcatgccatcgaacgtcgggccgccaaattcgcctaccgttatccccggctgctgctgggtgcgcttattgccggattcgtggtgccggccgcgctcattatcgtgtttgcgctgaccaccagcgagaaaatcgtagtcatgggcacatggctggcatgggtgctcatcatcatgggcttcctgatggtcgtggaattcatgcgcgattccatccgccgccaaaccgagctcggcagcctctccgacgagtcgatccgcgccatgctgtacgggcataaggccaagcgtcgcgacacctccgccgaacgccacgaagaagcggacccgagcgccgctgttaccgcaatcatccccactattccgccgaccaaggaaggcaggcacgcacgatgaacaccatgtggaaactgtttaccggcgacatcaaacgcctgaccagcaacgtggtctccatcatcatcgtgatcggcttggtgatgattcccggcctgttcacctggttcaacgtggccgcatgctgggacccgttctcgaatatgaagaacctgaaattcgcggtggcgaatgtggatgaggggtatcgttccgacctgatcccggtgaaagtcacggtcggcgatcaggtggtgaacgcgctgcgcgccaacagtcagctcgattggacgatcacgtccaaagccgatgccgtcgagggcgcacgatccggcaaatactacgcggccatcgtaattccgaagtcgttcagcaaagacatgatgaccttcttctccgacgacgtgcagcatgccgaactgacctattaccgcaacgagaagaagaacgcgctggcaccgaatctgctcaacgagggcacggatgaggttgcggcggaaatcaacaccacgttcgctaagaccatcacttcggccgggctggaaatcgcgtcttcgctggccgatcagctgtccaagcccgaggccaaagagcaactgaataccttcaacgccaacatcgccaatttcgccacacagcttgacgatactgcggatctgcttggcacatacagcgcattgaccgatacggccggcgccttgctcggcacctcgaactcactgatcactcaggtttcctctgccgccaaacaaggcggcaaggatcttgccagcgccaaacaggaagtcaccgacgtggccggagccctgggcaccaccgctgacgcgatgagcagcgcactggacgcgagcgcctccagtttcggcgcggtgtccgattccatagacaagctgtattccgacgcgaatgatggtgccaccacggtcgccgacgaattggaccgtcaagccacggccattggcaagcagacggagaaatacactgaaattcgcaacacgttggccggcatactgggcaacgactcatccatcatcacggcgattgaccgttcaatcgcacgacaaaacaggctgcggcaagcgctgaatacggcggcgaccgatattcgccaaggcaatcaggacgcgcaggatcagcatgcgcaggtcaagaatctggctgatcaagcgcagaacagtattgccaatatcaagtcagatttctcggccacggtgaaaccgcaaatcgactccctgtcgtccaccgtcgctgacgcctccggcatactgagttccggcgccacccagttggactccacgctcggcgacctgaaagggacttccgacgacgccagcgatatgctcagcgacgctcgcactaccttggacaaggtgtccggcaaactgcgttccgccggcgccgaactggcttcgttcaacagcacactgagcgacgcactaaacagtggcgatatgggcatggtcaaagaggtgctgggcaatgatcccgaaacgctggccagtacgttggccgcaccggtgcagctcaggcgcaaggccgtattcccggtggcgaatttcggttcgtcgatggcaccgttctacacgctgctgccgctgtgggtgggcgcgctgctgatggtggtgacgctgaaaaccaccgtgtctcgccggacgcgcaaagcattgggcgatccgcggccgcatcggctcttccttgggcattacggggtgttcgcgctgattgcgctgctgcaatccacggtgtcgctcggtggcgatttgctgttcctgcgcgtgcaggccgtgcatccgctgctgtttatgttgtctggatggctggcctcgctggtgttctcgttcttcacctatacgatggtggtgagtttcggcaatgtgggtaaggcaatcggcgtgcttatgctcatcgtgcagatttcgggtgcgaacgctgcctacccggtgcagatgttgcccgacttcatcgccaaagtcagtccgctcttgccgctcacccatgcggtgacgatgatgcgtgcggccatcgccggcatctacgacatggattactggcgggccgccggaatgctgctggcattcgtgccgccgctactgttgcttgggctgttgctcaggaagccactggtgcggttcaaccagtggtatgtagcccaagtcgagagcactaaagtgctgagctagtaggtattatccgggagttgcctacaaacggcatggacttaccaccctcagtctggctttgccagccagctctcgccagcgggagcgtacgggagcatatttcgaagagaagagatgacggagatgacagacacgacggcgacaccgcgcggtgagcgcacgcgcgaggcgacggatcgcaagctcatgcgagccacgctgcagattgcggtggaccgcggcatcagcggcgtgaccatcgaggaggtggcccggcgctccggtgtggccaaaaccacgatttaccgccgatatcataatgccgacgagctgctgcacgagatcagcgcgatgtatctggccatcccggattccgacccagtgcccagccccacgcgtgagcatttcacgcaactattgcagcgattggtcgattgggtgcgcgacaacgacatcgacgtcaagcgcgtgggcattgtattgtccagcgaggccgagttcttccagcacatcgtcgaccaagtggtgaccccgtggctggagcgtgtgggggcgttcctcaagcagggagtcgcgcagggcgtgtttcgcgaggacgttgacgagaagttgctgttgtccacgattatcggatctttggtggcgtatgaggccatcgagggcaaagcaatggacgacgacaccgcctgggcctcgcgcatggccgatctgctgtggccagcattgctgaagtagcggtcttactcctgaatcgaagcctcctggcgggcgacttcgagggctttgttgaaggcgtcggaggtccagctggcgccggcgaccttgtccactttgagacccttcagaggtttgccgtccaccacgccgttaatggctttggcgaagtcgtcctgatggttcttggaaatcgtggtgaacgggtgcccaatgatattgacggtctcgacgttgccgtccttgatggtcagatggacgtcgatggaatcctcgcctaccgggccgtactggccgttgatcgagtagttgccgtccttgtagttgccggtgtccttcttgtcggacgtggtggtggacgggtcgttgtgcgacgagctggaatcggagccgtcggagctatcggagccgttcgactgggattgcgactgctcttcctgcgacttctcggtctcgcccgagttgccggcgtacgcatcgtccatcggcgcggccttggattcgccgcatccggccagcagcgcgccagccacgaccagtccggccgccgccaatgtcgcggatttcttcaacgtactcttttcggtcatattcacgctccttaagccccccctctgacgaggggggctgtcagcgaagctgactgggggagagaccatcagcttgccatgtattcctcacatactgctcgatgcccctgacggccctactcctcgccgccggttttcgcggccttggtggggtcagtgaaaccaatggcggtctcgccgttctgcgcgccctcgacctgtgcacccgtggaggcgggcttgccgccggccgcctcgtaggccttgcgcgcatcctcgtcattccacttctcaccgacgagcacgccatggttgagcatgatctcgcgctgcgcgcagctggcgaccagcgcatcgtgggtgaccacgataatcgtggtgccctgctcgtgcagcttgcggaacaggtcgagcacgattttctcgttcttctcgtcgaggttgccggtgggctcatcggccagaatcagcttcgggtcgttgatcagcgcgcgggccacgcacacgcgctgctgctcgccgccggagagctggccgggcaggtggtgggcgcggtccttcaggccgaccttttccagcgcctccatggcctgcttctcatcgaccaccgaatggtagtactgggccaccatcacgttttccacggcggtcaggtgcggcaccagatagaacttctggaacaccagtccgatgaggttcttgcgcacgtcggccagctgcgtggcgttcaggtcctccagcttgcggccttccagcttcacggagcccttggagggcgtgtccatgcagccaatcatgttcatcagcgtggtcttgcctgagccggaggagccgacgatggcgagccattcgccttccggcacggtcagattgaggtcgtccacggcacgcaggtcgccgtagatcttcgagatgtggtcgagttcaagtagcatgacgtttctctttctttattcttcgcgaagcacgacggcggggtcgatgcgggtggcgcggtggacgggcgggatggaggcgacgatggcgaccagcgcgctgaacagcacggaaatcagggccagccaccagttgaatacgatggagcgttcgaacaccgccacgcacagccaactggcgagtccgtagccgattgcggtgccgatgaggccgccaatcaggccgtagagcgacgattcgatgtagaactcggtgccgatggcacgcgagctagcaccgagggccttgcgcaggccaatctcgttgcgtcgctgcgagacgatcgagctgattgtggtgccgacgccgacgagcgtcagcaccagcaccaccagcgagacgatccagaacagcgtctgcagcatggtgatgatgcgggtgtcggaggcggtgatcttggtgacctgctgtgccttgacgtgcatggaggtcatgtcgttgatgctggacaccaggcctgcgaggtcgctggcgccggccgaatactcgatgacgtccacgccgcgcgtgatgccggtgagcttgttgacgtcggcgttggtggcgtagatgatcgagtcttcgctgccgccggtgtccacgatgccggccacgcggaattcggtaccggaggtgtccatgatgtcactggagacacggccgtctttggtttgctggtcgatcgaggagttcgacgaagtgccgttggtgctggcgttatcggatgcacggtagccgatggtgatggcggagccgattctcaggccgatggcgtcggcgatgtcgcgtccgaccagcaccttgccgtcggtcggccacgagccgtcgaccacccagtgatggttgaggttcttgacctgcgccgcattcacgccggccatcacgtacggcgaggcgttgacgcgcacgttctcgtagcggtaggtggcgtatttcgcggaacccttggccttgaccatttcagtggtgtgctgcaccatcgccttgtcgatgccggccttgccgtcagcattggtcgattcggtgggcgtgacaatcaggttcgcgccgtacgcacgcatctcctcgttcatctgctgcggcacggcgaggcagatcatcgccagacagaacagtgtggctgcgccgaccagcgacgccaccacagccatcaccgcgcgcgaacgccgacggaacacggcgctgaacagcattctgaagaacataccggtgttggtcatcggttccctccttccacacctacgtagataaactcagcgaccatggagcacctccgcgggcttgagattcagaatcgaacgaatcgatgaggcggacgccagcagcacggtgacagccagcagcacgaacaccagcacgaacaccatcggccgcatcgtaatgccggaaccgaacaccacccggcctatcagctgggccacgccggaaccgagcagcgcgcccacaatcgcgcccagcagcgagattgccgccgtttcggccagcatcaggcgggataccgcggcatcggtggcaccgagcgccttgagcaacgccagctcgcccgaccgttcgccgatcgaggcgaccatcaggttggccacggccacggctgcggcgatcaggctcagcacggtcatcagaatcatcacggcctgcgtcttttgcagcacattgccctgcaacgcggccacctgacgcacctgcttggccaccgcgcccggaatcacctcttcgatctgataggcgatcgagctcgggtaggcggtgcagtaccaggtctcccattcctcctggctcagcgcggccgggttcgcggcggccttacgggccaggtcgttctccggcgtggtcagggccttgacctcgattttgtcgaccgaatcgggcaggtcggcgagtacctgggccgtggaggaggcgatgtagagcgagccgttgtcctcgtcgccggaatcgtagacaccggtgagcttgattttctgctcgttcttcttgcctgaggcggtggttttgttgagggtgatggtgtcgccggtggtcacgccgagttcggaggccagcgtcttgccgatcacgccctggtcggaatcgtctttgggccacttgccgtccagctgccaccacgagcgcatgccttccacgcccacgacggtagtctcgccggtggagatcttgaggttcttgttgaaccacgtgccgacgaccggcacgttggtaccgttcaccgtggcgtggatgttgagctgcggcgcgaagctggtgatgttgaacgaccagaagatcgtcttgatcttggccgcgtccgactccttcagaaaagcggtcgggtcgctggtggacgtcgcgccgcccgactcggtgttgtacaggtcggaaacgaccgcatccgccttgggctgcacggtgatgttcgaaccgtaggtggacagctcggcgttgagcttgtcgcccacgtcgaacacgacgcccagcatcgatacggacacggtcgccgacaggcatacggtcagcgcgataagcaggcgccggcgcagctgtcgggtgaacgagcgagtaatcatgcgcagaaagaacatgattcttgtctcctgcctgactcaccggaagtgggcgctcagcgcgtccagatccgtagtttgaatggtgatcttgccgtggccggtcttgtacgggaatggtatcgggttgcagccacccttgaagccgatggtcgccaggttgatggccacctcgcacttcttgcagatgatcttgccgtccttctcgtagtagccagcgtcgccgcagttctcgcaggcgtccaggccgatgccgtacgcgccaccgttctttcggatgatgatgaagcgcatgacggtgccgtccttggccttgtattcgaagcggtgcaggtggccgtcctcgacctggctgaaggggatggtggccacgccgtccttgagcgagtaggcttccggcggcgaaagggtgatggtctgatgggtcgcggcaacgcccacggtcagggttgctgtgacgccgatggctgcgataaggctccacacggcagcggcgatggcgtggcggcggaataccttatgccggcgcaacgtggcctcgttggctcccggcacatcatgggttttcatacggaaaccggccacgatggaggccacggcgggaatcaggaacaccagcgcctgcgccataatcatcgtggagttctggttgatggaccaagccagcgccacgaacatcgtatggttcatcgggaagcctcgcgcctgcagaatctgggcaagaccagtgaagtgttgaatcagcagaatcaccatcatggccgcgacggccacggtgaacgcccagcgcacggcagtggtgcgcatcgtgcggaagatggcggccacaataatggacatgaccacgccaagcaggaaaccaagagcgcgcagcagcatggccgaagtgaatgcggtctcccctggttccacccagatggtgagctgcagaatcacgtccggcagcgcgtagaacagggtgagtgcgatgtcgatggcggccacggcgttagcgatgtgcatgaacaccttgtgctgctgccaattggtggtgatgcggcgtgcgaacaccaccacgacgatggtcaggatgtcggcaatgatcgcgcaccacaacaccgggtagttgacgaacgtgcgctgattgatcacggccgaggcgcgcaggccggcgaatacgatggcggcgatcagaccgacgatcaggccgatgagacgccaatgcgagcttatcggcttatctcgcccctcgccgaccgtgagcatcacgctcaggctcatcaccagcaatgcgggggccaaagtgcccggcatcactgccacgaattgttcaagcattcgcgtcctttctctgttcaccttaggctcccctctctgaggggagctgtccgcgaagcggactgaggggagttttagaccgtcctaagaattatctccctaaagcggcgtaaagccccctctgacgagggggctttctgcttagtcaatcaccactggcgaggagtgtaatcccagttgtcgaaggtgacctcgatcggctcggtccagaagtggcccttgacgccggtctccgggtcaacgtgcagcatccaacccttggaggccggggattcgatggagagcttcagctggtaggtgccagccttgtcgagcttgacgttggcgccgtagtgcgggccatcggaagcgttcatctgcatgaaggtaccggaggtggcggtgccgccctcgacttccttgccggtggacttatcgatgatggtgtagttcacggtcagatccggcacgaagtcgcccttgccgtagccgagctcggtgcccttctggttggcatggatgtcggcctcgaggtggaaggaagcgtcagcagccttcaggcccatggaagacggctccatatcgatcggctggaagtacacagcgcccacggtcagcgggccggcgtcctgatcctgctcttcagcagtaccggacgggccaaccggaacctcttcgaaaccggcgccggaatcggaggaagaatcggaggaagaggagtcggaagactgggaggaggagtcagccttagtgtcggatgcggagttggtggaaccgcaggcagccatggacacggtcatggaaccggcgagcagcaggccgagcagagcggccagtttcttgttcttcatcattgttattccttttctctatctctggtgaattaggattcacgcttagataattgcaattattcagttatgagataagtgcggcgtgggctggaggaattggcatcgatccgaggccgtgccgcaagtctgtcagttgtctgcagttatgggaggaaacggacgagctagacgggctacgccttcacggccgggacctcgacagtagcctgcgccttcagcttgcgctgcttgatgaagccgaccacgaacagcgcgataaccgcaacggctgcgatggcctgcgccactaggcattcgacgtacgggtagaggccaagccaatcgttcgtcggcacaccgttcaggtagaaggcgggcagcaagtcgccctcgatcagcgagtggacgccgccgccggcgaacaccaccaccagcacagacatcagaatcgaagtgaccaggaagaacggaccaatcggaatcttcacggaggtgaagcggaagagcaggaagatgccgacaagcaccaccgcggcggtcagaccaccgatccacataccgcgagtatcgcggctcatcgtgtagatggactcgtagaagatcacggtttcagcgccttcacggaacacggcgaggaagctcagcatagccagcgagaccacggttttcaacgtcacgttgtcggcacttgcggcggcttcggcatcagccacagcagcctcggtcttcttgcgaatgtaacggttccacgcttccacgctggacttgttcagcatccagttactcgtccacagcagcatgcccatggcgatcagtgcgcaggtgccttccatgatctcctgaatcgggccggagccgccgaaggcgaacacgaagatcacagccaccaagccggcgccgagcagaccgacgagcacacccaagtaaatccacttgacgaagcgcttgttatcggacttgaccaagtaggcgacgatggctgcaaccaccagcagagcttcaagaccctcacggataagcacgaggaacgcctggccggaggagctggtgaccagcttggtgaaaccgtcttccttatcggcggcaccaccgtcaagaatgccggcgtccttgatcagcatggccttgaggtcgtcgatcagcttcttggtgtctttcagggatgcgccggcgttcatggacttgcggcacatcttgaactggtattccacctgcgagacgcggttgccgctgatggcgttcatcacgttcttttcgaagccgagcttctcgtaatactggtagtacgcgttgttcacgagcgtggcgcccttggcaccatcacccttttcgtaagctttgtatgcattgtcgagaatcggggtcatttcgttggccacgtcggtccatgaacgattgcccttgcccgggttcttctttttcttggcgtcgagctccttgcgctctttggccagctgcgcctgcagcgcttcggcgtacgccttcggcttggcgagatcggcgttggtgtcgagctgctgggccgtggcgtcaagatcggcggtcaacgcatcaatctgctgagccagttgatcgtcgttgccaggcgtgtaggaaagattctgaacgctttggaatgcctgctgttgggcgagctgcttgtccgcgccaatggtgtcgtgcacgaccgcggtgaagttggaggccacgtaaatcttgttgtacgcgcccatgaaatcggaggtggcgccagcggtgttgccatccttgtacgtcttaagaccgctgttcagctgcttgtccatcgccttggagacttcggcccaggtggcgtagtcaacgctggacgagcttgatgaactggacgagctggtgctgctgtcggcgaaggccatcggagccgtgactgcaggagccacagtggcgatgaccatggcgaacagaaatacaatcgcagccagaactcgcagctgcctcacgctggtgtgttcaacggaccgaagagcagcctgggcgcgacgaaccatgcctatccctctctctgcgcggctaagtaatcaaaaaccaactactcaatataaagaaaaacttttttgaggaacagtcttgattttttaggatttaagaggtattaggcactgtttttcgatcaattattaccgcagattgtctcaatattcgatattgtcccgctcacagatgggagacttcccgaattatgaactccccgcgactggccactccccatccctcatattgcatgaccaactgtttcaccaaggttcatagcctaaaatcactatgttgcatcacggcaagaggctggcaataattcacgcgatggcatgcgcatgttcattctggtttgcctcgggtttgctgacttgccttgagtcgctttgatttgcactggttcatcccccggtgagatcacctgttgcacacgccgtacgaacgacctgcacatcagcgcaggcactcattggtggtccttgtccacaaagcgacacgccgcagccggcactgaatgtgcatttatccgaaagctgtggtaacttattcgagttgcctacggagcttacttctagcaagcactgcagtgcatggaggattcgcctagtggtctatggcgcacgcttggaaagcgtgttggtgtaacagcctcacgagttcgaatctcgtatcctccgccatcagggttttggcttttgtcaaaacccttttgttatccgcacccacatgcatatacgcagcggtccaaatatgtgcacaatcgtgcacattcactgtttttgcagtggcgtggcatggcacatattccgagacgaccgaattcccacaattttcgtgccacaacagcgcataaaaacacgaaaatgcgattacgtggcacatccgaatgccacatgagcgcaaaatagccaatattgcgctcatgtgtacaacttagagcacccgaatacttcctcgcacacccgtcgatttgcgtaatacgcgattgcgtgtattgttgtgcaagccgttcaacggccctaagccgtgcgcacattatcgccccgatagctcagtggtagagcacttccttggtaaggaagaggtcgtgagtccaattctcactcggggctctcaatcaccactcgatgccgtactcggcatacatatacatatcgtactggtactcactgctgtagttcaggtcgttctgatgtgcttcatgatggctgttatctgactgcataatcattccttttcctagcctcatcggtattacgaccagatatagcgaaatcgcgttaccgaactatgcgcgttcagcgaatcgcaggtgaactcatagcgaactgttgcacgcactccgcatgcgagcgcagactcattgacatataccgtccggcacacacttcataatgtgcaaggccgcgcgccagctattgaataccgccaaacagcaaaggaaagcctctcccaccatgacctcacaccttgccgaagcaggacgcacactgattccccgcaaggatgatcggtacggtctgctttccccagctctggttattctcacgtttgtcgccggactggtggatgcgttaagttacttggcactcggtcatgtatttgtggccaatgtgaccggcaacattgtgttccttggttttgcattcgcccacgcgcagggcttcgtctggtggacttcggcgctcacgctggccacgttcatgattggtgcgttcatcggcggacgcattattcattactttggcgccaaccgcgcgcgccatctgctggtgtccacgtcaatccagctggcttttgtggcagctgcgctcgtcggcatttatctgctcaatcagtttgcgcctgaaccgtcgatgggtggcactgatgcttcagccatcgcccgcacggcacagcccagtctgaacttcccaactgctcggcatattgatttgcatattattctgctgattgtgctgctcgcaccggctatgggcattcagaattccactgctcgtaagctttcggtgccagatttgcccacgactgtgttgacgatgacgttaactgggattatcgctgacacttcggcgcatggtcatgggcagtccaaacttggccggcgcgcgattgtaatgctggctttggcgctcggtgctttgactggagccacgctgcagacgcgcggtcatgaggacgttattttgatggtgatgatcgtctgtctgattgcggtcattgtgatgatgatcccccatgtgcattccgatgcccgctgggtgaccggaaaacactgattcatacaaaaacggccggcgctgggcattgctgaccggcaccggccgagataataaggagtgctccttatgtggtcgcgaaccttacggtttcatgatcacatctgctcgcgattgcggcggtaggcgattgcggcgccggcaccggccagcagcaatccggccacagcaatcgtgacgacattggcacccgtgttggagacgacattgccatcacccttggcagcggtacgcttcaccaagccggcaattgccttctcgagagcctcgcgagctgcgtcgacctgcttctgcgtggcgttgctgttgtcggagacctcacgggccttcttcagcgcggcgcgcagagcgttggcggagtcgtcggtgtagagacccaggttgatggcggcggccttgttgatggtcgcgttcagagcagccttgtccaccacgcccggttccggattcggcttcggctcggtggcagcttccagcttggagatggcgtcctgaagagcgctcagtgcggtatccacatcctgctgggtggcgttcttgttgtcgagcacctgctgtgcagccttcagtgcctcggcgaaagcttcccacgagttggtcgtgtaatcggccttctcgagcttgcttgccttgttcactgcagtctgcaggtcggtcttgttcacctcaaccgggcctgggccaggctcctcaccggtcttctcgagaccagcgatagcggattcgaggttcgtcagcgccagagccacatcgtaagcggtggccttatcgttatccgccacggcctgtgcagcttcgcgggccttgaccagagcagtccagctttcagccgtgtagtcggattccttaagaccgttagccttggcgatggtgtcgttgaggtcggtcttgtccggagcgacagtctcttcctcaacctcgcggtccgtggtcaaacgcagttcggcagcggatgcgaacttgttggcctgggagtcgctctggcctgcggaagacaggacggtcaagcgtacggcggtcacattctcgacggcgtcgaagctggccttctgccacatggtggtggtggagaactcagcatcggtgacgacatccttggtggtgccatccgccagagtgagcgtgatcttgtagcccttgatcttgccgttggcgttcatacctccggagcgcggcaggtagcgcaggccgttgatggtggtcggttcgttgaggttgaactgataccatgcggtgccgttgccgactgcgttctcgctccagctggtgtgccagtgggtgctgtcgttgccatcctgtgccagatcggccgggccttcgctcggcaggcctgcggtaggctcttcgctgcccgtggccacggtgtagccacccagctcatcggagccgtcagctgccacgtcgtacttgtcgctgctctcgttgccgggagcggtcttcatgtactcgtcgagggccacgagaatgtcgtatgccttggtgaagtcctcagcggttgcgccattcttgttgatgagcacgcgagccttgaccaaggtgtcctgatactgctgccatgcggcatcggagagctcagcacgcttggaatcgtacttgccgcggatttccttgaccttgtcctgcgcttcggccttggtgcgggtctgggactcgatgcgctcgatcttcaggttgtcgagcacgaagtccttgtatccgccgaagtcctgtgcattgccggtggaaccctgcagatcaggtgcggttgcggtcgagtaaataccgaaccaggaatcgccgttgacgccaccggtcagctcgaactcggccttgccggtctcacccagagccttcttcaggttggtcagcttcacgctgccggcagagtattcaccctggcccacagcgatggcgtagatgtcatcggaaccggactggtagtcgaagctcaccttgtacttggcacccgcctcgaacttcacgttctgcgggatcgtctggtagaccagcgtgcccttctgggtcaggccgttaaccttcacagaccaagtgccatcgagcacatcgtccatcttcttgacatcccaaccggcctgcgtgaacggagcatgcagctcggagaggtggatgcggttgtcctcaacgccttcggaaccggagaccacgaacggccagatgccctgggcgttgttttcgaatccgttggtgagggacttcagcgtgccgtccttctcataggtgatgccggagtactggttctccacgatgcgcacatcgtcgaagtaggtgtgtgctccgtcggtgctcttgtgagacagggttaccgtggcatcgccgttctcaggcgcggtgaagaacacgtacatgttctggaagtagctggagccattttccgtattgctgttcgtgttgtggccgtatgccttgatgtagttcttggcgatggacttgccggtggagttggtggccagcaccttgccgccgctggttacggtgacggatgcatcgccggtggagcggttgtcgacgccaacatacagcgcgtacttctggccagccttgagatcggtcagacgctgggagacatcgaccttgccggtcaggcgcagcatggcgttgttgtcgccttcaacttcggccttgccggagccgctgacggtccagttgtcggtgagggtgttggagccgccgttgaagccggcgtctaccacatgcatgccttcgctccagttgacctggatctgcttggcttcgcccttgtacaccacgtacggggtttcggcatcagcggtaagcgtcaccttgccgccggagacggcaacggtctgctcgttggtcttgccctgatcggtgagctggtacacctttacgctggagaggttcttccagctgtccggcagggtccaagtggtggtgccacccttggtattccagtggtagagcttctgttcggaatccttgaccagcttgccggtggaggaatcccacagccacggcagcaggtaggactcgtcaccagtggaggaaccatcgcctgcggagacagcaccggaagccaccatcacgccgttgaaggtgatggtgcgctggcggtaggctgcgctagaggtgtcgttggaaccacgggagactactacaacgttgccgttggaatccttcagggtaatctgctcgttgccgttgttcgtgttcgggtcggacacggcagcggcattgccattgtcggcggtcagcagcgggttgttgacccagcgggtcaccttgaagtgctggatgaacttagtggacacatcatgggtgtacaggttcttgatgtaggcggcatagtcgttgcggccctgccagccttcgaagtccttcatgttgtagccgccgagcagcggggcgttggcagcgccgccgtattgcgggtagtcgccaacccagctgtccttctggtggttgcgcaggaagcgcatcacttcggagttctcgcccttggaggtgtagccgccgtaggtcagatcagctgcccagtgctggaaggtggagtcgtactcgttgccggaaccccattcggtggtcatacgccagccgttgtcgttgatcatcttgctcatcttgcgggtttcccaagaatcttccgaaccggaagaagtcaggttgccccacacatcgaggtagatgaagtccatgttgtcgccgacttccttgctgaggtcagcgaaacggcttacacgagaaccggatgccagatcgtagatgccgtcgatgccgacaccctgatcaagccagttccagccgtagctcaggccgcctgcagagttgcggcgcaccatgtcctcgctgaaggccttggcttccggatacatttcggaggcgttgacgtgcacaccgaagcgagcgccatacttggagccctcttccatcatggtgttcatgtcgtcggcgccgccgagacgctggccgatatcgccgtagtccgggtggccggagtcgtggccttcattgccgtagcccttgagcagcacggactggccgaggccgtcggtgttcaaggccaccttcttgacgttgtcaagcgtggtgaggaacgggttctgcgcctgggagccgaagttcatggcgatacgccatgccaccagttcgggaacttcctcggacttgtacgggttgttcatgatgtcgcggtaggcgattgcgccatcctgccagttgacggcaccgtcttcgttctcgtcgccggcgatggccacggccatctgcggcagagcggtttcggccacggtgtacttcttgcccttggaatcggtgaccgtgcggtggtagtaccacggagcgctggccaggcccagggaggtggcgtcaccagtctgctgggtggtggcgtagacacgcgtgttctggctgccgccgcgcacaggagccgccacataggtgccatcgtgctcggagttgctccacaggccggcactcaggccagcaccggagatgaagccgtaggtgtagtcgctatcggtgacgttagtatcttcggtcactgcgaagttggtatcgccaggcttctgcgtgttggaagacatacgagcaccagtgaattgggcattttcctggctggaacgcacggaaacgagactctggttcgggaaggacagcgtctggatggcgttctcctccacaccgttgccctcaggaatgccttcggacaggttgttcttgatcttggtgacgttgaggtgcagctggttggccttgaccgtgatctgaacggtgatcaccgcgtcaatcttcttggcctcatccttgaccttcagcgtgtaggtggcctcggtgtcggaaaccttcttgaaggtcacgtcgtcatcgcccagttcgatgttggtgccgttgatttcaacggtgcgcacatccttggactggccgtacatcaccttgccgtcggtcatcgtgtactgcagcacagaggggaagttcttcttaatctgaacttccatcttcttggtcttcagcgtttcggaggcgacctgaacggttttgttcagggtgatgggatcgatggcaagatccgcgccggagaccgtcacctgctgggagacgtcctcatagccttccttggcaatcgaaagcgtgtgttcgccttcttcaatgtcggcgaaggagaaggtgccatctgcaccggtcttcaccttggtcttatccaaacgcactgttgcgccttcaatggcagcgcctccagcgtccacaaccttgccggaaaccgcgtgcttggcggcttcgacaacctccgggaagtccttgatgtacacgtcggtgacctcgttcagctccttccaggagccggccttgatggcaagcttgttggagaggttcgtcattgcggagtaatcgacatcgaatgccttctggccatccacggtcagtgtggcgaccttggcgtcggtccaggagacctgaatgtcgtgctcttcgttggcgctcggagcagcgatacgagcaccgctgtaccagctgccgctaccgccaccggtgtaggtctgccagaaccagccgcccgaatcgtagccgatgaacaggccgctgcccgggtcgttgtagcccaggtagaagccgaagcggttggcggagccttcctgcggggatttgatggtggcgtggaaggagccggccttggagaagtcgtaatctgtgccccatacggctactgccggccagttgttgctggagctggggttcgctgccgcattaccgttagaggcagtggacttgaggtgcagccaaccgtttgccatctccaggatttcgccgccctgagcgatgttggaatcaatagtccagccttcaaccgcatcggcttgtgcggaaggagtctcggaagcagttgcagaatcagaagtatcgttgatttgctgaatctgacttgccaaagtctgcaagtcagcatcagacaggggcactgcgaacgcagtacctcccccgctgcccatgcaggttaaggctaacgctgttgccagcgcagccgatatagtcttcttctttttcattaactatattttccttaatctcttcttcgaggtgaagcagatgccttcttcattgaagaatacgcattcgcaattacgataagacactttacaagaagctattcttaatagcaatctcagcaaatacggagaatcgccacatatttgacattgaattacaacgtgagtgaaatcacaaaacccaataaacgactacgttgttaaccttcacatctatattcgcatcatcgcgacacgcgcagggaaaaactgcgcaaaaaaagtaagacgaatttacctgcattcgacgcaatcaatgcagcagcattacagcagcaagccgattgagcaaaatagcaaaagccgccttgcgcaaccgcaagacggctttgacgacaatggtgaggctgtgctcgcttacttcttggaagcgttcacggcatccacagccttctgcagcgattgagtataagccttgtaccaatcagcctgctcgttgagcttcgcagtagcggacttgaagccggcagtgtcgtcagctacgcagccttcgtataccggcagttccacgctcagttccttgttgagggcgtccagcgtggaggcatcctttacatccttcttggtgagcgcagcagcttcggaagcatcgccattgaccaagttgttgtagtcattagtggcgttgcgcacattttcggaagcggcggcgcaagcggcgactgcattgttgtactgagcatcggagtaggcgcggaagccgaacacaccggccacgacgataatggccacgaccaccacggcgataatggcgacggccgccttagacatgtgcttcttctgagcgccttcattgcttgcattgttggcgttgtttgccggtacagcctgctgcccagcggacatacttcgatctccttcgttctcgtactttcatacacacgtatgcgctcttagcgctcttatgcgcactcatatgcagggaagtcgcttttcaagcggctacttccctgaaaacaaaaaaccctcgcattccgcgagggtcattggctgggatgcctggactcgaaccaagaatggctgaaccagaatcagctgtgttgccaattacaccacatcccaatttggcttggcgtagcaactccaaggagttgttcgtcgtacccccaaccggatttgaaccggtgttggcgccgtgagagggcgtagtcctagaccgctagacgatgggggcatattcagtttttcaaccggctgctcggtgaaccgcgcaacgagtgataaatatacgcaagtattcacccttacgcaacttacggcgtgtcgcgcggaatttcaacgatttcaagtgctacgctgccactactgatgaatttgcatgaactctactgacggattatcagtaagcactactgatgaaataccatctaatgcactgatgaaattgcagatgaggcaatgatctttgccttgcacattcatagccggcaaatcagccttcaagaaccaaatgaggcgcttatgttcccttgcgacagcgagcgcgtcgcgatgcttgtaatgcaatgtcacgtcaaagaccgccgcccggttacctatcaaccgtttcatggacgcatgaaggcgaaaccacctacaaggcacgtttcgtgacctcactgcacaaaccagccatgttcaacctcgtacatattctcactggcatgcggcgcagcggtaagactttccagctgttccagctcatcactgaatacaagaaaaggtgggcatctgcacatgcagacgcccaccttgagtgtccttacagctcagccgagcacggaaggaaccttagctcacaggtgctcgcgcaggcccttcaggcgagcgagggaaaccggcttgccgacgatctccatggactcgaacagcggcgggctcacgcgacgaccagacatggccacacgcaccggaccgaaagcgaggcgcggcttgtagccgccctcctcaaccagagccttgttcagggtctcatgcaggttgtcggtcttccagtcagcctcatccacagcctcgagtgcggcgatggccttgtccagcacctcgccggcagaatccttcagctgcttcttggcgtcgtcagccggctccaagtagccctcggtggagagcagggagccgaccatgccggcaacctcacccagcaggcgcacgcgcggctgaaccagcggagcggcggcggtcagcacctcacgctcacggtcggtcagggcatcccagttgtcggcggaaaccacaccgtcgcggtgcaggtacggcaccgagcggcgcaggaagtcctcgggctcaagcatacggatgtgctcggcgttgatggagatggccttgtcgatgtcgaagcgggccgggttggccttgacgtcgcgcacgtcgaacttctcggtcatctcgtccatggagaacacgtcgcggtccggtgcaatggaccagccgagcagggccaggtagttgagcaggccctcgcggatgaagccattgtcgcggtggttgaacaggttggactctgggtcgcgcttggagagcttcttgttgccctgacccatcacgtacggcatgtggccgaacagcggcatctccttggcgatgccgagttccataaggtaacggtaaagcacgatctggcgcggggtggagctcaggaggtcctcgccgcgcagcacgacgttgacttccatcatcgcgtcgtcgaccgggttggtcagcgtgtacagtgggtcgccgttcgggcgcacgatcacgtagtccggcacggagccggccttgaactcgatggtgccacgaatcagatcgtcaaaggcgatgtcttcatcaggcatcttgatacgtagcgcaggcttgcggccctcggcgcggaaggcggccttctgttcatcggtcaggttgcggtcgtagccatcgtagccgaactcggccggacggccggcggcaaggttgcgctccttgatttcctcaggagtggagaaggactcgtaggcgtagccggcttcgagcagcttggcggcaacatccttgtagatggcggtacgctcggactggcggtacgggccgtgagggccacccacatcgatgccctcgtcccagtcgatacccagccaacgcagggattcgaggatctggttgtagctttcttcggagtcgcgcacggcgtcggtgtcttcgatacggaagatcagcgtgccgccggtggcgcgagcttccgcccagttgaacagggcggtacgaatcatgccgacatgcggggttccggtcggcgacgggcagaagcgaacacgaacgttcttgggcagttcgggtttggtgttttcagcatcagtcatagtcccctattgtgccgcgcgcgccggacgcggagagcagcgctcctcgctcttttgcttcgttattgacgtttcgggccaacaccatcccaaaacggccattttccaacgaaatctcttttgcctgccattttcttttcttttgcttttaaaatcaaaagaaaagaaaacagcaaacgagaatcagcaggccaggcccacgaacagcagatcctagtcttgagattcgtcttcatgcgattcgcgctgctcaacggcggcatccgtgtattcgtggttcatggcattccctacatctctgtatgttgctttatgcgtagcgccaaaagcttcgtctgctttccagttccacccccgcaactgtgcgcaatattcatgtaacaggttacacaaccgatcgacaacgttcaccctcaactgatatcgatttgataaccatcgattctttccagtgcattcaccacaactttggacattatttggcgcaattgttgagttttccactcatgcaatggaagaatatgatgtgacacataggtcttatgaaaggggaatcaatgtctgatcccaacaatgtgcctttgcctcagcagcctgaggccaacggtacgcccgcacctaatcccgtaccgcagtatggcgcaccggccccggcgcagccctcacagccggcgcagcccgcttacggccagccggcatacggccagcctgctccgaccgcgaactcttatggccaggccgcaccaacctacggtcagcccgcgcccgacgccaacacctacggtcaatccgcaccggcgtacggcacaccgacccccgatggcaatccttacggcccggttccgccgtcttacggccaatacgccgcgcccactgccactgtgccgctggataagccttactacggatgctccttccaagaagccttcctgcgcttctggaagaagtacgtggtgttcaggggccgcgcgtcccgcagtgaattctggtggtgggtgctggccgctttcggcatcaatatcgtgctggacatcctcaacaccgccacagatgaaaagcttggcttcctcgccaccatttggggtctggcgaccctaatccccaccctggcactttccgtccgccgtctgcatgacacgaacaagcctggctggtgggttgccattttctatatcgcgatggttatcggccttatcatcatgattatcggcggtggtgcggcactgtacggcgggttcaggagccttggcagttatgactatggttatggcagcatggccgccggcggtcttggcgcggcggtcattggtgcgttgattacgctggccggctgcgttgtctatatcgtgttcatggctcttcccagcaagccggagggcgcacgttttgacgatggcgcggcggcaacccccatgcctcagggtgcttacggcgcaccatacagcacgcctgtacccccgaatttcgccgctccgaacgcgcccgcacccggcttcaaccagccggccccggcttacggccagccgcccatgccaacccccgactatggccagccggctgcacccgcacctgattacggtcaggtgccggccccgcagtacggccaaccggaggccccggccccacagtacggccaggttccgccgatgcctcaaaacgccggcgacgaatccgcaacaccttctgagcacacggctcccgccggcgacaatgcccagaaaccctggcaaggccagtaaccgatatcggtgaacttccgttgaagaagttccccgcaaccaatgatgaagccctactcaacgcgagtagggcttcatcattctcggcactgtattatcggcactgtattcagccaactaccccaacggcatcacggcaatggactgcgaaagcatatacgattcacccggactaagggcaacgatacggtctcggcacgccgctgcctccacggccacaaagccacgccattcacccgtcttggcatgggcaatggcgttgccgccctgctctccgggattccacaccaccgtctgcggcgagccggtcttgccgatgcgaatcacacgacccagcacatggtcctgcaattccagtgcagcatcggaataatacacacggtccaccggctgatcgccgaacatcaccgatggctgttcttgtagttttggcgggaatccggcttccgtggcatccagatatgttgcaccccgcaaaccgaccagccgcgcgccgagcacatcgccgacatgcagatacgagtgcagcgccgcctcatacgacatcggctcacctcccgtgttggtaacggtcagcgtcatcgtcagcgtatcgctggcacacacctcgtatgcggcatggaaacgcacgttgggttcatcctcgatccatggcacttcgccagtcgtcagtcgttcggaatccagcacataccgcacacgggcaccggtaaacgccccttcgtccagcgcccactggcgcaatcgtgcgaacccatgaatcggtcgcttcgcagtctgcccgccatgcacaaaccccggcccgaaccaggggaagcacaccggcactcccccgccaaccggctgaccagcttcgaaatgccatgtgcggggcgtccagattacatccggctgccccgccggggcccaacgcagcagatgcgccccgtaatcgctgattaccgcgctaccgccgtcattggtgagcgtgcgcagattgacgccattgcccataagtgtttcttcttccgttgcgtaagcgatgttcttcaccacatagacgatttccttggcacggaggaatcgcgagcaggggtaagagaaccgatcaggcgggctaagctgccttgattctcacaactccacggtttctttgccagggtcatctttaatgtgcgcaaacttggcggccaaggcctccttgttgcgcttttcgtcttcttccttggccttcttcttggcttcgtccgggttccagagcacatcgtcgcggtgcttggtccattcggcaccggccagcggggcaatgtattcggcggtggcggtcagggtgtcaccggcattggcacgcgtatcaatcagatcaagaatctgctggtcggtcaggcagatgcgcggaatcgagcactgctcacgtaattcgttgacgtacagcagaatcggcaacgttacgatggcggtggcccgggcctcgtcagcaacatcagcggcatcagcaacagccggaccaaccaagccaaccgtctcggcatgcccgctcaccacgttcagcagcgcatcgcatacggcgagcgcggtggcgaaacggacggccacatcagccggctcgccggaagccgccaaacgtccgccagcctcggcatcggcctcaacctgagcctccacggagacaaccgtctcacggactgcggcctcgacatgcgaatcccagtcaacacctaaagcttcggcggcatcgaaaatcagctgcacatcgccggattccgagtaaccggccatcgtatcgtaggcgtcattggcagcaagcagcgtgtctacgatgctttgcggacggccaggaatctcatcggccccctcgtagacgaattcggcgtcaggcatcgtaacatcctgaccggtgagaatgcgtgcgaacgcgtgcgtgacacgcacctgcaggttctccgcatacttggcgtcattgtccatctgcatggcttcggtcagcggccacaggctaattagcgccgagccggcttcagcggcctcagctacccccggcaatgccgcgatccgtgcgattgcctcacgattgagttcaatggtcattcatgctcctctgcgttcaccacttgattgtagtgcgtcccattggctccctctgaggggagcccagattgtagctcagctattcaccagtgtgccgttacttgacgttggctgctgggtcgacatacgtgattgacatcacacggccggtttcgttgtcgtacgtcaccgaggtcacggaggcgagcgccgtgtgccgcaggaacatccagtgctcggggtggccggtctccagataatggcgataactgaaaatcggcgattcgtggctgaccaccacaatctgttcgccggggtgttgggcgaccttctcgcgtgcgaaatcatccatgcgctgcgcaatgtgctgataggattcgccccaactcggcttgtacaggttggtgaccagtttccaattgccgttcttccacagcgcgccttcgccatggccgatacgcttgccgcggaactcgttgccggcctcaatcactcgctcatcggcggtgagcatgagcggggcttcgcctcgggcctcgcgcacgggattcaacgcgtcaagaatcgcgtcggcggtctcgcgcgtgcggtccaggggagacgaatacaccgcggaaatcgtattggtctgagggctattggccagataggcggcggtggcctgtgccatacgccggccaagatcggagagatggaagtcgggcagccgctcgtagagcagatggtcagggttgtagaccttgccgtggcgaacgaagtggatggtggttgcgctcatgagccgcctttctttttattcctacgggcatcttgcgatgttcgccgaagaacatgagaacgttgtcttaatatctccaatctaccgcgtgtcgcgccctaaccaacgattagagtatccgtgacgcaaatatgcgaatagggaaatccaacgcaaactttgcgcgaccatggacaacacatcattcgatgagggcttcgccggcaacgccacgtcagcggggaacatccaatcgggagcggaaaggagcgtagtgctgttatgtccaacaacctgtccaactcgaacaccattatggctggcatcaaggaagtgggtcacaaagtttttggtgggtatgcggagttgctgcgcatacctcataccgctcgttattccatcggttcggtgattgcctgcatgccgttcccgatggtgggcatgaccatcaccatttccgtgcagcattactacggcaactactcgctggcaggtatgctcaccgccattcaggcgattgcactggccgtggccacgccgctgctcggcaagctgaccgacaagttcggccagcggcaggtttcgattccaacgattctggtgtggattgtcgccgccgtcgcgctgaccacatccatcaccaatcgtgcgccggaatgggtgctgtactgtttgacgccgttcctggcagctattccgccgtggggcgcgatgagccgcgcgcgctggaccaaaatcctgaagggcgatcaggagcgtaccaaccgtgcgctctccctgtgcggcgtgctggacgaatgcatgtgggtaatcggcaatccactggcttccacactggccgtgatctccggtctgctggcattctcgttcaccggcatgtgcgtggtggtgggcgcgctgatgttcttgaccgagctgaccactgagccaccgtcacagactcagctggcccgcgctgagggcatttcccgcaaggaataccgtgagcgcgaggcggctcgagccgaagcgttgaaggtggagaccgcagccgaggagactcgccgccgtcttgagcgcgaaggcgtgaccgatgaggccacgattaacgccgccattgagcaggcggtcgccgatgcgcgttccggcaagaaggcgtccatctggggaccgggtctgattgcggtatgcgtcacctggttcggcttgggcgcgttccagtcggctacaggcatctcgatcatcgcattcgccaccgagtcgaatatgaagcagtacacgggctttgtattcgcctgcttctccatcagctcgttgatgggcgccttggtgtacggcgcgaagaactggtcgattgccctgtggaagcgcttctacttctgcctggccgtggtgaacatcggcatcagcacgttcctgttcgccaagcatctgtgggtgattatgatcatctacctgatcatcggcgtgtgccaggctccgacgtggattaacggcaaccagctcatgctgcacttggtgccgccttcccgcctgaccgaaggcatggcgtggatgggtgcgatgaattctatcggctcctccgccggttcggcgattgccggccagttcatcgaccgcatgggctcgcatggcggcttcatggtggtgaccactttggcactggtctcgctggtgattgcgctgattggcttcaagcagatcaagggctccaccgagcagccgaccttgactgaagtgagtgtgtgagacaaaagctaagccccctctgacgagggggcttatacgtcaaaacgctacttcggccagcctttgggcgtgtgttccagggaccagatgccgagcttgtgggagaagctgttctgccacttggcttcaagctcctcggcattcagtcgattttcagcggacttcagacggttcatcgcattggtgtgcgtatcgtcgagcagccacttgcgaatcaagaagttccagatcattaccacggcagtggccaccaacttgccgatattggtgcgcaacagatattcggcatgctgcgatacataggcatcatggttcatgccataagtggaaatccagataatcgcgtcattcatgaacagaccgactacagcgcccgccacgaagataagaatctccatccagcgcgccatgtcatcacgatgcttgaatacgaatttcatgctcgccagatagttgaaaatcagcgagatgatgaaagagacggtggcagccagcacgttgtgcatgtggaatatgccaaccaataggttgagaataccccagtcgataacaaaggcgatgacgcccacaatgccgaacttcatcagttgttcaatcagttttctcacaagggtattcaacactattgggctgactgcggaacatatattggctggaaaggccaataatctccccaaattggccttgccccggtccgttctgcaagcagcttcctacatccgcatgccatgttcaacagcaaccgctgaggctagactggaagcgaaccgaatcaaggaggaattatgcccgttattcacactcatgtgtccgtgcccaccacccctgagcagcgcgaggcgttgaaggctgcctatggcaaggcgattaccgccgtgccgggcaagtccgagggctggctgatgtgcccgttcgaagacaatatgccgatttacttcggcggtagcgatgaccagcccgccgcctatgtggaggtcaacgtgttcggccgctccgtgccgggctctgcttgggaaaagctgaccgagagcattatggccgcgctgaactccacgctcggcattcccgaggaccgcacctacatccgttacaccgccaccaccgactggggctggaatggtagcaacttctagtttgcgtatgctggctcccctcagtcagcttcgctggcagctcccctcaaagagggaagctcagatgtagaaagcccgccggtggcgggctttctacgtttcaaggggctgatttccaacattcagaagctctactagcgtttcaaggggcttttaaaacaagaaaaccggagtataaacattgcaatttcaatggtcatactccgggtttcgcaatcgaagagcccctcgaaacgcagatagacctccggaaaaccggaaatccgcccctcgaaagcgagttacctcaccttgtgcctgtcatcacacgatcttgggcatgggggtggtgaggctggtggtcaggttgacgtggaccagaccggcaccggcatgcacctcgaccttcttcagggtcacggtgcgctcttcttcgggggcacggtcgttgtcggtcatggtcgccggggacttgaccgccacgaacgccagatcgtccagcgagatgcctgcgctctggcacagttccatggcctcggacacggactcggtgaagcccggcttgtaaatcacgcgctcggccggtacgccgtaggcgttctcggccacccacttggcgttctcggtcagggccatgcccttgtgcgagtgcggttcggccggcatggagccgttctgcaacgcgtcgacgaaaccgtcaagctgcggggccagcgcctcgccgccgtcgcggaacaggttgccgatgatcggcgtgcggaagcccagctcgtcggcggtggccttcagggacggaacctgatcgtcctcgccttcccacaggttgatgagcgggaaggtcggaatgtccaggttctccaggcgctgcacgtggaacgggtagcgccaggccagctcgggatcgtcgcgccaggtggaggcacgggtcaccacgatggcggcggacggccactgcgcgccgtattcgcggcaggcgatgtccagccacttctgggcgccggcgtcggtgccgtagccggcctcgacgatgaccacgtcatgcagggcgcaggccatttccacggagaccaacgtcggaatgccgatggacacgttggcgaacgggccaccgtgcacgtagaccggggagccgtttacggtttcggtcttggccggcttgaccgcgtcggccaaaatgccagtgatacgccacaggtccacgaattcgccgaaggtcacggccttgccgtccttggtgccggcgatcatcttggacacgcgctcggaaatctcgtccatcgagcgggagagcaccacaatctgcatgagctcgcaggtcggcgtgagcacgaccttctccggcacgttgcccttgccgtagtccacggcggtggagcgcagggagcggctcggaacctcggagacacgcggcacgagaatcgtgtcgagcttgccgtcatcgatggccttctcggcgaaggagacgagcaggttctgggccgcctcgatggcgcccatttcgccgcacagaccccagtcgatgagctcggggtgggtcagggaagccttgccgccgccggaggcaccgcccttggaaccggctgcggtgatgcccatgctcggctgacgcagcacggcggtcgcatcaatgccgcgcttgttcagggcgtcgatcagggcgatggtcgtggtggtcttgccttctccgcgcgatgccttgagcggcgtatcggcggtgacgagcaccaccttgccgtgcttgcgcggggcgtcagggttctcggccaggtacttcatgtagccgaatgcgtcgatcttctggaccagaccgtactggctggtgaagtcttcgatggtggtcatataaagcctttctgtgtttgtgtgatggggcggggtggtggggcggcagtcgccgcctcttcgcctaaaaacagcccactgggctgttttcttaacggctcagcccctcagggaggggagctcaatacggactaaaagtcggacatgtggaagccgttcttcatttccatgctgcgagtgtacagcacggagtcaagcagcttttcggtttcctccttgagctggtcggccatggtctggttggcggcggcgagaatctcgcgcacctcggggttacgcagcgcggcgatggtctcgtccggggtcatcggctgcacatcgccatccacgttgtcggcctcaaattcctcttcagcggcggactgcgcggcttcctcggcggccgtcaagcccagacgggcgatctgctcgtcggtggcggcgaccaagcggtggcccatcgcaccggtcttctcctggtagcgctcaacggcgttggacgtggagcggaaggcgccatcgcacagggcggcgatgatgcggttggcccagtagaagttctcggacgtcacgcgggtggtggtgtcctcaaggtaggcgggcgtggtgtccacgttcgggaagaacggtaccagcgtgttgaacgggttggagccgtatgccatccactggatggcgcgggaggcctgcgggcggtacgggcggatctgcatcaccgcgagctggctctggcggttgatgccgatcgtgcggtacatgtggcgggtgcgctcatcgcccagctggccgtacggatcgaacggggtgccctggtagtgggagctcagcacgtacttgatatcctcgatggtcaccttgcgctcaggctgacgggcccacgggatgtcgtcggaggtgggcttgtggtcggcgtccgggccgtcccacacctcgtcgtacgggttgaggaagcgctgcatgtaccaggcgcgcggggtgttgtacacgtggtcggagtcggagtgggagccgaaggcatcgcgcgggttgaacggggtagtgttctccaccgcgaggtccaaatggttggtttcgatgaattcggcaaggtcttcggaacacatgtgcgcttcctggtcacccagggcgtcctcaaggtcgaattcgtcgataccgagctggttcggcatggtcacgtaggcctcgtccggcacgcgcttggcaatccagtgatggccgcccacagtttccagccaccagatttcgttggagtcggagaaggcgacgccgttcatctcgtaggtgccgaattcctcaagcagcgcgccgaggcgctggacgccctcgcgtgcggtcttgacatacggcagcacgatggtcaggaagtcctcttcgccgatgccgccgggcacctcgggctcatcgcccttggccggcgtgtattccacgaacgggtcggcgccgagcacgcgctcgttggtggtcagggtttcggtggcgctcatcgccacgttcgcctcgttgacgccggcctcgccccaaataccttccttgaggtccgcgttcggcacggcggtgtactgcagcgggtcgtccggcagggtgatggttaggtgggagatcaccgacttgtattcgcgcggctgttcctccggcttcacgacgatgaagcgcttcgggttgaactcgccgttcgcggaatcctcgttgcgggcgatgatggtcgagccgtcatagctcgcgtctttgcctaccagaatcgtggtgcaggccatagtgtgatggtgtcctttctttgttgtagtcacgctcccactggcgggagctggacgacgaagtcggactgaaggtggttttgtactgacccacccccagtcagtgatgctgacagcccccgcctgcgggggctcatgtggctcacgccttgccggtcaggaagatgccgtcggtgtcgggcacttcaccgctgttgcgcagcgcgtgcaacagctcgttgagccagaagccctgattcaagccgggcaacggcttcttggtggcccacacctgcaggtagtactcatgatccttgtccggcggctgcggaccgttgtaccgcatgatcaccgccgggtcagtgctgcggcccaagaacttggaggccgaggagttgcgcccctgcacggtctcgggaatcatggccggcagctgacgggagaagtccggcgggatggccaacgcatgcgaatcattgaagtcgtacatcagcgcatcaatcggcagattggccacggaccagtgaatccactcgaagccgcagaccggaatcgaatccgggtccacgaactcccagtgcaggtagcgggcctcgggatccacatcatcgatgtagaacgggaaggagacgaccggcacgccgccgttgaaatattcaggggccgcagccttggcgaaatcgtccgggatgacggtgaaatcggcggaaatcttcatacgtcccagtatcgctcatatgtgtgacgtactgggagctgtgcgttacggggtctctcccccagtctcgctgcgctcgacagcccccactcatcagaggggggctagttgcgtcgggttatgagatcagggcgcagaagagggactcgaataccagtagcgggttgccgttgccggctaggcgcttgcgggcgtgggccacttcgtccagacgggtcacggcaccggcccggttcaatcgcaccgacaattcggtgatcgacgagcggttctccaggttgatgaggcccaccgaatcctccgcattgttctgcagcaccgccacatctcggtagatggaagcgatggagttcagcgcacgatccaatacgtcgcgcgtacggcgggtgaccaaacgcttcacatcgtctttcttggcaatctggttgaatgcgccacgcagtttcggcgggatgcggtcgctcggtgccagtccgttgatgcggcggaattccgcttcctggccggcggtgatgcggttcgcgtccgcctcggcctgggccttggcattgtcgataagattgccggccaacaacactgcatccgaggcacgggccagattcagcacaccgaccacaagttcatcgcggtcggacataacccgttcgtcggtggcgtacaacttggcgatgccgatatggccttcggcgagtcgggccgcacgctgcgccacttttggctcgacattggtggtggaggtcaggaatccggccaccgcctgggtggagggcacggcgaggttcacgatgcgtgtgcgcgagcggatggtgggcagcacgtcctgggcgctgggcgcgcacagtagccagatgcaatgctcggccggctcctcaatctctttcaagagcacgttggtggtgcgctcaagcatgcgatccacgtcttcgatgatgatgatgcgccacggcgcggtggcgggcatctgctcggaggtagtgatgatctcacgcacctgatcgataccaatagtcaccttgttcgtggtcagcaccgtgacatccggatgcgtgccggcaagcacctgctgggtgacgcgcgtgggctcagcgctcatgccgtgatccgggctttccagcgccgccgcgaatgctcgggccatgttggaacggcccgatccgggaggtccacagatcagccacgactgggtgatctggctcgggtcgccctgcgcgatacgactgagcatgtcgattaccggcttttggccgactagtgaatcccatacgctcatgcgagctccttgatgtcggattcgatggcagcccataccgcttcaatgctctggctcgcatcgataacgcggaaacgattcggctcggcggcggccaagtccaagaaggcctggcgggtgcgggactggaagtcatcaccggccgattccatacggtcttccgcgtgttcgaggcgatggtgggacagggctgggtccatatccagcaaatacgtgcggtcgggcagcaggttgttggtggcccacatgcttaaggatcgaatctcttctggcgtgagttcgcggccaccggcctgataggccaaggaagagtctaaatagcggtcggtgatcaccacttcaccgtgctccaatgccgggcggatggtttcggcaacgtgctgggctcggtctgcagcgaatagcagcgcctcggcgcgcggtgcgatgtcgactgcgcccccatccacaccgtgcaacagcagttggcgaatggccttgcctaacgcagtgcctcccggctcacgggtaacgaccacggtacgcccctgagcctcaagatacgcatgcagccgctcgacttgcgtggtcttgcccacgccatcgacaccttcaaacgaaacaaacagaccgctcatgctattgaccttagcgttaggcgcagagttgcgcccaacaggcagttaaaccagctctacctccgtttcaaggggctgatttggtcttttctgaaggtctacttccgtttcgaggggctgttgcccaagtagacaacgttccaaaacggcggaatgacgttggcgcggagccgttcatactcgtggttcagcagatgaccagccccttgaagcggaagtagatattctcaaaacgagaaatcagccccttgaaacgcaagtagagcaataattccgctcagccacgcttgggaattacggcggggcgctcgtagtcctcgttggcggtcagccagtcgacgtcctttttcacagtggcgggggtggaaccgagtttttcggcgatgcgctggttggaccagcccttgttcgccaacttcttgacttcggcacggcgttcggcgcgcttggcctcctgcgccgaaaccgcagccgaggtaccgcccttcttgcccttgccggcaacggccttggcgccaccagcacgcccagcaccgcgacggccacgggtggagggaccagccgcacgcttttcggcgagcagtcggaaggcgtcatcaggggtgatggattcaggcgtgtactgacgcggcaccgtacggttggtctcgccatcggtgatgtacgcgccgaaacggccgtccttgatggtcacgttcttgccggtgttcgggtccttgcccaaatcacgcagcggcggcttggcggcaccacggccacgcccgcggccgtacttgggctgcgagaacagttctttggccttgtcgatatcgaccgtgaagatctcgtcttccgaggccagcgagcgggtctccgacttgccgtcggcacccgtcttggtcaggtaggggccgtagcgaccgttgttggcggccaccgtgcattcggatacctcgccggtttcggcgttggtttcctcgtatgtgcccacttcgcgcggcaggctcagcagctttagcgcgtcttccagcgacagcgattcagggctcatcgtcttgaacaacgaggccatcttcgggcgcgacgcggcggcggccgcggccttcttcgaacccttcttggccgcagaagcaccagcagtatcgccagcagcgccagccgaagcctcagccggcggcaccaacgccacatacgggccgaaacgcccattgcgcacctcgacggtaccgccggataccggatcaacgcccagctcgcgcggtccaccggagtggttgtcgatcaaatcgcgggccacggccaccgtcagctcatccggcgcgatggtgtccggcagagacgcgcgcttcgggttgccttcggcgtccagatgctccatgtcttccagatacgggccgtaacggccgacgcgcacgtgcaggccgtcgccgatgtcgatggtgttgatggcgcgcgcgtcgatctcgccgagctgcgcgacctgctgttgcaggccttcgtgcgcctcgtcggcgttgcgggcggcgccctcgccggaaccgaagtagaagtgggtgagccagtcgcggccggattcctcgccgtgggcgatgcggtcaaggccgttttccatctcggcggtgaactggtagtcgaccagcttggggaagttcgtctcgagcaacttggtcacggagaaggcgagccagctggggatcagcgcacggccacgctcgtatacgtaaccgcgatccatgattgtggaaataatgctcgcgtaagtggacgggcgaccgatctccttggcttccagcgtcttgaccagcgtggcctcggtgtagcgggccggcggctgggtttcatggccgtccggttcgatgtcgcttgcctcgacctgctggccgacgctcatcggcggcagggaggtgttggattcggaggcgtcacccctgacggccttggcgtccgtcttgccggcggcagcagcctggtccgagccagccccagcgccgggagcggcggccttgggcttgcgcccctcccccgtggccttcataaagccggggaattcgatgacggtgccggacgcctggaacacggcctcgccctcggtggggccggccggcgcagacaggcgcacggtggcggtggaaccggtggcgtcagccatctggcaggcaagcgtgcgctgccagatcagcgtgtataggcgcagctggtcgccgggaagtttggaagccagctcgtccgggtcgtggaagcgcgagcccgccgggcgaatacactcgtgggcttcctgcgcgccagcggttttggtggcgtactgcttgggctcggcggagaggaacttgtcgccgaaatggtaggagacggcgttgcgggcggcggtgatgccctcctgcgacagcgtcaccgaatcggttcgcatataggtgatgtagccgttctcgtacaggctttgggccgcgcgcatcacggcgcgagcacccatgccgaggcgattgccggcggtctgctgcagggtcgaggtggtgaacggcggctgcgggcggcggcggtacggcttggtttccatcgacatcacagtgaaatcggcggtcttcagcgccgaagccacggcggtggcaccagcctcatcaagctggcgaacgttcgccgcgaacccgtccggggtcagctggccgtcggcaccgaaatccttggagccggcgagtcgcttgccgccgagcgcgatcatgcgggcggagaattcggcacgctcccccagcgcgtcaggcgcggacagcgtggcgacgatatcccagtacggcgcgcgcttgaacgccatgcgttcgcgctcgcgttccacgatcaggcgggtggccacggactgcacgcggccggcggacaggcccgggcccaccttgcgccacagcaccggcgacagctcatagccgtacagacggtcgaggatgcggcgggtctcctgtgcgtcgaccatattgccatccacatcgcgcgtgttgttcagggaggcgttgatggcgttcttggtgatctcgtggaacaccatgcgcttgaccggcacctcgggtttcaaggtctgcaccaagtgccacgcgatggcctcgccctcgcgatcctcatcagtcgccagatagagttcatcggcgttcttcagggccgatttgagttcgctgaccgtacgcttcttgtcgccgtcgacaatgtaatacggcttgaacccgtcgttgacgtccacgccgaacttgccgaacttggccttgtctgccgcgggcacctggctgggctgcgcgaggtctcggatatggccgaccgacgccatgacggtgtaccccttgcccaggtagtcaccgatcttgtgggccttggtcggagactccacaatcaccagtttggtagccatacccactccttatgtattgcgcgaaacacacgacgtttctggcgtcataatactcatgaatcatgtccaactgccaaattccgccgttgtgccgggcaaattcggccgttcgcaccccatgttttaccgtttgggcggtgccggcggagcgccgatcagacccagccggcttaagggcgctgcagtgatctgacgcagggccagcaacagtccgaatgcgagcatggccacacccgcaatgcccacaacagcgctgacattcgccccctgaaccgcccagctggcgctgacattgagccccggcaccacctgccagatcacataaccgctgtaggcgagcaacagcaggcccccggtaatcagcacgctgccgacgatttgcacgctcactgaggagacgcggcgacccggctcgtccatgccggacttgcgcgtaactgccagagcgagcagggccaatcccgccaccagcaggatggacatcgccacatccgaagggcgatgccattgtccgtatatcacggagacaccgacggtcaccgcccaaaccacgccgatgacgcccgccaaagctcgaaccgcacgaggcacggtaagcagcagaatcaccgcacaggctgcggccagcatcgtgtgaccggaaggcgcggaattagcggcaggcgattcagtgttgatgatgaacggacgcggcaacagacccttgatacgggtgacggccaagcagaccacggcgaacacggcgatttgcccggccaaccaccagcggcgtcgaatcagcgccgtaataatgccgattgcgtgtttgtgttcaattagttgttgcgggtttagtcacgatgatttttcgggtttagaactgttagaattacaggaccaacaagggtgttgcacttctaaatagacatcggggacaaggtattaggcgcggtatcaggtgagacttctgaagatgccatcgtattgcacttcgacatccgttatgcggtaggccaggcacacgaacaaatcatcgagcgtattcaagcacaagccgaagcggcgggcggccgcattgtcgacatccttaacgatgacccatactacgtgcaggctgacgacccgcgtgtccagttgctcaccgcaacctacaacgacgtgctcggttgcgaggctcgacccgtggctgtcggcgacggcacccacgcccgctttatcccgcgcgcactcaacttcggtcccgaattccatgccgaccatgtgccggcggtcgacggcatcgacctggagaccccgccattcatcgcaccaggtgccggcaacgcgcacggtgccgatgaatgggcctcgctgaaaaacctgaaaacagcgtttgtcctatatgcgttaggcctagtgcgtctcgaccaatacctgcaatagctggcggataagacgtttgacgtgattatgaccttgcgtatgctttttgacgagcctactattcgtattgttcaagtacgccatgtcggggccgacgcgtctggtgaacacgccgggtcatacacggatgatagagtgaaattccatggttagaagaacacatggtaattctcaagaacacgtcaccaagcatattttcgtcactggcggcgttgtctcctctctcggcaagggcctgaccgcatcttcgctcggtcgtttgctgcgcagccgcggtatccatgttctgcagcaaaagctcgatccgtacatcaacgtcgacccgggcaccatgaacccgttccagcatggtgaggtctacgtgaccgaagacggtgccgaaaccgatctcgacatcggccactacgagcgtttcctcgacgtcttcctgagccagaaggccaacgtcaccaccggtcagatctatcaggaagtgctgcgcaaggagcgcgccggcgaatacctcggccagtgcgtgcaggttatcccgcacatcaccaacgaaatcaagtctcgtatgcgcgcccaggcttccgatgacgtggatgtgatcatcaccgaaatcggtggtaccgtcggcgacatcgagtcccagcccttccttgaggccgcccgcgaagtgcgccgcgatctcggcccggacaactgcatgttcgtgcacgtttccctggtgccgtacatttccgccgcccacgagctcaagaccaagcccacccagcactccgtgatgatgctgcgccagctcggcatttccccggacgcccttgtgctgcgctccgaccgcccgctcaatcagtccatcaaggacaagatctccctgatgtgcgatgtcgatgccgaaggcgtggtcaactgcgtggatgcgccgagcatctacgatgtgccgaagatcctgttcgaggagggcctcgacgcctatgtggtgcgtgagctcggcctgccgttccatgacgtcgattgggacgaatgggccgacctgctggagcgtgtgcaccaccccaagcacgaggtcaacatcgccatcgtcggcaagtacatcgatctgccggacgcctacctgtctgtcaccgaggccatcaaggccggcggctttgccaactgggccaaggtcaacgtcaagtgggttgcggccgatcgttgcgaaaccaccgaaggtgcggccgccgctctcgacaacgtcgacggcatcgtgatccccggcggcttcggcatccgcggcatcgacggcaagatcggcgctctgaagttcgcccgtgaaaccaagctgcctgccctcggcctgtgcctgggcctgcagtccatggtcatcgaatactcccgccacgtgctgggcattgaagacgcgaactcttccgagttcgagcccgattgcgccaacccggtgatcgccaccatggaagagcagaaggacatcgtggccggcaagggcgacatgggccacaccatgcgtcttggctcctacccggctgagctggaggaaggctcgctggtcgccgaactgtacggcaccacgcatgtcaccgagcgccaccgccaccgttacgaagtcaacgtggcctacaaggatcgtctgcgcgaaggcggcctgcgcatctccggccagagcccggacggcgagctcaccgagttcgtggaactgccgcaggacgtgcacccgttctatgtggccacccaggctcacccggagttcaagtctcgcccgaccaagccgcacccgctgttcgccggcctggtcaaggccgcgctcgaccatcaggcggcacgctgactcacttttgtgccgtgcataatatcgcggcatgatgtgctggctgccgtcatcggcgtagcgcaagacatacggtaaagacgtggtggcgaaacatctaatgatgtttcgccaccacgtctttttttgttgtatgagcatcatgcagcatgatgtattggaaggcgacggtaaaaaattaccgtttctatggtgtgttggtagtatgcagataacgcttagtaggccatcgcagaaagaccgaccatgaccgaacaccttgatgactcgacccagcagtttgcgcctctgtttggtgcgaataatgccgtcagcggcactgtggcagacagtgtggatgctgctgcatcagattccattcagggcgatgagatgaggaggcgccgcatctggccgtgggtggtgattgcttgtctgctggttgccttgggggctgcctgtggcggcggtgtttggttcttccaagatcacgtgctgcctggcacaacgctatggggaaattcagttaccggcaaaaccgagcaggagattgtcgacctaatcaacgaccaggtcgacaacaccgcggtacgagcgaaataccaggggcagtcggcgacgttcacgctgaaagatctcggcatcgaagttgatggtgaagcaatcgcatccgatgtcatcaatgcccaacgcggtgacgcatggtggcaacagtatgcgttctggattacgcatgatgtggccccgcaaatcaatcccgagctcgctgatggcagtgtggtagataaggcgctgaacattgatgcacaagaacctgttgacgcgcaagtcgcattgaacgataacaacagtggcttcaacgttattgcgggagaaaatggccagggagccaacgccaccagcattgcgaagcaagccatttccacagtggagtcattgggcagtgtccagccacagaccgttcgggtggaactcgacgtaaccgaaccgacgattaccaatgcaattgccgatgaggcgaaaaccacgctggaaaccctagtgaacaatgccgtggccatcaaggtggcggataaagacatcgccaccgtgaatgcgtccatgctgggttcggccatgcgcatcgacgccaaccagcagtcaaagctgaaagacaatgaagtacgtaatggctacgtggtctttgatgccgataagctgcagcaatactatgacgagcaaatcaagccgaatctcaaattggaacgtgaagacaagaaggtcgtcgtcaataatgctggcgaggtgctgagcactgaaatagaaggccatgatggcattgtgattgccgatggcgcggatacggaggttggtgctcgcttggctcaggtgctggccacgggaactggctcagtgaatgtggacggcaaggtagatcccaaacaggaagtcaaggtcgctcatcgcgtggcgattgacctgtccgaccgtaagctctatgcctatgagaatgacacggtggtcaagacattgaatgtcgtggtcgcggagggcaacgacaacgtcaccggcgaatgcgttggcatgatgtgtacgccgacaggtgacttcaacgtatggcaaaagttgcccagtcaagatatgagcggcacgctgaatcttgccgatggcacggtggaaacatgggatgtcaaagacgtgggcttcgtcaattacttctcctccggttgcgcaatccaccgtattgccggcggatatgtagcggatgccgtaatgccctccattgccaacggatctcatggttgcgtgggtatcggatgggatgtggccgaatggttctacaactggtgcaatatgggcacgagcgtgcatatccaagtgtgatatgcaacagtgtgatatgtaacaaatacggcatgcagtggtgcgacacataatgccgcatacgcgatgttcggtgtgcatgggacaagcttgcccggctccaatatcgctgtatcgcattcgtgtaatcaagcccacagccaatatgcgtcagggcggctagtgtttgcacttgggttctgctaggttttcataggattaagtgtgatacaaggaaggcaggatggtgaccgaaaacacagcaccaaacgccgccgctgacgtggagatgagccagtatgtggctgatcgtacccgcgtcaacgaggacaagatcaagaaggatgacgagatcatcagccagttcggcgactacaactatggttggcatgattctgatgccgccggcgaagccgcaaaacgaggcattgatgagaacgtcgtacgcgcgatcagcgccgacaaaggcgagccgcagtggatgctcgacatgcgtctgcgtggattcaaggcgttcctcgaaaagcccatgcccgattggggtgtggatctctccggcttcaacgcagacgacttcaagtactacgtcaagccaatcgacaagcaggcgaaaagctgggacgaactgcctgacgacatccgcaacacctacgatcgtctcggcatcccggaggcggagaagaaccgcctcgtctccggcgtggccgcccagtacgagtcggaggtcatctacaactccatccaggaggacctgaagaagcagggcgtcatcttcgtcgacacggacaccgctgtgcgcgaataccctgaactcgtcaagaagtacttcggcaccgtcgtgcctccggaagacaacaagttcggtgccctcaacaccgcggcatggtccggcggctcgttcgtatacgtgccgaagggcgtgcatgtggacatcccgttgcaggcgtacttccgcatcaacaccccggccatgggtcagttcgagcgcacgctcatcatcgcggacgaaggctcctacgtgcactacgtggaaggctgcaccgccccgatctggtccgaggactcgctgcacgccgccatcgtcgagatcatcgtcgaaaagcacgcccgcgtgcgttacaccaccgtgcagaactggtcgaacaacgtctacaacctcgtcacccagcgtgcctacgtgcgcgagggcggcacgatggaatgggtcgacggcaacatcggttccaaggccaccatgaagtacccggcctgcatcctcgccgaaccgtacgccaaggcatccaccatgtccctcggcttcgccggcaagggccagtaccaggacacgggcgcgaagatgattcacctcgccccgcacaccagctccaccatcgtcgccaagtccatttcccgtggtggtggccgctccgcctaccgcggtctggtcaaaatcgtcaagggcgcgtacggttcgtccaactcgaccgtgtgcgatgccctgctggtcgacgacttctcccgctccgatacctacccgcatgtcgacgttcgcgaagacgacgtttcgatggcccacgaagccaccgtttccaagatttccgaagaccagctcttctacctgatgagccgaggtctcacggaggaagaggcgcgaggcatgatcgtgcgcggcttcgtcgaaccgatcagccgtgagctgccgatggaatacgcgctcgaactcaacagacttgtggaacttcagatggaaggatcggtgggctgattccgatgaccgacaacacaacacccgtcaaggaaatcaagattccggtcgccgaccccaacgacccgtacgcgattccggccgccatgccgtcctccgtggaccatgccgtgcgctcgttcaacgcaggcgactacccggagcccagccgcaagcaggacgaatggcgctacacgcctatcgagcgcatcaacgagttcttcaccgtgttcaagcctttcggcgaaacgcagatcgaagtctccatgattgacggctcgccgttggccgaaggcgtgaagctcagccagatcaagctcggtgagggcctgtccggcactgtgtccaagcccaacgaccgcgtctccgcagtcgaatgggaatccggccgcaccgcaaccattctggaactgtccggtgagatcgcccagcccgtgctcgtcaaggtgcacggcgcgggggaggatctcgacgctttccatctggtgatcgccgccgccgacaaggctcatgcggacgtcgtcgtggaacacgacggtgacgcacgactggccgaaggcgtggaaatcaccaccggcaaggactcgcacgtctccaccacgttcgttcaggaatgggccaaaaccgccaagcatgtggccaaccaccgcatccacgtcggcgaaggcgcatccctgcgccactccgtcgtgaccttgggcggcgacatcgtccgcatccgcatggatcaggacttcggcggcgaacagggcgacctcaacatgctcggcatctacttcgtggaccccggcgagcacatcgaacaccgcacgatggtggtacacaaccaccccgactgcaagtcccgcgtggtctacaagggcgcgcttgacggcaagggcgcgcactccacttgggtgggcaacgcgctcatccagcccaccgcccccggcaccgactcctacgagctcaaccgcaacctggtcctgaccccgggcgccatcgccgattccgagccgaacctcgaaatcgaaaacggcaacatcatcggtgccggtcacgcctcttcggtgggccgcttcgacgacgaggaactgttctacctcgaatcccgcggcatccccgaaaccgacgcccgcaagctcgtggtgcgcggcttcttcggcgaactcgtcgaggagatcggcattcccgccatctccgaacatctgatgaccgtgattgaccgccgactggcccgtggtgaaaacgacgccatggcacaggtcctcgaagacaagtaagaacagcatttttaggagcacaacaatgtcaacactcgaaatcaaggacctgcacgtccacgtcgaaaccaaggaaggcatcaagccgatcctgaagggtgccaccctgaccgtccactccggcgaaacccacgccatcatgggccccaacggttccggcaagtccactctcgcctacacgttggccggccaccccaagtacgtggtcgactccggcgaggccctcctcgacggcaaggacatcctcaagatgactccggacgagcgcgccaaggccggcctgttcctggccatgcagtacccggtcgaaataccgggcgtgtccatgaccaacttcttgcgcaccgccaagaccgaaatcgacggcgaggctcccggtattcgccagtgggccaaggacctgtccgcagccatgaagcgcctcaagatggacccgaagttcgcctcccgttccgtgaacgaaggcttctccggcggtgaaaagaagcgcgccgaagtgctgcagctcgaactgctgaaaccgaagtttgccgtccttgacgaaaccgactccggcttggacgtggacgccctgcgcatcgtgtccgaaggcgtgaaccgcgccaaggaagccaaccagttcggcatcctcatggtcacgcactacacccgtatcttgaagtacatcaagccggacatcgtgcacgtgttcgccgacggccacttcgtcaagaccggcggccctgagctggccgacgaactcgaagagaacggctacgaccagtacctgcccgaaggcgccgactccgagtccgcactggcctgagtccgtgaccgtgggagtctgacatgccctattctcgacacgctccgggccgcttaggccaggtctttacggtcgcgaacaggccatgtcagactcccactcgtttcgtacaattgttacgtaagtagggggaacataatggttgattttaaggcgattcgggcgcagttcccgattctggatcaggagattcacgggcacccgctcgtgtacctggattctgcggccacctcgcagaagccgaatgcggtgatcgacgccgaggcgaacttctaccgtacaattaacgccggcgtgcaccgtggtgcgcacgagctggccgcccgtagcaccatggcctttgaggaggcccgagccaaggtggccaagctggtcggcgcgaatgcggccgaaggtgaagaggaggtcgtcgtcaccggtggtgccacggccggactgaacctgctcgccaccgcattcggcaatgcatcgctggggcgtgggggagaagccgccaagcgttttgccctgaagccgggcgatgagatcgtcgtctcgcgtgcggaacatcattcggtgctgctgccgttccaggagctgtcctaccgtaccggcgccaccttcaagtggatcgacctgaccgaggacggccgtgtgcgtacggacaacctcgacgaagtcatcaccgagcgtaccaaggtcgtggccgtcacccacgtgggcaacgccacgggtgccatcaccaacatcgccccgatcatcaagcgtgcgcatgaagtaggttcgatcttcatcttggacgcttgccagtccgtaccgcacctcaaggtcgatttccacgcgcttgatgtggacttcgccgcctggagcgcgcacaagatgtacggtcctaccggcgtcggtttcctgtacggtaagcgcgacctgctcgaagccctgccgccggccaacttcggcggctccatggtcgagctcgcctacatggaccacgaggcccaatacatggcccctccggcccgcttcgaggccggcacccagccggtcgcccaagtggtggccgcaggcgtcgccgccgaatggatgatgaacatcgggctcgagaacatcgaagcccatgagaagaccatcgccgccgaactgctcaagctcggcgacgtcgatggcattcgcatcctcgggccgcgcgaaaacgtggaccgcatcggcaccgtggcgttcgacgtggccggcgtgcatccgcacgatgtgggccagttcatcgacgcccagggcatcgcgattcgcgtgggacaccactgcgcccagccggtacaccgccacttcggcctatacgcatccaaccgtgcctcctccggtgtctacaattcggtcgaagatgcccaagcgttggtcgaagcggccaagggcatccgtaagttctttggagtggagtaaaacagaacaccatgaacgaattcggtatgagcggggatgacctcgaacagatgtaccaagaggtcatcctcgaggcgtcgaaacatccgcatggcaaggaatcctttgcgcccaacgcagcggtcgaacagtccgcggacgcagcggccaatgtcaccgtacaagccagccacgaatactgcacgcccggtgaatcgcaccagttcaacccgacctgcggcgacgaggcgaccatccatgtcgaagtctccgatgacgaaccgcacaccatcaagcgattggtgtgggacggccacggctgctccatttcgcaggccagcctgtcggtgatggtcgatctggtggacggcaaaaccgttgacgaggccatggatctggaacagacattccacaagctgatggaatcgcgcggtgccggtctggacgacgagaacctggaagaaaagctcggcgacgccgtggtattccaaggcgtgtcgaaataccctatgcgcatcaaatgcgctctgctaggctgggaagggctgaaggactccatcgccaaagccctcgctgcaaagaactgaggaaatatgtccaacgataatttggttcccgaaccacagccgtccgttttcgatgctgtcaacggcgtcctgcaggacgaggaggccgctcgccgcgtgatggccaacccggccttggccaagggcttcccgaacggacgcccgatcgagcactctgctgcgtccggcgatgacacctgtgcgtgtggcggtcaccacggcaaatgcggttgccaggatgacgaacagtccgatggcagcgagattccgatcaaggcgattgacgatatcggccgcgccactgccgaagacgtgcgcgaggcactgcatcaggtgattgatccggagcttggcatcgacgtgatcgatttgggtctggtctacggcattgagatcgatgagctaggccgcgccattattacgatgacgctgaccacgccggcctgcccgctgaccgaccttatcgaggacgaatgcgcatccacgctggccggtctggtcgaggagttccgcatcgactggacgtgggatccgcgctggaccatggagcgcatcacgcccgaaggccgcgaccagctcgccgccctaggcttcagcttcgacaatatgccaaagtactgatagcgcttagtaagttccctcatcagagggagctctatacgagaaaagccccgcatgatgcggggcttttccatgtctggactggtcaatcagtcatcgacgatggtgttcttcgggacaaccgtgatgccatccggcgtgacggtgaagccacgggccagatcgtgctcggtatcgatgccgacagtggagttctcggtgagcaccacgttcttgtcaagaatcgccttgtacacgcgggcgcggcggttgatgactacaccgtcgaacagcacggaatcgacaatctgtgcccacgagtggatacgcacattgggggagagcacggagtggtgcacttcaccgccggagacgatcacaccgggggagacgatcgaatcggtggcgtggcccagacggtcgcggccggcgtgcacgaacttggccggcggcaggttgccggacatcgtgtaaatcggccaatcctggttgtacaggttgaactcgggcacataggcgatcagatccatgtgcgcatcgtagaactgcttaatcgtaccgacgtcgcgccagtaagcgtgatcagtggccgtggagcccggaatctcgttcgagttgaagtcgtagacgccggcttcgttgcgggaagcgaagtacggggcgatgtcgccgcccatgtcgtgcttggtgtcggcagccttctcatcgagagccagagcctcgaacagggccttggtgttggcgacgtagttacccatggaggccagaatctggttcggattgtccggcagaccggtggtggtgggcggcttctcctggaagttcttgatcatgttcgggtgatcgggatcgacctcaatcacaccgaactggttcgattcctcgatgggctggcggataccggccacggtgaactcggcgccggactcgatgtgctgctgtaccatctgttcgaagtccatgcggtagacgtgatcggcacccacgatcaccacgatgtccggctggacatcctcgatgatgttgatggtctggtagatggcgtcggcggagccgagataccagtgcttgccgagacgctgctgcgcgggcacaggggagacgtacgagccaagcagcggggagaaacgccagacctgggagatgtggcggtcaagcgagtgagacttgtactgggtgagcaccacgacctgacggtacccggagttcaccaggttgctcaacgggaaatcgatcagacgatacacaccaccgaagggaacggcgggcttcgcgcgatcacgggttaacggcatcaggcgggtcccctcaccacctgcaagcacaatcgacagaatcttgggattcttggtcatcgtaactgtcctctctgttactgagcgtctttcgacaccgcactgccgggccggatgcttccttgcattcggtttacatagttaataattgcagaaaaaaacgaacatgcaaggctttcgcccccgcgtgccgtgaacttgcgatgaacagtttcgtagatttgttaaggatccggccttttcggagcgcgtgcgattccttagcgtgtcgcgtagaacgccactgcgctggatgccgccacgttcaggctatccacgccgtggctcatcggaatcttcacggtcaaatcggcgcgggcaatcgtatggtgggacaggccgtcgccctcggtaccgaagatcagcgcgagcttgtcgatatgcgtcggatcttcggcaggcgcgtgcagacggcgtgtcagttcgtccaacgaaatcgaacgatcctccaatgccatggccacggtggtgaagcccagcgacttcaactcgtcgatgccctggaacggccagtaatgcttgttttcggtgccgtcgtcgttgaacccggtgatacgggtccacggaatctggaatacggtgcccatcgacacgcgggcggcgcgtcggtacagcggatcaccgcaggagggtgtgaccagcacggcatccacatcgagcgcggccgccgaacgcatcagtgcgcccacattggtgtggtccacgatgttttccattactgccacgcggcgggcgctcttgcagacctcggctacggagggcaacggccagcgtcgcatcgcgcatagggcgccgcgatgcaaacggtagccggtcagacgcttgagctgctcaggtgaggccacgtagacgggaatatccgcgccccagcgcccgtcgatgaagtcgaaggtgtctttcatgccctccagccaaggttcctcgaccagcagtgacagcggttcgcggtcagcggccagcgcgcggtcgataaccttgggggactcggcgatgaacacgcccttggctggttccaagcgattacgcaactgcatttcggtgaggctcacatacgcttcgacgcgcgggtcgtcgacggtgtccagcgtgatgaactgcattggtggcctttcgtgtgtgcagataacgaaaaaccccttgcaatgcaaggggtttatctgtgcccgagacgggacttgaacccgtacgcccgtataaaataggcactagcacctcaagctagcgcgtctaccattccgccacccgggcaggtgtcgtttggacaacgagtagatagcttagcatgaaattaccgggatgcaattcgcgcgtgtgcccggcgtgtcgcgtgtagccttgaagtcatgactgatgccctttttcttttcgacccgcaggtcgacgacgtcccggtgaacagcgacgaactccacgccggctggaagctaaccctgcccgctcacatcaagcgccatgccgtgcaggccatgcgattcaaggcaggggacagcctgcaactttccgacggcagcggcttgagaatccaggcagtgatggccgatcctgaagccggactggctgaagtcgtggaagtggggcgcgaacccgagccgctcacccggttggcgctgattcaggcattggcgaaaaccggccatgatgagcaggccatcgatatggctactcagatcggcgtcgaccaagtggtgccatggcaggcggaccgatccattgccaagtggaaggtcggccgtacagacaagaagtggaattcggtactggatgccgccaccgagcagtcgcggcgcgcctttaagccgcaactggaggcgtgtgcgtccagcaaggaggtcgtggccatctgccgcagggcctgcgtgcatggcgatgtggtgattgtgctgcatcaggatgctaccgatacgtggtccggcgtggaggagaaggttgcgcagttggtggaacgcacgctccaggacggcctgccgcggactgtcagtgtggtggtcgggcctgagggcggcatcagtgagcaggaggtagctgatttcgtcaaggccggagcggtgagctgcgtactggggcgcaatattctgagagccgcgacggccggtcctgtagcgttgtcgctgttgtctcgggtgttgggacgttacgagtaacgcccacgcgctaagctggtgcgtagcaacatcaaaccaaggagcatgatgagcgaatccgacgattgcctgttctgcaagatcatcgcagggcagattcccagcagcaaggtctacgaggacgagacgacctacgcattcaacgacatcaatcccaaggccaaggtccacgtgctcgtggtgcccaagaagcactacgccaacgtcgccgaacttgccgccggtgacccgaccgagctggcccacatcgtctccattgcgcagaacatcgccgacaaggaatttcacggcgcctaccgactggtgttcaacaccggtctcgacgccggccagaccgtcttccacgtgcacgcgcacgtgatgaccggcgaaaagctcgacgagtagtaggggaatatccgcttcgtggcaacgactacacgtaccatcaccatcccgccccaacttgaccccgtcgccgtgctcggcccggttgacgaggtcattcgcgaggtagagcgcgcctttccggacctgacgattatcgtgcgcggcaaccgcgtggcgatcgtctcccgctccaagcagaccgaagcccaggccgcacaggccgaggatttggtcaataccatcatccaagccgcctacaccgcgcctatggacgccgacaccgtgcgtcgcatgctcgaccagaacgtgctcaagaaccacgtgcgcctcgaacatcccggtcacggcccggtgcgtgacaaactggcgcaatcgacctcaaacgaacgcgcccatgcacgttctgccggctcccacgacccgacgtaccgcaagcccacggttcccggcgtcatcacctttgctgccggcgtgccggtccgtgcgaaaaccgccggacaagtggcctacgtgaacgccatcgaatcgcacaccatcaccttcggcattggccccgcaggcaccggcaagacgtatctggccgtggccaaggctgtgcgtgccttccaggacaagcagattcgccgcatcatcctcacgcgcccggccgtggaggccggcgaaagcctcggctttctgcccggcacgctgaatgacaaggttgacccgtatctgcgcccgctgtacgacgcgcttggcgacatgctcggcgccgaccagctcaagcggtacatggacgacggctccatcgaagtggcgccgctcgcctacatgcgcggccgtacgctgaacgacgcgttcgtgatcctcgacgaggctcagaacaccaccgaacagcagatgaagatgttcctgacccgtctgggcttcaacaccacgatggtcatcaccggcgatatctcgcaggtggacctgaccgtgcctcgctcgggactggccaccatcgaacgcatcctgggcggcatcaacgacatcgcattcgtgcatctcaaaaccgaggacgtggtacgtcaccagctggtcggacagatcgtggccgcctacgaccgtcactccgccatcgccggcgaccaccgcgacatcgaacgcaagggccgccgcaaccataccgacttcgatgcccgccagcaagcggattcaaccaaccaaagcgagacagacgatgagcgttgacgtcaccaatgaaacccagtgggtcatcgaccccaaggtcttctccgatttgggtatttgggtactcgaccagatgcgcgtgagcacccagtccgacctgaccatcatgttcgtggatcccgatcccatcgccgaactgcacatgcgttggatgaacctcgaaggcccgaccgacgtgatgagcttcccgatggacgagctgcgccccggcgacggcaaaaccgtgatggaaggagtgctcggcgacatcgtcatctgcccgtgggtcgctgcccaacaggctgccgcagccgggcacagcaccatgcaggagatgctattgctcaccatccacggcatcctgcacctgctcggctacgaccacgtgacccccgagcaggagcgccagatgttcggcctgcagcgacagctgctgctcaccttcttcgccctacgccacgatgccaacgtgcaggccacgctgcccgccggcacacccgacgcgctggccctgtacgacgccgcgcacggtgctggccgcgacctcgattccaaataagctcccaaatcaatcacaccaaatccggattattcgataccgttcaaggacattcaaggacaccgaaaaatcattatggagtattccagtaccacgccgatcgccatcaccgtcattcttgtactcgtggcggccctgttcgtctggctctcgctgaccatggccgccgctgaaggcgccgtggcccgcgtaacgcgagccagccttaacaatctcatcctcgaggtgcagaccgactccgaagcaagccagttcctcaagatgaagaagatcgacaagattcatcgcgtgcaacggctcatcgccgaccgttacgccaccgccggcagctgtgcgttcttccgcatcgcctgcaatgtgctcgacggcgtactggtgtcttccatcgcatccctgtggggtgcggaactgtggattgaactgctctccggattcctgttcgcgattatcgtagccgtggtctccgtactggtccgcccgcgcaccgccggcatggccaagccggtcggcatcatgatttccaactcgcgcatcgtgtcgttggccaccaagctcacgccgttcgcacgcatcggtggcgacaagtccggttccaagggaccgggccgccgctccaaggactccgatctgtccgacgacgaggagcttgagaagattcagctcgagcagggcaaggccgccatcgaccgactggtggagtccaacgacttcgatccggaagtctccgaaatgttgcgcaacgtgctcaccctgtctgatacgttgactcgcgagatcatggtgccgcgcaccgatatgatctgcatggagcgcgactccgcactgtcttccgcgctgaaactgttctcccgctccggcttctcccgcgtgccggtgatcggtgaggatgtggatgacctgatcggcgtggcctatttgaaggatgccgtgcgtgccaccgccttcaacccggcggccatggagcgcgcggtcgaatccatcgtccggcagccgctgcttgttcccgaatccaagccggtggacgacctgttccatgagatgcagcgttcccgccagcatgtggccgtggtggtcgatgagtacggcggcatcgccggcatggtgactatcgaggatgccatcgaacagatcgtcggcgagctggaagacgagcacgaccgcacccagcgtactgagccggagaaaatcggagacaacaagtggaagatgcccgcccgtacgccgattgccgatctggaggagatcttcgagatcgacattgatgaggacgatgtcgataccgtgtacggcctgctgaccaagattctgggccgagtgccgattgtcggtgcctcggctgtgacgcgcggtctgcgactgaccgccgtggactccgccggacgccgcaagaaggtgtccaccatcgtcgtagaaccggcgcacgtcgagggcggcgaggaaaataacaagacccatgaggaaactgacggcgagcccgtcgaaggcgatgataccgccagcaaggagtgatatgaccgatcagaacaacagcacgaacgacgtcgatgacattgacgttaccgatgcttccgatgttgccggcgttgccgaagtcgacgcgaccggtgaaacggcgaacgtgaccaagcaggacgtgccgtatcgctccggattcgtggccgtggtcggccgcccgaacgtcggcaaatccacgttgatcaacgcgttgatcggcaagcagatcgccatcgcatcctctcgcccggaaaccacccgtaaggcgatccgcggcatcctgaccgccgaccacgcgcagctcgtgctcgtggacacgcccggtattcaccgtccgcgtacgttgctcggccagcgtctgaacgacgtggtcgacgaatctctggccgatgtggacgtggtggccttcctgctgcccgccgatcaggaaatcggccccggcgacaagcgtattctttcccgactgcgtaccgacttcgccaccaagcgtgaggacggtacgttcaagtggcgcatcccgctgattgccatcgtcaccaagatcgacgagcttggccgtcagcaactcatcaacaagctcatcgaaatcaacgatttcgccgatttctcggacatcgtgccggtgagcgccctgaagcacgacaatctggctgaagtgaagaacgtgctcattgagcacacgcccgagggcccgcagatgtacccggacgatcagatcagcgaggagcgtccggaagacaccatcgccgaactcgtgcgcggtgcgttccttgagaccctggacgacgagctgccgcattcgctggccgtggtggtcgattccatcgactatccggaagacaacgagaccggtcagggctatgacggcaaggcgcaggtcaacgtgtccatttacgtggagcgtgactcccagaagccgatcatcatcggcaagggcgcctcgaacctcacctacgtcaagaagaagctgcgcaccccggtcaaccgcatcgtcggccaaaaagccaagctcgacctccacgtcaaggtagccaaaggctggcagtccgaccccaagcaactagaacgcctcggcttctagggcgtatagacgaaaaaagctccctcgtcagagggagcttttgctatacggtttacttccgcttggtgtacatctgggtgttgaggagggtggagtagcgcttgatgaccttggggcgaatcaccttcatggaagcggtcatgaggccgttctcctgagtgaactcttcaggcaggatgatgaacttgcgcacggactcggcgcgggagacgccctcgttggcctgatcgacccactgctgcacttcggcgcgcacggcggcgttccttgccgcgtcctcgagggacatgttctcgtcaagccccttggcggcgagccacgggcgcaacgacttctcgtccaacgtcaccagggcggagatgaacgggcgtttgtcacccagcaccaacgcctgggagacgaactcgcaacgctggatgacttcctcgatcgggccgggggagacgttcttgccgccggcagtgatgatcagatccttcttgcgcccggtgatgtacaggaagccatcgttgtcgatacggcccaagtcgccggtggcataccagccatcttcggtgaacgacagctcagtggcctcgtcgttcttgtgatagcgcgggaacacggcacgacccttgacctgaatttcgccgtcctcggcgatgcgcagggagaatccggggaatgcgatgcccacggaaccagcgtggaacggcgtacccagcgggttgaacgcgcacggcgcggtggtttcggtcagaccatacccctcgtatacaggcacacccgcgccacggaagaaagccagcagttccgggtcaagcggggcaccgccggccacaatccacttggcgcgaccgccgagcacttcgcgcagcgaagagtagacaatcggatcgaaggcagcgcggcgagtgcgggtcagtgcacctgccttgccattggcggagacttccttcatatagttctgcgcggccaccacggcggaggcgaacaccacgcccttggggccgtggccggccttctgggacgcggcgttgtacaccttctccagcacgcgcggcaccacgatcatgagagtgggcttggccacctgcagatcgctgatcagcgtcttgatgccggtggcgatgtagatgcggacgttcgaggagacgacgatgtagttgatggcgcgggcgaaggaatgggcctgcggcaggaacagcaggatggtgttcctcttgtcgtgtagcagatcgggcatgtaggccggcagattcagcgcggtctggcagtagtgctcgtgggtcatctccacgcctttcggcgcggccgtggaaccggaggtgtacacgatggaacacaggtcggtcttcttgaccgaatcgatgcgctcgtccagctcctcgtccgagaccgtggtgccgtaggccttgatctcgtccaagccaccggtctcgatggtgatgatgtgctccagggacgggcactcttcgacggccccatccgccttcttacgcatgtccgtgtcctgcacgatcagcagtcgggcatcggagttgttgacgatgttgcgaatctgctcggcggaatcggtgtcgtagatggtggcgagcacgccgccgcacgccatgatcgccgcgtcggtcaggtcccagtcgtaggaagtgcggcacatgaatgccacggcatcgcccttcttcaggccgtaatgaatcaggcccttggccacggcacgcacgtcagccaggaactcgttggcggtgacggtcacccaatcgttgccggacttgtaggtgtacagcggctcatcgcccatacgctcggcgcggtccgcatacaggtcgtagatggacgtaccttcgtccagcggcggattgccttcggtggaggtggtgagcaggccggtggcggggtcgatgtcggtgacggtcaggtggccgtcgtcccaatcgtcgctgtgaggcaaagcgatattggtctcgaccggcacgtcggcgttggacaggtaatcgggctcgtccggggtgtcgtcgtggaccgggtggacgaagtcggatcccaacctgagcgccttacgggtgagattgatagtgtgctgcgtgaaggaattgataaccgacaagtcttgctcctgtaaacctttcagtgtcgtccagccatgaggcgaacgcttctcaaagttcaaattgtaatcgcccaaaccgaactcgtcaccttacgcaaccgtaggattctggcgggttaggggagtgcgtggcaaaatattgcacaggttccgatattgttgagtaaccgtgagctacgaaacggtgattgtcgataattactgagcggttggttgctgatcgatgccgggtgattgttggacgacttccgagcaattcatccgcaatgcacatggacacattcgtatttctcgctaatttcgggttcgtttctgtttcgattggcggaatctcaagtcatggcctttaccttccgactatactttctatgcggataaccatgtccattttgaagtagaacaagaaagggctctcatggcgcaaaacccagaagccaccgtggtgttcggcgttttgaatgaaacgtccgaaacggaatcccgcgtcgcgttgacgccggatatcgtcacccggctgaagaggagcggagtctcctcgattattgaggccggtgccggcattgccgccgaatacaccgatgaggattacgaaaaggccggtgcgaaggtgaccagccgcgacgaggtgctcgccgaagccgacgcgctcggttttgtggaccgaccgtccgccgagaccgtggccaagctcagggccggccagtgggtcattggcatgctcggttccttcaccgatgccgattacgtggccgcgctcgagaaggccggtctggtgggcatcgccatcgaaaagctgccccgtaagctttccagcgcccagtccatggatgagatgacctctcagaactccgtgatgggctacaaggcagccatcaccgccgccgatgcttacggttccttcctgccgatgatgaccaccgccgccggcacgattcgcccggctaaggcgctggtgctcggtgccggcatcgccggcctgcaggccatcggtacgctgaagcgtcttggcgcggtcgtcaccgcgtacgacgtgcgtcccgcctcccagggcgaggtcgagtccctcggcgcgaagttccttgatctgggacttgacttctccaagggccagggcgagggcggttatgcccgcgcgctgagcgccgaagagcaggctcagcagcaggctgccgtcgacgaaaaggccgccggctttgacatcatcatcaccaccgccaaggtcccgggccgtaagcccccggtgctgctcaccgcagccggcgtcaagggtctcaagcgtggtgccgtgatcgtggactgcgcagcatccgacctcggcggcaacgtcgaaggctccgccgttggtgagcaggtcaccgagggcggtgtcaagctgatcggcgctccctacctggcctccggcgtcgccaccaccgcatccaacctgctttcgcgcaacgtggccgacatcctcgtgcacttcgtgcgtgacggcaagctcggccaggatctcaccgaagaacttgacgacgcgctggtggttgccggccgcgccgccgccccggcagctgctgccgatgccgagaagtccgagaagtaaggaagaaggaataccatgcctactctcgtcgtttccattaccctgttcgtcctcgcgctgctcatcggcatcgaggtcatcggcaaggtgcccgccaccctgcacacgccgcttatgtccggcgcgaactccatccacggcatcgtcatcgtcggcgttgtgatcgtggcagctgaagccaatagcccgctggcctacgtgttcatcttcctggccgctgtgctgggcaccatgaacgtcgttggtggctacgtggtcaccgaccgcatgcttgagatgttcaagtccagcaagaacgagaagaagggggagtcgaagtaatgacctccgcaaccgttggcgccatcgacatcgtcgcttggttcgtctacctgttctctgccgtcctgtttgtggtcggtctgcatttcatgaattcgccgaagaccgcccgcaagggtaaccagatctccgcgttcggcatggtcgtggccgtgctcatggcgttcatcgtgctcttcgccaagggcttcgtgaacattgtcgccgtggtggtgctggtcgtcggcatcctgatcggtgccgtggccggtgtcgtctccgccaagaaggtgaagatgaccgatatgccgcagctggtctccgtgttcaataccgtgggtggtggcgccgccgcactcgtggccctgaacgacatcctgaccaaggaaggcaccccggacatcgtggtgctcatcaccgctggtctcggtattctcatcggttctgtgaccttcaccggctcgctcatcgctgccggcaagctgcagggtatcaagtgggtcaagaagctgaacctgccgggcaagggcgtatggaacattctgttcgccgtgctgtccgtcgcctcgctggtcatgctgtgcgtccagcccgaacagcgtctgctgtggtcgattctgaccaccgtgttcgccctgtgctacggcttggtgttcgtgattccgatcggcggcgccgatatgcccgtcgtcatctctgtgctcaacgcatgcaccggtacggctgtggctatgtccggtctggcgattgacaatgtcgccctgatcgtggccggcgcactcgtcggttccgcaggtgtgaccctgtccatcctcatggctcaggccatgaaccgcccgctgctctccgtcttggccggtggcttcggcggtggtgctgacgccgccgctgctggcgatggtccggaaggaaccatgaaggagaccacgccggacgatctggccgttcagctcgtctacgcgcagaaggtcatcttcgtgcccggcttcggtttggctcaggctcaggcccagcgcgagctcgctgacctcggcgaactgctcaagggccacggcgtggaagtctcctacgccatccacccggtcgcaggccgtatgcctggccacatgaacgtgttgctggccgaggccaacgtgccctacgaggagctcgtggatcttgatgagatcaacccgcagttcccgcaggccaacgtggctctggtcgtcggcgccaacgatgtgaccaacccggctgctcgccgtcccggcaccccggtctccggcatgccgattctcgacgtcgacaagtcccagaacgtcgtggtcatgaagcgcggccgcggtatgggctacgccggcatccagaacgagctctacttcgaagacaacacccagatgctgttcggtgacgcgaagaagagtctgcagtccgtcatcgccgccgtcaaggaattgctcgcgtaaccattcttggctcccctctgtgaggggagctgtcgaacggagtgagactgaggggagtagcccatacgcgggtgctcccctcagtcagcttcgctggcggctcccctcacagaggggagccgagctctatatctactacagcccaaacacccgcttaacaaagctgttaacgcgacgccaatagcggtccggatcggtgctggcgctcatcgtgtggtcggcgccgggaatcagcagcttctcgcggtcgatgctggcgcaggcgttgtaattgatgtccagatacttcggattgacaaaagtatccgctccgccatgaatgaacatcatcggaatagtcgcgtgccgtaatgccttcacacaggaggcgtcctcaaaccggtatccagccttgcgttcagacacatgactggccactttgaccagcagcacggccaacgagtgcggcaaacggaacatcgcctcggcattatccgtaaactgcgagaccacggaactgtatccgcaatcggaaatcgcggcgacgacgttgcgggggagtcgcgcatcgccggccgccatcatcaccgtggcggcgcccatcgaattgccatgcaacagaatgcgtgcatccggatcagctgcggtgatcagcgaaacccagcccaacagatcgtcgctttccagcaatcccatacccacgtaacgcccttcgctcaactcatgggcgcgctgcgcgggtagcaggaccgtaaaaccgagttgcgcatagcgatgcgcccatttggccatttccgcgggctctccggcatagccatggcagcagatcgcgtatagatgcggctgtgggtcggaacaatccgggtccaacagccagccgtggagtttcaatccatcatggctgcgcagcgtgaccgattgcttggcctcctcgaaccaccgggcggcctcaagctgctcggacatgtcgaattcgatgcctttcggtgtctcctcgtgcggcatgttgaacatcgaacgtttggccttggtgtccagcgcgaacgtgaacatgacgttggcggccgcggctgtgacgccggctcctgtggcggctatcgcggcaagtgccgcagccatacccctgacaacgcgagtgtgtgcggcgatgacgtcatggccatcctcattgatgacgtcgtccgaacgagtcatatcaacctcccgatacggtactcaccatcgtacgttattttcgaaatcatccccaacttcgtgaaagaccgtacactgagtgtcgctgagcgtacgattttcacgaaatggcggacgatttcgtgaaaaccgtacgttgagaacgggtaagcgtacgttcttcacaaagttagggattatttcgcggaaaccgtacgttgacgtggctgggacggccgggatgcagtgtcatcgaagcatcaccgcgccaaagtccggagttggcgtatacttgacaattgttgctttggcgagggaagtgtgcgtgctgacacatgacacagcttccgttatcgactcggtgtatttcactccttgtagggtgtctttcggcgtgtcgtggcgtctgagcgagacagaacgaaacgaaactacaaggagtatccattatggctaccaccattaagcttgagggcgaggcccgttccgagttcggcaagggcgttgctcgtcgtctgcgcgttgccaacaagattccggccaccatctacgccggcggcgaagagcccgccttcgtgaccttgccgatgcgcgagaccaccctggccctgcgtcacaccaacgccctgttcaccatcgccttcgacggcaacaccaagatggccgtcgtcaaggacgtgcagaagaacccggtcaagcgcatcatcgagcacgttgacttccttgaggtcaaggccggtgagaagatcgacgtcgaggtgccggtcttcgttgaaggcaccccgaagggcgctgctgtggcattcgtcgacattcaggagctcaaggttcgcgctgacgtcgccaacctgcctgagaagatcgttgtgagcgtcgagggcctaaccgacggcaccaaggtgttcgctaaggacgttgttctgcctgaaggcgttgagctcgacgttgaggacccggaagagtccgtcgtcaccgttgaggtgccggaagatgcttctgagtccaccgccgctccggaagctgctgctccggctgccgacgctgctgctccggctgccgacgccaagtgagtcgatcgcttcgatagcgaacaattcagaacataactgaaacgtggaagcccgcagccgttgagaacggtgcgggcttcttcgttttttcaccatgtgaactctgccacacgagtaacacatgggtgtgcaaaagtatgcaacagagctcgcgccacaagcgcacagcacacaccccatatggtggctttcgggccgccaaagtcaagaagaagtagctagtaatgactgaaaacacgcaccacgatccggcagcgctcgacaagctcgccgaaccgttcaccgtactgccgaacgacaaccccgcatccgatgagaagcgccagtccctcatcgacaagccggctttcggccaggtgttctccgacaacatgacccacatgacctggaccaagggcgaaggttggtccgaccgccgcgtcgaaccgtacgcaccgctcaagatggatccgggtgcttccgtgctgcactacgcacaggagtgcttcgagggcctcaaggcttaccgtcatgccgacggctccacctggctgttccgcccggatgcgaacgccgagcgtttccagaactccgccaagcgtctgtacctgcctgagctgccgattgacgacttcctcggttccgtggccgcgctggtcaagcgcgacgccaactgggtgccgtcccgccgcgagtacacgctgtacatgcgtccgttcatgttcgcttccgagccgttcctcggcgtgcgcgccccgcaggaagtcgactactgcgtgatcgcctccccgtccggcccgtacttcccgggcggcgtcaagccggtgagcatctgggttgaagacaagtggttccgcaccggccctggcggcactggtttcgccaagtgcggcggcaactacgccgcctccctgctcggcgagtacaagggggttgagaacggctgcgagcaggtgtgcttcgtggacgccgccaccaagacctacctcgaagagctcggtggcatgaacatgatggccgtgcacaaggatggccacgtggagaccccgtccctgaccggtaacattctgccgggtgtgacccgtcgctccctgattcagctgctgcaggacaagggccacgacgtagtcgagaccatgattgccctcgaccagctgctcgaggacatcaagtccggtgaggtcaccgaggtgttcgcttgcggcaccgcagccatcatcaccccgatcggtcgcttcaagtccgagaagttcgatgtcgccgtcgccgacggcggctccggcaagctcacctgcgaactgcgtgacgagctgctcggcatccagctcggcgaagtcgaggacccgcacaactggatgtggaaagtgtgctgaatcgccttttgtttctgactaagaccccttggaacagcaacaattccaaggggtcttggcgtattggaaatgttcttggctagagagatacagatggatttagcaacattccgcaacaaataatatgatctaggtcttctgcacgttgcggggggtggttatggttcatccagatgagaacaggagcaaacctatgagcaagatgagtgacatgacggaataccatgcttcagcctaccgtttgccgtcaggcttcgaacactgctcgaaattgaagccggtggctgaggcagcgacggcgctggaccgggtcaaggccgtggtggatgtgctgtattcgccgggcggctgcccgtgggacggcaagcagacgaacaagtcgctgctcaagaatctgctcgaggaaacctacgaatacgtcgacgcggtggagactcacgaccgtgacaacatgcgcgaggaactgggtgatgtgttgctgcaatccgtgtttcaggcgcgggtctgcgaatcggatactgaggacccgttcggtattgatgaggtcgccgatcggttggtgaacaagctcatcactcggcatccgcatgtgtttgcggctgatgatgccggcaattcctctgattcttctgatgcttttgatgctgacagtaacgacgggggagaagctgcccaacccgaatccccggaagctgtgctggctctatgggaaaagatgaaacagcaggaaaagcatcgtaaatccgtgcttgagggcatttcccgcgttcaaggtgcgttgcctcgcgcggccaaagtcgtttctcgtatctccaaatcgccgaatgctgatagattgttcgcggcgtttgatgagtcggctgcggctgatgctcagcgagatgatgtacatcctcaagcggcgaaccaatccgaatcaagcggcgacaattccgctgaacgggagaaggccgatgcctacgccgatgaaatcctcgccgtcgtgcgcaaggcccgcgttgacggcatcgatatcgagtccgcactgcgcaatcgcttgcgtgatgtcgaagaaaaagtcgccttgattgaatcagaaatcaacaacgattaagtccatacatgttttttgatcacggatcgtaaaacttagaggtgctgagttgccaacgactaccggcaagctggcgtcattgccatcctattcacgtcttagtggccccttcctccccggccatactactcaggcaaggcctgttgtaggctcgggtacgacgggctgtagcgccgaataaggatgaacgggaacagaacgaagacggactgagacgaaccgaagcggtaccagaggggagtggctcatgcaggtggcgttggagaacaacatcgtttttgtggtcatcgagtatttagcaatcctgtgttggggattatcgggcggacttgccgccattcgcaagggctacgacatcttcaccatcatgctgtgcggatggcttaccgcactcggcggcggtcttgtgcgcgacgtgatgctcggtgccctgccgccggtcggcatcaccgacaaaggctatgtgctcaccacgctgttttccggcattatcgtggtggtggcccatccggagatcaccaaactcaaatggacgatgactgtcatcgatgctctgggcctcggactattcgcagtcagcggcaccgcaaaagctctggcctacggttcctcaggcatgacagccgtattccttggcatgttcacagcactggccggcggcctcattcgtgacatcttcattggcgacgtgccaatgattattcgagacaaacacctctatgctgtgccttcgttcatcggctgcatcctgaccgtgctggtatggcgcggcgtaagctacggctggttcgacatgcgctcggaaatgctgctcgacgtgctgatcgtcatcatcgtggtggcgctgcgactgctctcggtaggcttcaacgtcactctgcccggagccgtcgaacgtcatcgcgtctacctgcccagcgaaagccgatatctcaagcgcccggtcatccatccgcacgccgataccgtcgatcccggcgataccaccaaggacgaagaagacaagcctcaggatggttcaaggccgcctcagggctaactgtcttcaaagaggtacatctggccttctgcagaatgctaactgctttcaaagaggtacctgaagcacgaaacgctgagtataagtgttgcaatgatggcgtttatagttggtttttcccgtattcggtacctctctgaacggagatgtcatttcgcaagaccgccaatgtacctctttgaacggagatacaaaaagtcccgcaagccagatgacttgcgggactttctaaaaccttaagaggcttatgctcacagagcgttgatcgcaacagcgaggccggacttgcggttggcggcctggttcttgtggatcacgccagcgccagcagccttgtcgagcttctgggcggcaaccttgtaggcggcctcggcggcagccttgtcaccggcggcgatggcttcgcgggtggcgcggatggcggtcttcaggccggacttcacagccacgttgcgaaggtgcgccttctcattggtgagcacgcgcttcttctgcgacttaatgtttgccacgtttactccaaacgatgtgtgttataaggacatacaaaagttagaggatagcatgagccccggaaaaacccgcgcaatgccacgccgaatacagtccctcggctacactaggtgaagtttgagtatatgccaagaggaggaatgcgttggtcgtccaacacaatcagccgggttccacggatcagtcggtgattcgcaacttctgtatcatcgcacacatcgaccacggcaagtcgaccgtggccgaccgcatcttgcagttgagcggcattgtgcccgagcgagagatgcgcgatcgcttcctcgaccgtatggatatcgagcaggagcgtggcatcaccatcaaatcccaggccgtgcgcgtgccgtggacctttgacggcaccgaatacacgctcggtatgatcgacacccccggccacgtggacttcacctatgaggtgtcccgcgcactggccgcctgcgaaggcgcggtgctgctcgtcgacgccacccagggcatcgaggcgcagaccctgtccaatctgtatatggccatcgaccatgatctggccatcatccccgtgctcaacaaaatcgacctgccgtccgcagaaccggacaagcatgccgaggagatcgcaggtctgatcggctgcgagccgagcgacgtgctgcgcgtctccggcaaaaccggcgaaggcgtggccgacctgctcgaccagatcgtcatggacgtgcccgccccgcacggcgaccccgatgcccccgcccgcgcgctgatcttcgattccgtctacgactcctaccgcggcatcgtcacctacatccgtatggaggacggcgaactgcacgaccgcgaaaaggtccacatgatgggcattggcatgacccacgatcccattgaaatcggcgtgatcagccccgatatgacccgcaccaaggcactcggtgccggcgaggtcggctacatcatcaccggtgcgaaagatgtgagtcagtccaaggtgggcgacaccctgacttcggccgtccgcccggccgccgagccgttgcccggctatcgcgacccgaagccgatggtctacgccggtttgttcccgatcgacaacgcccagttccccgaactgcgtgatgcactcgacaagctcaagctcaacgacgccgccctgatctacacgccggaaacctccgtggccctaggcttcggcttccgctgcggcttcctgggtctgctgcacatggaaatcgtcaacgagcgactctcccgcgagttcggcctcgacctgatccagaccgccccgaacgtcacctacgacgtgaccgccgaggacggcagccagcatcatgtgaccaacccgagcgaattcccggacggcaaaatcaagaagattgtcgagccgatggttgccgccgacatcatcacgcccaaggaattcatcggtgcggtgatggatctgtgccaggaccaccgtggcattatgggcacgatggagtacatctccaccgatcgtgtcgagatgcactaccgcattccgctggcggaaatcgtgttcgacttcttcgaccagctcaagtcccgcaccaagggctacgcttcccttgattaccatgaggatggcgagcagtccgccgatttggtcaaggtggacatccttattcagggcgagaaggtcgatgcgttcagtgccatcgttcaccgcgataaggcgtattcgtacggtgtgatgatgaccaagaaactgcgtagtctgattccgcgtcagcagttcgagattccgattcaggctgcgattggttcgcgcatcattgcacgtgagaacattcgtgcgttacgcaaggacgtgctcgccaagtgctacggcggcgacatcacccgtaagcgcaagttgctcgaaaagcagaaggctggcaagaagcgcatgaagatgctcggccatgtggaggtgccgcaggaggcgttcatcgcagccctgtccaccggcgaggactccaacgaccgcgacaccaaagacaagatccgcgccgctcagaagaccgagggctagtgttcgaggtctacatccacgtcccgttctgcttgcggcgctgcggttactgcgacttcaacacctacacggctacggatcttggtgcgggggcctcgcgcggcaactatgccaatatggtcattcgggaaatgaaattgaccaagcagtggcagctcgaccacggcatcgaggagccgccggtttccaccgtgttcttcggcggcggcacccccacaattctcgccgcccgcgatctggtcgccatgctcgatgccgtccgcaagatctggagcatcgcgcccgacgcggaaatcactaccgaagccaatccggacacggtcaacgagtattacatcaatgagctcgctgccggcggcttcacccgtgtttccttcggcatgcaatctgccgtgccgcacgtgctcaaaaccctcgaccgcacgcatacgccggccaacgtggccgtaggcgtcaatgcggcgaacaaggctgggctgcgctccagcgtggatctgatttacggcgctccgggggagagccttgacgattggcgcacctcggtcacgaccgccatcgatcttggcgtaaaccacatctccgcctacgcattgaccgtggaacccaccacgaaaatgggccgtcaaatcgcggccggcactctgcccaagcccaatgacgatgacgaggccgctaaatacgagatcgctgacgacctgttcgccgccgccggcctcgaatggtatgaggtctccaactgggctcgccccggatacgaaagccagcacaacctcggctactggcgcaacgttgattgggccggtctagggccaggtgcccactcccactacaacgcggtgaccgaggctgaccacccccagtcggcttcgctgacagcccccgctggcgggagcaagtccgaagccattgcctctgcctcagctgatggacaggccaacgccgaactaggtatgatcaacgcgcatgggaacaactcccaagaaattcatgcccccgctggcgggggttgtccggcggatgccggactgggggtggtttctgtctcacacggtctgcgcagctgggacatcgcgcacccgcgtttgtggggcacggccatcaacgagaaccgtgtgccgtgggccgatagcgagacgatcactcccgaggaaaacctcgaagagctcatcatgctcgggctgcgcctgcacgagggccttgacctcgaccgcatcaaccgcgccatcaacgatgcgggtatgagcagcacgccccagactctccgtaatgtttcccttgaccaactcgccccaatggtcagcgaaggcctgattaccgtatccgataatcatcgagtggtgcccactcgtcgtggccggttgctcaatgactcggtaatcgaacagttcttcgatttcgtcggtgtatgagtcggtggtatggtgcgcggcagtcgccattacctgttcgctagttgtggttacaccgtcagagggagctatttttgttttaccggcgggggagggaaccgcgtaggactacgtccggggcgctttgcacgtagatcaggcggttggcagtgccgccggtggcctccccgtcatcgcggttggacaggatgctgtccacggcggcctggcccatttcggccagcggcagatgcacggtggtcagtggcggaaacacgtcggcggagtaggggatgtcgccgaaaccggtgacgccgatttcccgacccggctcgatgccgttggcgcgcaacgcggtcatcgcaccgatggccatcacgtcgttgagcgcgatgattgaatcgatgcctttgccgtcgtacagtgcgccttcgcccggcttcagcagtccggatcgggccatttgcatgacggccgcatagccgtcggtacggctgaacttaccattcgccacggctttcggatccacggtgatgcctgcctcgtccaacacttccatcacgccggccagtcgttctttggaggagcgatgtgcgtcatcgcccttgagaatcgcagggcgcgtatacccggaatcgacgatcagctttgcgatggcgcgcgcgccgacatcgttcgccacgtccacggcagggaagggcaggttgcggttgagcacgaacacggcacgtccgccggatgcttcgtactgggtgagttccgtctgcaacgcctggcgttccggcgcgtcggtgtattcactttcggagatgatgatgccgcgcggcctggtggatacggacttacgcaccgcctccaactcctcatgcggggtggctgccacgccgatggtcacggaaatgccgcgttcggccgccgccttgaccacgccttgcgacacggatgcgaagtaggggtcggagatatcggagaccagcagcacgatgttcggtgcggtgcctttggccactgcctgagcataggcgttgggacgatagttgagtttggtggctgcttccatcaccttgacatacgattggttgcgtaccttgcgggtgctgccgttgagcacgcgggatgcggtggcgatggagacttgggcttctttggcgacatccatcaatgtcgctggcgattgcgccttatcgttctgtacagccacgatcgaatcgatccttttcttccctgaaacggaaaacgtgtctaaacgtttaccgcaatgatatcgcatttttgcttgcaatagtagcattgtggattggaaagcctgaattctgaacaaaaagaaatcacgcgaattacggaaagcgtttaccgtcccggcgtgtcgtgcggtatgctcgaagcatgacgcgatacttatgcgcccctgactccttcaaagagagcctgaccgccatggaggcggcccgggcgatggctcaggggattgagaatgccgaccacgatgccgaggtccgttgccttcccatggccgacggcggtgaaggcaccgcacgcgcgcttgtcgacgccactggcggatcgatgcacgccgtgccggtccacgacccgctcggccggcctgtcgaaggccacttcggtctgctcgccgacggcacgaccgccgtggtcgagacagccgaagccagcggactagcactgcttgaagccaaagaacgcaacccgttgatcgcctcctcctacggcaccggcgaactcatgctcgccgccgtccgttccggagccaagcgcatcatcgtcgggctcggcggcagcgccaccaacgacgccggtgccggacttctgcaggcccttggcgttcgtcttctggacgggaacggcaacgaccttaagcacgggggagcggctctcgccgatctggccaccatcgatatcagcacgatggacccggctctcaagaacgtcgccatcaccgccgcctgcgacgtgaccaacccgctgaccggccccaccggagccagcgccgtgttcggcccgcagaaaggtgcgtccaaagatgatgtcgccacattggacgccgccctcgcgcattttgcgcagggaatcgacagccagctcggcgttgccgtgaacgacgtgccgggtgccggcgcggccggtggcatcggtgcagcgctgaagggcttcctaaacgccgaattccgcccgggcatcgccatcgtcatcgaacaatccgggctcgatgcggccgcgcaatgggctgacgtggtgttcaccggcgaaggctccatcgacttccagaccaagttcggcaaaaccccggccggcgtggccgaaaccgccaagcgccacggcaagcccgtgatcgccgtcgccggacacatcggcacgggcatcgacgaactgcatgaggtcggcatcgacgcggtattcggcatcgcgcccggagctgccagccttagtgagctgctggccgatgcggccgccaacgtgacccgcaccaccgaacaaatcgtacgaaccctacaactgtgagcaggctcccgctggcgggggctggcgggcttcgcccgacgggggcagcgctgagaaccaccctcagtctcgctatgcgagacagctcccgcagcgggagcgagtaccggaaaggaagacgtgcgcgccacactggaaaccgtgagctgcggcgaactgaccgccgtgtatcgcaaagacagcgacaccggcatcgtggaactggcatcatggatcgtcgacgcgagctcggtcttgtgacatgattggtggtgatggaatcaacgatgagtccaacaaaacggcaccgcctcccattgcgcaatatcgcgcgcaatattacgcagcgtattggctctccgaatgcgtgtctgctaaacctcgtgttgctctatcagcgagctttccgactgcgcagctcaggcaacatcacgacgaacaggatgaccgccacaatcgcggtcagcagatcggcgatggcctgcgcggcgatcacaccctgatagccggccagccaggagccgacgaacagggtaatcgccagcatcacaccctgcctgctgatcgacagcacaaaggcgccgaccgccttgcccgcggactggaaggtgcaggtcgtgaccatcacgacggctacgcacaccaggctcagcagctgaacccgcagcatgccggcgcccagcgtgatgatggtggcgtcctcgatgaagaatcccatcagtagacggtcggacaggctgagcaccacggtcatcaccagggcgaacagggacaggaacaggtaggaaaaacgcagaatgccgcgcagtcgaggcatattgcgggcgccgtagttgtagccgatcagcggctgcgcgccgaacgcgaatcccacgaaaaccagcaccgcgatcatgatgactttcagcgcgatgcccatcgcggctaccgcgtcggtaccgtaggggagcaggaacaggttgatcatgacgatgccgacgctctgcgtgaggttcgtgatcgccgaggggatgccgatggcgaggatgctcccgacctcccgggccgtgaccgccagacgccggcgcgcgcggtcgatgacggtccgcgggtcgatggacaggttgctgctgtgacgcagcgtgaaccagacgaaataggcgtcggtgcagatgttggcgatcacggtggcaccggccgaacccgcagcaccccagccgaatccgtggatgaacaggggattgagcacgatgttgaccgccgtgccggccaccgaaccgatcatggactgcacggcgtggccttcggtgcgcagcaggttggacggcgtcatcgacacgatgatgaacggcgagccgacgatgatcagtgtgtagaagtcggaggcatactgccaagtgtcgtcagtggcgccgagcagcgcgagcatcgggtcgcggaacgccaggcccagcaccagaatcagcaggccggtggcgatggcggcatagaagcagaacgcgctgagtcgcttgccgtcggcgaaccggtgttggccgaacaagcgcgagatgaccgaactgccgccgaggccgaagatgtcgccgagggcgatcatcacggtgaacactggcgcggtgagggagacgcccgccaccatatcggtgtttcccgtatgcgcgatgaaataggtgtcgaccatgttgtacaccaaggtgaccagcatgctgagcaccacgggcatcgccagcgagaaatacgcctccggaatcggcgccttttcgaagagttcgttatccatttccgtcccttggtgtttcgttcttcagtcactgtgcaggatgccgttcggcgtgcatcacaggcattgcagaggcaacagtgtggacaacgggcgggggagtatctcatgatgcggtgagggcgttgatgatgacgcatcgtgtattggcggccgtgtgcatcgtatgtgaacctgtgctggcgcggcgtacgcacgatgggaaaagaaagaatatatggaccccgttgtcccggttattgttcagttttactgtgttgaattattgcgttattcaattattgtggtgtgccggccgattgcggcctgagggggattgccttcgtatgtgtcatgcaatctcatgaacgggattgttcgctagattcagcgagcgtccttgttggcggcgttgatgatgtcggcgaacatcttggagtcggcgtagccggcgcgggcgatggcatccataccggagagggcgagaccgcgaatcatggaatccttgagagacataatcattacctttcgtttgcgcatcgccgtgagcggctttgcgattgttgtttaagctttgttgttatggggtccgtggctaatctgattggattgccggaccggagccgatggctcagcgagcgttcttgttggctttgttgatcaggtcgacgagcgtgctgctgttggcgcgaccgcactggctcatggagctcaggccgtacacagccagaccgcgaatcatggaatccttgagagacatcatgtttcctttcgttggtcaaaaccttggggctttgagttttgtttatcggcttctttctgaaaccggtttcagaataacgcagtccgatgacaaacgcaaggggactattccgctctcggcgtttctggcggaatatcgccgttctttagataccattcggtagttaagaggttgtctagtcgaccttctgacggccttgttctgagcgtacggttttcacgaggtatggcctcatgtcgcggaaatcgtacgctgagtcgtcgtaagcgtacggttttcacgaaatggggtctcatctcgtgaagaacgtacgctgagtcgtcgtaagcgtacggttttcacgaaatggggcctatcttcaccggattttgggcacaccggccttgagcagcttggtctcaagattgatggggcgtagcagatcctcatagaacacatggacgatttcggtgacgccctgttcccggagatgccgatcacgtctgcggtcgtactccattttcgcctggaggcttgcgcgattcttgttgctgatgtcggcgtatttggccatgccgtcgtattctgccacgatgatgcggccgtctgcgagcttccaacagaaatcgacgcgatatgacattgcgggattgtcgggattcatgaactgcacctgcagcagggggatgccgaaagacaattcggtgatctggccacgcatcaatgattcgccgccgttttcgctcaggggatccgcgtacttcagcagcttggtcacggagacctcgtcgcagacgctttgaatcatcagcgactgcacctcttcgatggtcgtcagggactttctcagagccgaatcgtatatgggcagcgcctgtgggaatgggaatgccgcgcagtcgagcagcgttcgcgccggagtcgtcaagagaatgccgttatgcttccgcgtcggaatccgattgatatagatgcggttgagacgcgcctcgtctccgccgccgatgccggacttcgaggcgatgtgcactgtgccgtcgtgcagggaatagttgtgctgcagtccgtatacgcacgccgcactcaaccccgcaaatacccactgagggtggattgcggacaacgcacgtatgacctgcaatgactgttgctctctggtcatggtgttccaaagtgttcggtcggcgtacaggttcttatacggtgacaccagctccccggcatgcaggcgacgtttcagggcgcgccgttgcgcatcactggtgccatagcagcagcgacgctcctgcttcgcctgctgcagcagtgcagaaacttccttgtgttctttcatatctcgacgctaagggtgattttgatcgttgcacaagctcaaccggcaaatgtggatactatgtcacgcgaattgttgctgtggataacttgaatcgacgtcgacggctttgccgacggtcttgtcggaggcgatattagcctaggacaccttgctgcgccgccttccataccgaaaacagtcatcagtgacaccgggggcatcttcagcgtacgttcttcacgaaatcagctgccatttcgtgaaaaccgtacgctcagaatgactcagtgtacgttcttcacgagatgaggccccatttcgtgaaaaccgtacgttgacgacgattcagtgtacgttcttcacgaaattagggatgatttcgcggaaaccgtacactcaccgcaactcagcgtacggttttcacgaagttatcgatttgggtataggttccccgtcatgaactacaatgaatcgcggcgaaaaacggagaaccgaagtcggagcgcggctgaacggatatgggtgtgactggatggctgtcatagtgatgccggttctctaacatacgcaataacaacaactgacaacaacaggggagacaaggatggcgagaagtgcgggccgcacccggccggtgatcaaggacgtggccaaactggccggagtctcggcaccgaccgtctcccggtatctcaacggcaccgtcaacgtcaccgaagacaagcgtgaacgcatcgccaaggccatcaaggagctgggctacgagccgagcattgtggcgcgcgctctgtcgaaccgggagatggactccgtggtggtgttcgcggccaatccttccgccttctccacgtccgaaacgaaccatggggtggaggccgccgcccgtaaacgtcggttcctgctcaatattgtttctttggacgagtccgacatggactccgtcaaggctcgcgtgcgcatgggtttgtcgatcaggccggcgggcgtgatcgtctacgagtacgaccgggccggcatcgccgcactggaatacattcccaaagatatgccgatggtcgtggtgggtggcagcttcggcgacggtgaataccaggtcatcaacgccgaaagggatggcggccgttggatgaccatgcatctgctggatctcggccatcgcaccgtgttccatgtggggcgtccggaaggtccgaccgataacacccgcaccaatgggtggcgtgacgcgctcaaggagcgcggcgtcacggcacctgacccaatcatcgtgcccgacgatgatttggaggagtcggtcaaggctggacgcaccttgggccgtcgtggtgatgtgactgcgattttcgccggcaacgacgagactgccatcgctgtgatccggggtctaagggaggttggtcgccgcgtgcctgctgacgtgagcgtcgtaggctttgacgaccgcaacttcggtgccatgtggaatccggcgctgaccagttacacccagaacttcctggacatgggggagcgatccttccgaatgctgttcgaacagatccaggccaagcgcgccggcgatgacgcgccgccctcgcaggtcgaggtggtgcaaggcaagccgtgtctgcgagcctccgaacgcgcgtacggcgacggcgaaatcgcgtagtcgatggggcgtgcgtatcaatcgatagtgactgtagcgcatccatatcgtggtgaggagtctctcatgccgaactgtaagcgcttaccttaagtagtttgtaatatggtttacgtcataaaaatagatattctaaatcatagtgttttgcaagggcttttgcggaaaatggctatttatcaacagttttcgaaaagtccgcatgacgggcgactgtgagcacgctttatggtaaccgctttccgtagcattaacgttagagtatgacttttgaacaatcggcaactctgaagactcagccccagacctcgggcaccatctcagcggcagacgccgtgatgcaatcggcccgcgacgaactcatccccggcaaactcatctgtgcgatcatggccgtggtcattgttatcgtgttcgtcgccatgctccacgccctacgtaaccggaagtaggttgtaggcgggattggtctgactggtatccgccacagccgggttcggtagagcggctaccaatcggccagtgtctctacggcatcgagtcctgttctgcgatgttgttcgtcaaggttgttccggtaaggtgattcatcggtgagcatgtcgtacgggagcttgatacgtctgcgatccgtgtggctatgtagtcgttaagtttcggcgtcagggtcgctgatgagggatgcgggcattgcggcatcgtacagatgtctatctccaatccggcatggtctgcttggtatgcggcgctcttaagaatcaacgcgccaagcagatccgcgtcggtagtgggacgcacgtcgagaccgtccatgatggcgtgcaactgcaccatgagaccgccggtgagcagtcatgattcggtaatgcgctcggccaccatgtatacgatattccacggatgagcgccgctggggattgcaatgcgggaaatcattgctcatttccttgttgtatgccgtgatgagttctgtaagggtttcgagccctgcgcgtcgttctctcgggtcgttggattcggccagatcagcggcgcatacgccgatgggcatgggcccctgcccggcgggcagaaaatcagcgatatgccgtgattcggcgggaggtctcgtactggccccagcccttctgttcggtagtggtaccgctacaccgactctccccgacactccagtgccgccgatatcagtgaatgcccagcctgatgtcggtagagtaaaggctattggcttggtctcgacggcgagacttctccaatggccaatatgcactgttgcaaaggagcatgcggtatgcaaccaatcaaagccattcaatacggctgtggcaaaatggcgaagtacacgattcgctatatgcacgagaaaggcattcaaatcgtcggtgccatcgacgtgaacccggaagtcgtgggcatggatgccggtgtgtttgcaggcatcggccccatcaatgtgccgattcgcgccgatgccgaggctgtactcaacgagtgcgacgcggatatcgcggtagtcacgctattcagcttcgagaacgaaatcgccaccatgtgcgagcagtgcttggctcgcggcatcagcgtgatcaccacctgcgaggaatgcatctacccgtggaccaccgatccggccaccacgaaccgtctcgacatcatcgccaaggaagccggtgccaccatggtcggctccggcatgcaggacatctactgggtaaacatggtctccaccgtcgccgccggatgccacagcatcaagaagatcaccggtgcggtgagctacaacgtcgaggattacggcctggctttggccaaagcgcacggttgcggtctgaccgccgaggagttcgaggccgagcttgcgcatcccgaaaccgtggtgccctcgtatgtatggaattccaatgaagcgctggcccagaagcttgggcttaccatcgcatcgcagacccaggccagtgtgccgtatttcagcgatgtcgacgtgtattccgaaacgatgggcgagatgattccggtcggcaaatgcatcggcatgtccgccgtggtaaccaccgaaactaatcagggcatcacgttggaaactgcctgtatcggcaaggtgtacgggccggatgatggcgatatgtgcgattggaagatcgagggtgaaccggacgtggagttccacgtggtcaagccggcgaccgtcgagcatacgtgcgccacaatcgtcaaccgcattccggacgtgctcaacgcgccagccggatatgtgacggtcgatcagctcgatgagatttcgtatcttacgtatcccgccgcgctgtacgtggcatagccttcatattttcaaggatgaaggccggcactcataagggtgccggccggtatcaggcggccagagtcgacgtgcgtggcatcacctggaactggatatggtcatgggtgatgtcatcgggccgttcatgccgtaggttcgactcgttcagcgtcaccatgcgatcgataaccgtacgagccattgcggggacgtccatcgccacagtgctgatgggtgggttggtgcaggcggagaaggggataccgtcgaatcccatgagccgtacgtcgtcgggcacgtggatgccatgttcggtgagttcgcggagcgcgccgatcgctatggtgtcagacatgcacagttctcatgttcccgctggcgggagctgtcatgcgaagcatgactgagggtggtccacagccgccaatccgtaacatcacccaacgcagcatttcacgatacggacgtttccgtatcgtattttcgtgtggtcaaatagacatttcgagcgaaaaagttcgaaatacccccataactggccataaaaaaattgcttgagaatcactattgacttttatggcgactcggtatatggacacatgaaacgtaaatgacatggagcgacggtactgtgtcaacagcaatgaacgaagaggcatgattttcttacgtgcccacaaccaattgaggtgatttcggtgacattcaaagccccgctcgatctcacggtccacgctccggacggtatgtatgatcccgccaacgagcatgacgcctgtggtgtgggtatggtcaccactttgaacaagcgtcctgagcgcaagatcgtcaccgacgccattgaggtgctggtcaaccttgatcaccgtggtgccgtgggtgccgaggagaacacaggtgacggcgccggcattctgatgagcatgccggatgagttcatgcgtgccaccgtgcccgccgaactgccggaagccggtcactatgcggcaggcatcgccttccttgaccgcgacatcgaaacctccggtcagcaggaacaggccattgccaagatcgtgcgcgaggagggactcgaagtcctcgcatggcgcgtggtgcccaccaacccggacggccttggcctgcaggcccttgccgccatgccaggattcaagactctcgtggtcgcctctccggacggtgctctggccggcgtggacttggatcgcaagaccttccgcatccgcaagcgcgtcgagcatgaggtgggcgtctacttcgcatccctgtccgcccgtaccatcacgtacaagggcatgctcaccaccatgcagctcacccacttcttcgaggatctgaacgacgagcgcatgaaggccaccatcgccatcgtccactcccgcttctccaccaacaccttcccgagctggccgctggcccagccgttccgtctgctggcccacaatggcgagatcaacaccatccagggcaaccgcaactggctctccgcccgtgaaggccgcctgagcagcgaactgctcggtgaattcgagccgctgctgccgatcaccaccccgggctactccgattccggcaccttcgacgagtgcctcgaactgctgcacctcgccggccgctccctgccgcacgccatctgcatgatgctgccgccggcttgggagaagaacccggatctcgatccggacgtgcgcgccttctacgagtacaacaacacgcttatcgagccgtgggatggcccggccgacatcgtcttcaccgacggcacccaggtcggcgccctgctcgaccgcaacggcttccgtcccggccgctggcagctcaccgatgacggctacatcgttctggcctccgaggccggcgttctgccggagatcgcgcaggaacacatcgtgtccaagggccgtcttgagcccggcgagatgttcctggtcgacaccgccgaaggccgcatcattcccgatgaagaggtcaagaggaacctcgctgcccagcacccgtaccgcaagtgggtggaaggcaactccgttgaaatgagcgacctgccccgccgcgagcacgtcagccactccggccagtccgtccagcgccgtcagcgcgccttcggctacaccgaagaggatctgaagctcctgctcacgccgatggccaacaccggcaaggaaccgctcggttccatgggtaacgatgcgcctatgcctgcgctttccagccgcagccgcatgctgttcgactacttcacccagaagttcgcgcaggtcaccaacccgccgctggactgggagcgtgaggagatcgtcacctcgctcgaatccgccatcggccccgagccgaacctgctggccgattccgagctgcacgccaagaagatcctcatcccgctgcccgtggtcaactctgatgagatggcccagctcaagcgccttgacaaggcccgcatcctcggcggctactaccgcccgtacgtggtcaagggcctctaccaggtcgccggcggcggcaaggccctcgaagagcgacttgacgagatcttcgccgaaatcgacgaggccatcgccaacggcaagaacttcatcgtgctctccgaccgtgagtccaaccatacgtggggtccgatcccgtccctgctgctgacttccgccgtgcagcaccacctgctgcgccgccacacccgtacacagatttccatggccgtcgaggccggtgacgtgcgcgagattcaccatgtcgcgctcctcatcgcctatggcgccgcctgcgtgaacccgtacttggcattcgaatccgtggaagatctggcccgtaacggctacctcaaggtcgacgcggacaccgccgtgaagaacctcaccaaggcgctttccaccggcgtgctcaagatcatgtccaagatgggcgtctccaccatcatgagctaccgtggcgcgcagctgttcgaggctgtgggcctgagccaagaagtcatcgacgaatacttcaccggcaccacctcccgtgtgggcggcgtgagccttgaagaaatcgccgaagaagtggccatccgccaccgcgtggcctacccgaaccagtggagcgcgtccccgcaccgcaacctgcgcaccggcggcgactacaagtggcgtcgcaccggcgaggaccacctcaacgatcccgaggccatcttcctgcttcagcagtccacccagcgtggcgactaccagatgttcaagaagtattcgcaccacatcaacgacacgtcgaaccgactcatgaccctgcgtggcctgatgaagttcaacaccaaccgcaagcccatcgacatcgccgaagtcgagccggcctccgagatcgtcaagcgcttctccaccggtgccatgagctacggctccatctcgcaggaagcacacgagacgctcgccatcgccatgaactcgattggcgcacgctccaactccggtgagggcggcgaatccgacgatcgtatcaacgacccgcagcgctacagccgcatcaagcagatcgcgtccgctcgcttcggcgtgacctccgattacctcgtgcacgccaccgacctgcagatcaagctcgcccagggcgccaagcccggtgagggtggccacctgcccggtgccaaggtcccgccgtggatcgccaaggtccgtcacgccaccccgggcgtggagcttatctccccgccgccgcaccacgacatctactccatcgaggatctgaagcagctgatcaacgatgcgaagatggccaacccgaaggcacgtatccacgtcaagctcgtttccgagttcggcgtcggcaccatcgcggccggtgtggccaagtgccatgccgacgtggtgcttatctccggctatgacggcggtacgggtgcagccccgctcaacgccatcaagcacgccggcaccccgtgggagatcggcctgtccgaaacccagcagacgctgatcctgaacggcctgcgctcccgcatcgtcgtacagtgcgacggcgagctcaagaccggtcgtgacgtggtcatcgccgccctgcttggtgccgaggaattcggcttcgctactgcggccctgatcgtggaaggctgcgtcatgatgcgcgcctgccagaagaacacctgcccgcagggcattgccacccaggatcctgagctgcgcgcccgctttaagggcaagcccgagtacgtggtcaacttcttcatgttcatcgctgaggaggtgcgcgagatcctcgcccagctcggcttcaggactcttgaggaggccatcggccacgttgagtgtttggatcaggacgaggccatcaagcgctggaagtccggcggcatcgacctgaccaacgtgctcaagcaggccggcccggtacccggcacgatcctgcaccagaccatcgagcagaaccacgagctggagaaggcgctggacaacaagctcatcgaacttgcccagccggccctcgaacacaaggaacccgtgcgcatcgaaatgccgattcgcaacgtcaaccgtacggtcggcaccatggtcggctacgagatcacccgccgttacggcgaggaaggtctgccggacgacaccatcgacatgaccctgcacggttccggaggccagtccatcggtgcgttcatcccgcgcggcgagaccatgcgcatctacggtgaagtcaacgactacgccggcaagggcctgtccggcggtcgcatgatcgtgcgcccggaagacaccgtcaccttcgacaagcacagcaacgtcatcgccggcaatgtcaccggtttcggcgccacttccggccagatgttcgtagccggtcgcgccggcgaacgtttcggcgttcgtaacggcggtgccacgttcgtggtcgaaggcgtgggcgaccacggctgcgagtacatgaccggcggcactgttgtggtgctcggccccaccggacgcaacttcggtgcaggcttctccggcggtaacacttatgtgcttgaccttgatatgaagaaggtcaacccgggtgccatcaagtccggtgcactgctcttcaagtcgcttgatgccgaaacctccaagctggtgtacgcactggtcaagcagcatgccgaagagaccggttcccagttcgccgcggccctgctggaggactggaacgaaaccgtcaagcggttcacgcacgtagtgccgaagcagttcgtggccatgacgaaggccatggaagaagccaaggccaacaatgtagatttcaatgcgcccggcgcctgggaaaaggtgtacgagcaggttatggaaggagcgcgctgacatgggcgacccgagaggattcctgaaggtccgtacccgccgagagttggctgaacgccccgttgaggagcgtatcaaggactggttcgacgttcacgccgaaaccggcctgcaaccgtggacccaaacgcaggcggcccgctgcatggattgtggcaccccgttctgcatgaccggatgcccgctgggtaacctgattcccgagtggaacgacttggtccgtcagggcaagtgggaagacgcctacaaccgtctgtccatgaccaacaacttccccgaagtcaccggccgcatctgcccggccctgtgcgagcaggcctgcgtgctcggcatccaccagccgccgaccatgatcaagcttgacgagcagaccatcatcgaccaggcatgggatttggactacgtcaagccgctgccgccgcagcgtctgaccgaccagacggtcgccgtcgtcggctctggccctgccggccttgccgccgcacagcagctcacccgcgccggccacaccgtcgtcgtctacgagaaggacgacgccatcggtggtctgatgcgttacggcatcccgaacttcaagcttgagaagggtctgcttgaccgccgtgtcaagcagatggaggccgaaggcacccgcttccgcaccaacgtggaaatcggcaaggacatcacgtgggatgacctgcgtgaccgttacgacgccgtcgtagtggccatcggctcccgcgtgccgcgcgatatgaagattccgggccgcgagctcgacggcatccacttcgccctcgacttcctgcccgacgccacgcgccgtatcttcggcgtcaagccggtgcacgacatcaccgccaaggacaagcacgtcatcgtcatcggcggtggcgacaccggttccgactgcctcggcacctcgatccgtcagggtgcgaaggacgtcaccgtgctacagatcatgccgaaagagccgtcaagccgtccggacaacagcccgtggccgaccttcgcccgcacctaccagaagacctcctccatggaagagggcggcgagtatatctactccaccgactccgtgaacttcgagggcaccgaagaggagaaggccaaggtcaccattgataactcgaccaccgccgaaggcttcgtggccgatgagcgtggtcatgtcaccggcttgaaggtcgtctccgtggctcccggcgaaaatggtccgttcactcgccagcctggcaccgagcgcgtgctgcccgccgatctggtcctcatctccgtgggcttcctgcatccggacaccgagaccatcctcgaccagctgcccgtcgaactcgacaagcgtggcaacatcgctcgcaatgacaagttcgccacctcccaggatggcgtgttcgtgtgcggcgatgccggccgtggccagagcctcgtggtctgggccatcgccgaaggccgctcctgcgccgcagccgtggacgagtacctctccaaggaaaagagcgagctgccggccccgatcaaggccagccagcgtccgatgatgctgcctcgctgaatactttccaaacagaaacatgaaaatcccttcttcgtgaggggatttttgcgtttctgggattaattactgccttgagccttcagtaatgtttatatttcgagaatattgcatacgtggttaacatgaagctcctatggtgtctttcgtcgccaaaaagatgacgccagaatatttgggagagattcatgaacacacgccatgtcacttcactggtcgcggccggtgcggcaatcgtcatgctgctcagcggctgcggatcgaccggtacctccaattccagcaatgcttcagattccaatatcatttccgtgtacggcagtgagccggcacacccactattccccggcaacaccactgaggccggtggcggcaaggttgtagaccagctgttcgcaggtctggtgacctacgatgcgaagggcggcatccacaacgaggtagcagacagcatcacctccagcgacaacgccacgcattacgtcatcaagctcaagagcggatggaagttcaccgacggcactccggtgaccgcgcactccttcgtaaacgcatggaattacaccgccaacagtgccaacaagcaggccagcgccagcttcttcagcacaatcgaaggctatgatgatctgcaaaagccggacgtggaccccaaggccacgctgagcggcctgaccgtcgttgacgacaacaccatcgatgtcaagctcagccagcccgactcggcattcccggtcaaggccggcagccacgcctacatgccgttgcccgaatccgcgttcaaggacccgaagaagttcggtcagcacccagtgagcaacggcccatacaagttcgtgtcctggcagcacaaccacagcatcgaaatggtgaagaaccctgactacaagggcaatcgtgtcgccaagaacgatggcctgaacttcaagatctatacctcgcctgattcggcatacgccgacctacgcggtggcaacctggacttcacgaacacgattcctgacaccgcacttacctccttccaatccgacaagtcgctgaaggcatacaacgagcccggtggcaatacgctcactttcaccattcctgaatggctggaacacttcggccagaacgaggaaggcaacctgcgtcgtcaggccatttccatgtccatcgaccgcaagaccgtcgccgagaagatcttccacggtaccgccacgcccgccgtcgacttccttgcagccccaatcagcgcctactccaaggaactcaagggaaatgaagtactgaagtacaacccgtccaaggccaaggaactgtgggccaaggccaacgccatctccccgtggagcggtgagttcggcattgcatacaatgctgatggcactgcgaagaactgggttgaggcaatctgcaactacatcaagaacacgctggatatcgatgccaagagcatcccgatgtccacttccgacgaattcctgtccaatgtggattcaggcaagatgacctccgcataccgtagcggttggggccctgattatccatccgcggacaactatctggtacagctgtacgattccagttcggccgacggcaagggcggcaacagcggcaactacaagaaccccgagttcgatgccatgatggacaaggctctttccgccccgtccaccgaggaagccgacaagtattatcagcaaggtgaggagattctgctgcaggaccttccggctatcccgttgtggaaccagaatgccaccgcagccagcacctccgcaatctccggcgtcgcattcgactacggcggcggcccagtgttcaccgcactgaccaagaagcagtaagcagtaagtaataaacagacagcgctagccccccgctggcgggggctgtcggcaaagccgactgggggtggtctcaaacagcagaccacccctaatcttgttatatgagcgagctcccgtaagcgggagcaatcgagaacatacaggagcacattaactatggaattcaccgtatccggcactaccgtgcgattcgatgaacgaacaatgcagttcgcttttacgcgcgacggtgccgaatggaatacctgcgctgatttcaagccgaccctgcaatgcgcgcaaggcaccttcgcgttcgcggatgccacttccatcacccatgagcagcgtgaaaccggcacgggaaccggcattcgcagcatcttcaccggctttgggcacagcgcatactcctttgaaacctatgtatgggtggagcgtgcctcaggcgatgtgctcttcgaatggattccgctcaatgagcaaggcctgaacatcaccaatgtgacgtggcccgcagccatggacttcgattgcgccgacgaccatgacacgacactcatcacccatgagcaaggtgtgatgatccccaacacatggcctaccgccgtgagcaccaaagacatcgccttcgacggccgcttcgaaacggctggcggttacatgccgtggttcgcgcagctccgcgcagacggacacgggtatatcgccatctgcgaaactccatggaatgccggttacggcatcgaccatcccagcaatggcccgtacacccatatcaatacttggtttgagccaagcctcggcacaatgaattatcgccgcgtggtacgctaccagttcctcgaccacgccgatcacacggcggtgtgcaaggcctatcgttcgtacgtcaacgaacgaggtcgcctgcgtacgctcgccgaaaaagcggcgcgcaatccctccgtgcgtgacctgattggtcgttcatgggtgcacatcggcatcaaaaccaaagtacagcccgactcgtactactacgataaggatcaccccgagaaaaacgattcattggtcacctttgcgcagcgcgaaaagcaaatgcgaacattgcacagcatgggtgcaggccgactgtacatgcacttggatggttgggcacagcccggatacgacaacgcacaccccgactatctgccggcttgtcaggaggcaggcggctgggaaggcatgaagtcgctggtcgacgcctgccatgagcaaggcgatattttcggcacgcatgaccagtaccgcgattactacttcaccgcgcaaacctttgatgccaacaatgcgattcggctggcagacggtacgatgcccgaacacgcacgctgggcgggcggccaccagacctacctgtgcgccgagctcgcaccggactacgtgcgccgcaatttcgccgaaatcgccgcacacggcatcaaactcgactgcgcatacttggatgtcttcacctgcaacgaaggcgacgaatgctcgaaccccgaacaccgcatgacccgccgcgaatgctttgaccgccgcgccgaatgcttcgaatatctgctctcgcacggcatcctctcctcgtccgaagaggtatcggactgggcagtgccaagcctgatattctgccattacgcgccatacgacttccagatgcgctcacccaacgagccgcgccaaggtgtgccggtgccgctgtataacctcgtctaccatgattgcgttatcgagccgtggatgatggagcgtgtggtggacggcgacgattacatgctgtacgccttgctcaacggcggagccccatacctgattcgcgatgccgcatacatcggcgttgacggcgacatggacgacgaacagcgcgctcgcacggaaaacgacatcgaacgctgccatacggtcgttgcattccatgagcgggtcggcatgcaggaactggttcgtcatgagttcgtggatgatgatccgctggtgcagcgttcggtattcgcggacggcactgcggtcacttgcgacttccatacgcaaacctatcgcatcaccgactgaaaatacaatgacacacagtgggttccgatggactggtggcaaattgccgccgataagcgagtaatatagccaacagtgtcaccgtcgaaacaggagtagtgaaatgccgaatcgtgcagaacgccgtgcccaagccaaagcaggccgcaggggagtgccgtcgcagtatgaccagacccgtggccgcggtcgctcgggaatgattgacgaataccagctgcagcagaagtcccagcgtctgcaggacggcaccgacggcaccgaatggaagcccagcggcggtacgattgcggacaccgaaaccctgctgaccactaacccgaactacacgaatccgaagatgttcaaggcaccgcattcgctgcgtcagtggttccgcgtgggcagctggacgctgatcgccatcgcgattatcgcgttcttcgtggttatgtggctgccaagccatccgatgtggctgatcatcaccgtttccgcggtgttcattgtgggtgtgctgagcctgttctttacggctggcgattccaagcacaatccgaatctggaccagaacggcacggccgtttgatcttttgcccggtaaatccggcttgaaaagcaaaacgcacgacggaagttgtgcgttttcttgtatgcggtgccctaaagtaagaagtgcttgagtttctttctgacgcacgaaggagaggcagtccgatgaaagttgatattctaacccgcgaatacccgccgcacgtgtatggcggtgccggcgtacacgccgaggaactgtccaaggtgcttgccgagcgcatcgacgtaaccgttcgtgcgtttgatggcaagcgcaccgaggcggacattcctgctatcccgaatgctgccgatgctaagggcagcttgaaggtcgtcggctatgacacgccttctgagctggctgatgccaaccccgcattgaagaccttcggcgttgatttgcagatcgccaatgatgtggacgccgacatcatccacgcgcacacctggtatgcctgcttggcgggctacatggccaagatgctgcacggcactccattggttattaccgcgcactctctggagccgttccgcccgtggaagcgcgaacagctcggcggcggctacaatctgagctcctgggccgaaaaagacgcgtacgagcacgccgatcgtgtgatcgccgtttccggtggcatgcgcaaggatattctgactgcttacccgaacctcgatccgaacaaggtggttgtggtgtacaacggcatcaccatggccgacttcgctaccccggcaccagacgatccgggttggaaggtgttcgagcgttaccacatcgaccgctcgcagcccaccctgctgttcgtaggccgcatcacccgtcagaagggtctgccatacctgctcaaggccctacatctgatttccaaggacattcaggtggtgctgtgcgcgggagcgcccgacaccccggaaatcgccgaagaggtcaagaccgcgttcgccaagctggatgaggagcgcggcaacatcgtttggattgaagaaatgctgccgaagtctgagctgaatgctttggaacacggctgtgatgccttcatctgcccgagtatttatgagccgctcggcatcgtgaaccttgaggccatggcctgcggtctgccggtcgtcgcatccgccaccggcggtattccggaagtcgtggtcgacggcgaaaccggctatctggtcccgattgaccagctgcacgacggcaccggcacccccaccgatccggacaagtttgtacatgatatggccgccgctatcgacaagatcatggctgaccccgaactcgccaagaagatgggccaggccggctacgaacgcgcccgcgacgtgttcagctgggagaccatcgccgacaagaccgtggaagtctaccagtccgtgctcgacgagcagaagaagtaaaagcgagccagcgcaggctcgcgcagcgtgacggagggagagaccgtgcaataagcggtgctctccctccgttttgtaccactgaggagaatcatgtcccaaaccgtcctccaacttgacaacgtcgaattccgccgcaaccgccgcgtcatcatcaccgacgtgaacctcaccatcaacgcaggggagcgttgggtgctgttcgggccgaacggcatcggcaaatccaccgcagtcggcatgctggccacccgcaccttcccctcggaaggccgcgtgttcattctcggccaccagctcggcaaatacgacgtgttcaagctgcgcacccgcatcggtctcgcatcggccgacctgggtcgccagttccccgagttcgaggacccgctggatgccgtggtcaccggcctgtccgccgtgaccggacgttggcgcgatacttacacggacgaagaatacgcccgcgcacgccagctgctgcgtgatttccgcgtctcctatctggaaggcaaggagatgtggcgactgtccgaaggcgaacgcacccgtgtgctgatcgcccgtgcgctgatgggcgatcctgagcttttgattatggacgagccgaccaccggccttgacctgggcggccgcgagcaggtgatgcgcacgttgagccgaatcggcgaggaaagctctgaacgtgccgtggtgctggtcacccaccgtctggaagagattccggcaggcttcgatcacatcgccattatgggccgcaagccgattcccgccgaagatgccaccgaagcgggcgtcgactcaatgggcaatcccggtgctggcaccatcgtctataccggttcgctggaagacggtctaaccgacgagcgtctctccgacctgttcggcatgcccatcgaagtccagcacactcacggccgctgggccgcctacgccgtgtgatgccgttttggtctccgccagcggaagccgtcggccaagccgactgggggaggtgtcagcagtacttttcctttttcggcaggttttatttttctcttcgccccctctggagggggctgtcagcgtaagctgacttggggaggttcgacatatgacggaaagcgacatgactggtagcaaactcgtattcattgatatcgacggcacgctggctgatgagaatcatattgtgccggagtcggcaaaaacggcgtgtgcgcgggcccaagccaacggtcacaagctcttcatctgcaccggtcgatccgtgccgaaaatcgaacgcaacattctggatcttggattcgacggtgtagtttccgtagccggcgcacaggcgaatatcggcgataagctgctgttccagcacctcgtatcgcccgaagccatcgatgcggcgatggcctattttgccgaacaccatatcgagagctaccagtggcagggtgcggacggcatgtacatttccgaaggttatcgccgccatctggagtccaagggcaagacgtggaatcgtggtgagtttgcgcggttctggcatttgctggacgaggtagaggttccggctggatctacgctgggtcacacgattcatgtgagcaagggatcgtatttcaccgggcccgagccggatgtttccttcgagaacactcagcatgatcttgccccctggttcgaactcgtgcacggctcatacgacaagatctcgccgaataacggcgaactgctcatcaacggcatcgacaaaggcaccgccgtgcgcgacgtggcttccttgcttggctatgccatcgccgacaccatcgccatcggcgactccgataacgacaccgccatgctcaaagccgccggcacatccgtggccatgggcaacgccatccacggcatccaggccttctgcgacatcattaccaccgacatccgcgacaacggtctagccaacgccttcaagacattggggctggcgtgacgagtgcgaagtccttaccagttgcgattgcgcaatttacggtggcggaggagccggaacggaatctggagatcatcgacggattcgcgcgtgatgcggcggcgggcggcgcgaagttgctggcattgccggaaggtttgattgcgcggcgcggcgatgacgattcatatgctgtcgcgcacgcgcaaccactggacgggccgtttgtagacggcttgcggcgtatcagcgcgcagcggcatattgtgctgatgggtaccgtgcatgttgcgccggagcaagtaacagaacgggatgcagattcccgagtttccaacacgttccttgtgattcgcgatggtgaaattatcgctgaatatcgcaagctgcatctttacgatgcgttcgcggcccgcgaatccgacgtggttctcccaggagatgcgttgccgcctatcgtcgatattgacggttggaaaatcggcgtcatgacctgttatgacgttcgtttcccggaaaccgctcgctcactggccgtgcgcggggcagatgcgattgttgtaagcgccgcttgggtgcgcggcccgttgaaagagcagcattggaagctgctgactgcggctcgcgcattggaaaacacttgctatgtgttggcttgcagtgaggtgagttcgcggaacatcggatgctgtcgcatcatcgacccgatgggagaggtagttgccgaagcgggcgatgagggagccgagcttattgctactgggcttagtcgcgaatgccttgcttccgcacgccagataatgccggttctgcagaatcgccgttttgccgacccgcagttgcccgattagtcgagtctttcagagcccgctgccgacgctttgatggcatattactgtcgaatataacgtgccgaattattgacgcaatcagtggtcatcgaaagtctgtgatagatgtcgcgggctcggacgcctatcatgggacgcatgactgctactgttcatgattccgcccaagctcctgtatacgctcgtctgcaagaggggagtgatgctcctgatttcactctgccggcgattgtgcccggcactgcggagaacggcttaatcaatctgtctgacgtgctcgaggacggacgtagggttgtactgtacttctatccggcggcaatgacgcccggatgcaccactgaggcttgcgatttccgagataatctcgcacgcttggagtcgcagaatgttgcggtgctcggtgtctccaaggattcactcgagaaactgcgcaagttcgccgagcacgaccatctcacattcccgctgctgtctgatcccgacctgaccgtgcacaagctgtacggcgcatatggcgaaaagaagctctacggcaagatacacgtaggcgtgatccgttcgacgctcgtcatcaatcccgacggctccgtggttatcgctcgttacaacgtacgtgccaaaggccatgtcgattcgctattaaaggcactggaaaagttggagaagctggagaagtagtgcgttctcgttgttcggacacagtggttcgtgcggtatgcgccgtatgaaccactgccgtatgaaccaccggttgacttctcggactcaccggcaaatagtgagaccgtgggcgcgcagtacgtctatggctggcatgtaatcgagcgatgttgcggtgggattgagcatcagttcgcggatggcggcggatgctgaggactcgcttgtcttcgaggattctgcggccgggaacagagcgtcggcgattagggagatgatacgggaacgtgcatcgccggcattggcattgttgctgctgttgccggcgtcggcagtggcggatttgccaataattgtggagctgtttcgtagaatcgtattcaacgctgcggcaagcggctcgggattgttctttgtcgcttcgacaatgtcatcgagctgatcgaataaggcgaacagccatgcacggcgttgcccctcatcgttgccagccgcaagcctttcattggtgacgcgcacgagttcatcaatcggtactgctggcgtctttgccggatcgcgatgctcgcggttgtcttcgatatctcccatcagatgctggattttgcactcgtcctgcaatacggtggtctcggcaaatgcggtggcgatggcgtccgcatcgatgaacttgccaccttcggactggaagcgcacgcgcttgggctcgctgtaataatgcgacatgccgaatgtgatgtactgcggcatctcgtcctgcaattgcttgaccgcatccgctaccttgcgcatgtccgcaagctgctgatgcaccacaataaaggcaagcactgctttggcgtcggcgagagtgagcggctgaccgatgctggctccatgatggtgctcatgatgcgcgaacatgttcttcagcgaatcaaacaatcccataatgtcctccttcgaactgggcgaattagctgcatcggccattcacactagtccggaatgtatgagaatcatcgtggaacgccgagagcgaattattgacgctgcacgcagcaacgtgagaactgaaccgacaccaagaacacggggcatacctgcagcatgtcgagcaatgcgatggcattatttgttaagagctcgaaaatatcgcacaggacgtagaagtgcttgtccgaatcatgtatggcaagaaggctctacagtttgcttgtgaacgactccactggctaactggtagagaagtagcggtttggtatacgcaaacagtgcgatcggcgatgaagatgactgtgaggttgtcatgtgtattcctcagaacgatgagcaagagccatggacttggtgcgtaatagcaaatgtcgtagatgagcatgaggttggtgttgaccatcatattgagcatggaacgaagatattcagtcctggaacaaaagtgtatgtgtcgactgaatggaggacgagcctaaaggatgacggtggaacattgtttgtgattgggaaagcgcgtaagcaatggcgaatggtaggtatgttcattccacgtaatcgattgacgaactttcgagttggacgagtattcgatccacgtgtactgcggcgtatggctaaggattgcaggcaatcagtgccagatccgtctgaatggggttggcgctggtggggcaatgatgaggatgcccaccaaacagtcattaagagggttgaatacttcagtcaagatggattttcgttgccagaagctggggctgaagatgattagaatcaggtgagtaacacgatgctgaagaattctgatgcgtctagtctttcttcttgagggaccttccaccgccaacaccgcgaccaggacggcttgcattccaatcatctattgttcaggtagctaacctttagtagtgccatatatacgtcaggttccggcagcttatatactgatgcgttcttgacgccgaggcgctcgctaacttctttggtgctgagaaacctaagtgccatttgagttcctctcatcttcgtggagatttcagtacgtcggtatattgagcatacctgcatattagcgaggcaaatcctctagtgaattgagatcttgactcactgataggcggttagtgaagcgattctgcggttaagtcgagcttttgcttcgctgagcagcctcagtgaggcaaatcctcgggcggaccgaggcattgctctactaaaaggccacttagcgaggcttttcctctactaactctctgagttgcttcgctgacgacgattcagcggggtattcccttgacctatccgtgttttcgctctgcaaagtagttctgagcggcggatcgatactcacacagatgtgtacggtgcgctgtcagcgtctttgtagtttcgccggtcagttgcttggtaatccaggataagtcagtcatggttccttacttccgtgtgaggcggtacacttgggtactgcctctattgagtgcattgataaaggtcagccccgcaagtattgctagtgcttgcggggcatttatgtagcggcagtgccgccgtcgtgcgtagtcagggactgcacctgattaagccgctaaccggcctacgctcaaagattgagtagggctcacaactagcttgcgctagtgttttcttttggcttctcagcctctaacagtttgcgagggttactgaccttgagcgcgtcacataacttgatagccatgccaagactcatattttcgataggtcttgaaccagtctcagtcgcggcgattcgcgtgtgcggcacacctgacttgtcagctagttgacgctgggttaacccgcgcttctgccttaactccctaagactcattacccacctcgcttatgctcagtgggcccgattatacctatcgttgaaacatatgtagagtgaggggcataaatcgaaaggcgtcaatgatgaacggaacattcgagcagttaagagcagccgtgtatggccaagcagtcggtgatgccttgggcgtgccttatgaattcatgccgagagataccttccgatgcgaaggtatgacgggatacggtacgcataaccagccgattggcacatggtcggacgataccagcatgatgctcgccacattggactcgctgatcgccaatgaatggcaagtcaatactgaagatatgcgagagcgatatctggcatggctgagtaatggcgaatacacgattgacggacgagtcttcgattgcgggcgaacggtctccgtcgcgttgcagcagcgtgtgggcttaagcggtgaacgagacaatggcaacggctcactgatgcggatcatgccgttggcgttcgcggatgcttccgcggatgacgtacgtgccgcatctgcaatcacgcacgcccatgcaatctcgatggatgcctgttcgagcatggtggatgtgttgcgcgacggactcatcaaaggcatatggccgcaagagctggatgatgaaccgttacgcggtatgccgcgtgatgaagttggttcgagcggcttcgtcaaagacacgtatgaggcggcgctctggtgcctcgcgaataccgatgattatgcgagttgtgtgctcgccgccgtcaacttgggtgacgatacagacacgaccgccgccgtcgccggatacctggccggcatcaaatatggattcgatgccattcccgctcagtggctggcggtattgcgcggacgtgagcttattgaggatgtgcttggacggacggagtcggcgtggcattaaggcgctcgcggtgagtggcaacctactgtttctgtatgcgatgaagatggccagtacgccaccatcaacagtgaggactccctgcctactgttctccacgatcacgcccaagcactggacgctcccatgtctcgttccgctgaacattgccgagaactcccttcttctggatgcgcatcatcgaatcccacttgctcgacgcccagactgctttggacggggatacgccgctagtgggggacagagattgagacgcattcgggttcgaatagtgtgagggatttggctttgccaacggttgttggacacattccatacggtggtgcctgtgttgttcgcaaaagtatgtctatctaatcgttaatcgaggatgacgatatggtgagtttttctgccgctataatgtaggattattaacaggttacggctgaagaactgattacagtattagaacatttttttctgatatatgtggttggcgtagatgtggcatatgcgagggggcatcctatggcggatgatgaaactcatatcggtcgaaataacgaggaacgcaaggaagacgaaaaccgtcgcattatgggaaaggcgctggaaggtgttgcggcggaaaccgtgcaacgctttggttctgccatcaaggaacatttagcggcctatgcgggtgatagagagaaacctgctgatgagaattccagacctcctaagaccttgaagtccattgctaagatggagactagcaatgaattcaaaaagcagaatctagctcagcaagcgggttttagtgccgaggttgaggcggtagccaggaagaacgccgataacatcattgctggcaacgatacgcgattcaaacgatatgatgacgtgaagcatccagatggacggcaagtgtcgaacgaccccatcgtggacattgtcgaagtggatgacttgggcaaaccaatcatcggctctgaggctcaaatgaagttcgtcggcagtagcccgaaaaagcttcttgataagttgaaaagcaagaaatatgcaaaatatcgtgatgcagacgtcagcatggttattccggatgattattacgatgtactgatgggtgatgggcctgacggcatcaacgaacagatacgaaaacttcagggcgagctggatggaggtcggcttgccggcaagaattctgaggctattcagcagcaaatcgatgatctgaaacagattaagaaaagcctgcggaaaagtggactcaccaagcgagaagcgttgtatgcgcgagaacatcccagacgcatggtggcgaaagatgtagccaaagttgccaataaagccgggttgcagcaggcaaggaatggtgcgctgattggtggtggtgtttctctgattcgaaatatggttgcctgcattaatggctctattgagccagcggaggcagcgagaaacgtcggcgtcgatgcaggcttggctgcggcgttcggctatgtcaccgctttttccggcgctgccattaagggtgccatgcaaaacgcgtcgagcgagtatctgcgtagtctatcgagaacgaacgttgcagctacgatggtctccactgtaacggatgtttccaaggtggttgcactgtattgccgcggcgagattactggagctgtttgtatagagcgcctcggccagcagggaatggggcagctcggaggagtgatgggcgttgccgtggcgatggccgcaatacctgcagatggtgcttttatggctgcgatggttggtatggctggaagcaccttgggatatgctgcagctgttgccgtatatgaggaattatccactgctctgcatgactatgagctggcgaaagaggagcgtattcgtgtggaacgcgaatgtgcggaagcggtggagctcatccgccaatataggcgtgatatgtctagggatgtcgagaattatctggcgactcatgatgaattgtttaatagagcattcgatgcaatggatcaagcgttgatttccaatgatattgatggatatttgaccggaaacgccgaaattcaagaatccttgggatacttgccaaggtttcggactcagcaggagtttgatgatttgatggcgtcagacgacaatttcgttttataaggaggagccagttaatgaagtacatcaaaacacgtgatgcattacaagcattttattatctgattgctgtcgatggatcagtccgtgacgacgaacgcgcactattcgatcatataggtgacaatttggatgcaaagcacttccatgattatcgcaaagagattatcgattcgtgcgatgagcgtataaaccagtgccacgattccgatgatcgctacgacgtaattgttgagggtgttgatgcagtcttgtcgcatcgaacggataaaagagctgcaggaattgcaccaaggctgcttctgtggaatatgttgtcagttgccttcgctgatggggaatatgatgcagtagaaagcagactcatcagacatattgcccggacgatgattgccgatcgttccatataccccgaaatggaacatcttatgcgcgcggcgtatgacgtgcgaggcgagctcgactggatcagcaattccgaactgccatatagtgaagttcgccccatggtggatcagctggaagagcgcgtgaatgttctccaaaacgctgccgtgttgctgattgaagacgagacggccgcgccagccccggaagtcatggttccagagaaggacgtgtttgatcagaccaaggatgccgttgactcggtggtcgctccggttgtggatcaggttcagcagggtgctcagggagccgcggatgcggtgaagcatacgtttgacgataatgttgctcctgttctcaaccaagttggcgatgcgctgaagccggtgaatgatgcagtgctgaaaccggtaggcaacgcagccaatgaggttgcgaaacgtgcgggtgacgcagccaatgaggttgcgaaacatgcgggtgacgcagtcaatgaggctgcaaaacgtgcgggcgatgcggcccatgctgtacaaggcttcttcggtggcctctttggacgcaaataagagaaacccaggaaggaattcactatgccattttttgttgttccactattcatcggaatggccgctgctgccggtaccgcaggcgtgggtatggctgccaaaggtagtcttgatcagcacacggcgaatcagcttaacgacaattccggagcacgcattcgatgggcagctaataacctcgaaaagcttcgtgggcaatgttcagattccctgaatgccttgggcaaagagaaagtcattattttggatgggagcgttcagcgcttccttgatgcttttcaacagctgaaaaatgttgatttcaccgcgtccgaagggcttgatgaactcaataaactgcgcatagacaaagcggcttttgctgaacttaaaaccatgggaaacatagcttcgtctttgctggaaggtggtgtgaccggtgcggccagcggtgcattggctgcgtttggtgcatatagtgccgcgtcggcacttgccacggcttccacaggaactgcgatcagtgcattaagtggtgtggctgcttccaacgccacgttggcgttcttcgggggagggtctttggctgcaggtggcttgggcatggccggtggcgccgctgtacttggaggtttagttgcaggtcctgcattgctggtcatgggcgttatcatcggtgccaagggtggcaaaaaccttgaggaagcgaagacccagtctgctgaggcaagcaagtattgtgagcagatgatggccggtgcggaccagtgcgttgccattcgtcggcgcagttatatgttccacgctttgcttgcccgtcttgatgctaaattcctgccttcaattcttgaaatggaaaatatcataaagaccgagggaacggattattcgcaattccgtcaggaaagtaagaagactattgccgcagctgcgtccactgcagcatcaatcaaggccgtgctagatactcctctgctggccgaggatgggtcacttactttggagtcggagaagctgatgaagaacagtggcatttgatgggatgaggattccggagctggactgatggttctgtgtcttcttccgtcatttttcatggcttcatatagatacgacgcatgacgaattctaccaggcgatctgggaggaagcgcttgagttgtatcagggccttgtagctgctgccgacggcgatgcgcaccggaggattgcgtttgccgagcgtcgcgacgatgactcgggccacgctttccggaccgtcaccggtctgctcgtcatgagccatttgcccgactgaacgttggcattcgtcgtagtacggtgaattggctggttcggcgaggatacgcgagccggtgaatccagtggataggtcacccggttcgatgattgtggcggtgatgccatgacggcgcccctccaaccgcagcgcctccacatacatttccagcgcagcctttgtggaagagtagtgcgattggaacggcaaacccagccgtcctccaatcgagccgacaacgatgactcgtccccgcttacggttgcgtgccgcggtacggcgcagcaacggcagtgcgatttcgttgacctgcaacacgccaaaataattcacatcgaactgcttgcgagcgagcgtcattggtgtgcattccgcagagccggcgatgccgaatcccgcgcaatggacgatagcgtccaatcgggggagagcgccgagaatgcgcgtgatgtcagacggcttggtgacgtccatttcgtaggtaaacagttcgcctcggccaagacgctgagtctcaggaacgctcccgtctgcattaagtcccaccgcaattacacgccagccttgcgcagcgagcatcctcgcagttgccttgccgataccactcgtgcctccggtgaccaatgccaccggccggccatcatccttgattggttccatgtgtactattatcgcgcggtggtggtgtcggaatcacggtatggtgatagcagccgcatggaacaagctacatgctaggcgaagcttgagcgtcgtcatccgtcttgcgagcattcagatgccggtgctcgtattcctcgaagtcatcacggacggctgccgcgggatacttgctcttggtctttgcgagcttgcccatgacgatgtcatccatatccacgccaagcgcatcggccatcatgatgcaatacgtaagcacatccgctagttcttccctgacatgtccttcatccacggatggcgactgcggcgtccactggtagcattccagcaattccgacgcctcgatgctgatggacttcgccaggttctcaggagtgtggtattggccccagccacgctccgccacaaaatcacgaatcgactgaatggtgctgtcactgatcatgactgacattctaggacttgctgaatgttggtcatgtaccagagctcatgatggaccataatatgactatgaacagtgagagcttggcgccgtttgtcatcaacctgccatatggccaatacagtagggaagcttttgaaaaggcttttgacgaatccctcgagaagcagatggggcgcagtgttaatgattccgagctggaacatttcatgctgcgatatgtgttggcatatccaacggtttatgtcgtgtattcaggaaagaccaatcgctattcgatgaagaacgaatatacggtgtacgtcggtgagaccaacgatatacggcatcgtacattccagcatcttgaaagagatgctaaagaacgcgaggactggaaagctgtagctgatgctgtctcgcggaatgatgatgcatatcggcaatatgttattgcacatcccaaattcaataagtcgttaaccctagatgtcgaaaaccgtcttatgcactatatgtccagtaccgattcggtgaaaaggctcaacaatcgacggaccaatgcgcaaggcgattattacaccgcagaccagtttgatcggattttctcgcaaatctggttgagattacacaaggaagattctgacctgttcccggcggaggagatcatccgagattccgcgttgttcaaggcatcgccttttcataaactcagcgatagccagctcgaagccgaagaatctattttggtgcaacttgccgccttggttgccgatagccggcaacagaagaaagccgatgagcaatctttagaccgccatccgaaattaatctttgttcaaggtgctgcaggtacaggcaaaacggtcctgttaagccacctgttctacagaatcgcgactgaaatcggcatccaaggcgacacctattccgaagacgaagattatcctgagctgccacaaacggcgaatggccggctttcctcatacattcttgtcaatcataaggaacaggtgcacgtatataatcagattgccacgaaactgggtttgcagaagaaatctgatgaagtggtcatgctgcccagtcggttcatcaatcgattcagcttacgcaacgagcatggtcgaggcattccagaccagccgcaaggcctggcggacatcgtgctcatcgacgaggcccatttgttgatgacgcaaggaaatcagggatattccgggaagaaccagctgtatgacattctgcgcagagcccgggtagtgattgcggtctttgatcacaatcagattatgcagtccagccagcagtgggacccagcggtgctggaaaaacttcagctggactctgattcgactcagaccgcatgtgcgaccgggaaaatcggcgcattcaaagcggttgatttgggcgccgaatatcatctgccgtccatttccgtggacgttgcgcatgtccatttgaaaaagcaattccgtattgccgcgagtaagtcgatgattcagtggattgaccgattcgcttcggggaaaggtatcggtcctttgcccgttgatacgggcgagtatgccgcagatggtgaagtgattcgagaaccttatgacgttaaggtgttcgactcgccggttgatttgtttaatgccattcacgcgaaggcccagctgaagcccgatggttgggatggggctggactgtcccgtttgttggccacctatgactggaagtattcggcgaaatctgagaatcagaatgatccgcatggcttttggaatgtggaactgcatcgcgatacttccggcgtatggcgtatgggacttgcggaggaccatggattcgatcattccgcaataagttctgaccaattctgcaagccttggaactatcagctcgaagattccgctccgaaaagcaggaaaggcatcgacaaagaactggcttgggcggagaagccgtacaccatagatgagattggctccatcttcaccatccaagggtttgatttgaactatgccggtgtgattattggaccctcggtgacgtatcgtaacgggggaatcgtgttcgatgcaaaggccagccaaaactatctggcaaccaataagcgcaaagatttaggagattttgccgaagaaaatttgaagcatgagttgaatgtcctgctcaagcgcggcgtccacggtctgtaccttttcgcggtggacgaaggcctgcagcagcgtttgaaggagtgctgcatccattaaggtatgtgacggaattattgtgctgaaaatgcacgcgaagcgcacgcaaatgatgttgaatgcgctgaaaatgcgctcaacatgctgggtgtcgtcgttcgctatgccaaaggcaggggattcctcatggatgagcatttggccaaggtctgggtttgcagccagctgaccaatatcatcaggaatctcagcgaagaacaggctggcatttctctgcatagtcaatggatatgtgccgaatgccgtaccgcgttgccactgtcgcccctacaacgcaaacgccagctcctcccgcaacgcagtacgattcggataacgcccgacgatctcgtgtgccagcacacgggtctcctcatcgccgaacactgcggcgaaacgacgcagctgtttggcgatctgctggtatgtggtgcggcgtgccgtcaatgtattgtcgacgccacgttccactgtaaaccggaacacgggcgtgcccatggtgccgtatggcatcgcgtcgaggattatcgattttgctgattcggggtgttcgatggcgatggtgcgcagcaacggtagcggcgggtaatcgaccatgacgcaatagatcagggccgcgcccgaaagccgctcatccacgatgagcttctcataagcgggattgcgccagctactgtgacgctgtgtaccgcccttggtggtcatttccggctggtacttgatacggtcgatgatgttccgggcgcaatctctggccagcccatcagccacgtcatgccattcttctgcgctaagaccgccgtagatgcgtaacagattgcgtagtttactcacgtaatgggtatcggatctgtcgttgcaggaaagaatgtagtaccgatacacgttggcgagcaggccaacgtcattgagtccctcggcgcagcattccatgatggtatgccatccatggggcagcagatccggcagcagaccgttatgccgggcatcgatatcgacatcttccatatcccggctcgacagaaggaaaccttgtgcgagcatgtatgcggaacgcaaatgcccttcatgaatcatgttcgcagcgttcatcagtgtgagggccattgactccgagtattcgctcagaagctgctcgcgtccagcgtcatcgttggatagagcgtataggtcgtagacgctcatgagtgtgaacaactgcaatacgtgcaacgattcatccgaaatgaagtcggtttcgtcgtctacttcgctcgaatcctcgttatcctcgtcctcgtcgtcctcgtcgctttcttcgctctcttcgctgaacgagtattccagattacgcgttatcgcgttgtcgatcacgtcataggcccacatgcgtttgtcatcatattgggcgaaagcgagcgcgctggaaatcagcaacatactgttcaatggttcgcattgccgcatgtccttgtcgttcgcggcctgcgcaatggtgttcaatgccttgccggcggtaggggagtcggcgaattccgccacattctccatatagcatcgcacgcgcatcgccagatcatccataagcgtgagcaaaggttcggagccatcgtcgtcctcggacgagagcagaagcgcgtggacttcgtgtatgcacagtcgcaggttgccgcatgcgctcgcgtaatcactggattgcagggcattgcccgcgatagcctgcacggttttgatgaattctgtgtagtcacaggatttgctgtacgcatcgctgtgcttactgatatgaataatgaaacgttcatggcatcggcggattgtgtcggagagcatggtttgtgcgtcgatcagcgggattagcggtcgttcttcgtctggctgggcgcagaaagtctttgcggcttcgcgcagctgggcggaccacaggaacagcagatggcctttgccttgctctgcgcgcgcgtcgaggtgttgctggatgggatccagcacggtgcgggggagtgcgatgacgccatcgtgagcgttggcggtgtcatcattgtggtgattgccgtgcgcgccaatgagctgtttgcgcagttcgtaaagcacggcacctatgtgcttgcaatatggtgttctctgatacgggcaggtgcacgcggcggattgtatgcgaatcgaattgtcgtcggttgtggattcgtggtcggtgttactgctggtagtggcttggtcatcggtgtttgcttcattggtgttctcgccgtgagcgtctttgccgaggcggatgtcaacgtcgtaatagtcatcgtcactgccggccacccgcgcgtgatacagctgcggcgcgatctcctgcaccgaactcactcggcctgattcccagtaatcggtggcgcgttcgagaatcagcggcgtgccttcgaacatgacctcgaattgagccaacgctggcttttgcggaacaaccatactgctgattgtagcgggtggagtgttactcgccgctaatgcctatcctgtgacgtaagtgatatcatgagctttgaagccggccgcctgcgggtggtttggaagtgaaagccggtgaccctgtgccatcataggggcccggctttcgcgtatacaccttattgaaaactaacaagcgataatttcatcgagaacgttttcccgaagaaattcagaaaaatctaattttccagttttggtatctccataagcgccgagaacttggtctggaatccatagacaaggctccgctgaaccgcgtatatgatccattcggattgttctgacaagatgcctggtacgcatctgtgcaagatgttcaaggtcgcgttggtcttgaggaggagtgcgactttctaacaccaaagtactgacctcatatgactctagaacaggtaacaaccgttctaaacacttacggcgtgctctttcgtccttgtggacagatgattcggccttttctgagggcgcgaatcagattcgtaatgcagtggtttgccccggactctgttacggtgataataacctcatcgttgataagggagtcttcatggcaggcaatggcaacacggcatttcgtttccgagtcgccttgcgccttgacgggcgtgaatgctggcgggagattctggtgccggcatcattgacgttcttcgatttgcatgcggtattgcaggaatgctttatgtggtacggcgagcatctgttctgcttctgtgccacattcccggatgggaagcaggtgcaagtggaagaattgtggggagaagagtccgcataccatgaggcgaaatacgaacaatatatgccggtggagccgttgccggaagttcgcattgcttcggaaaccgagctgggcgacgtgtttcccaaggcgcgtaccgctcgctattactacgattatggtgacgattggatccatgatattaagctgctgcgtacctaccgcagcgtgcacgttgcggatcctcagctttgggacggggcgggggatgcgcctccggaggatgtcggcggggtgtatgggttcgagcggttccttgataccttgggcaatcccgaagatgaagaacatgatggcatggttgagtgggccaaggatcagatgtgggatcgtctcacgctgaaccgccatcgtgaacgtctgttccgttggcacaagcaccgtgacatgatgttgcagtagatggcgtggctacaatatgagcagctgtcagcggaatagccgtttgtggcttgcggactaggggctgaaaatgctataaatatattgctttactcggaaacgagaaaggctccaagtcgccggggggctcccccggcattttttgtcaacggggacgggggatgcgatgccgtctgtattgagcatcttcgctgatgagagcggtgagtggggtaaacgatcagaatattatttaattactcttgtctttcatgaccagtctaaggacattagtcttgccttagagcggtaccgccagtcgttggctgactatggacttcctgatgtccctttccatgctgggccgctgcttaccgggcatgatgcttacgaagggatgagcctatcggagcgtaagaggcttctgggtttattcgttatcatgactcggcggctgccgattacatatcggacgtttgtgcatcgtaaaagtgattttgacgataaccgccaacgttttgaagcgcaactcaaacgcgatattgttaatctacttttggcgcatctttcggatttccattcttatggcactgtcaaggtgtattacgacggtggccaacagatagttactgatgccctgcgaggcgggattgagtatgcactctcaaaagatgccattgtctatcgtgacgcttctccacgcgactaccggcttgaacaagttgcggattttctatgcacccttgaattgacctgtgagaaattccggaatggggaacaaactgaaacggacaacaagttttttggtgattggaaatccttcagagtcaattatcttaagccgatccgcaggaaaagattggaatcataaatttggcagtgcccatatatattcgggacacaattgaataacacgaaatagcaaacaaaatccccggacctacacaatcatcgtcacgacaatctcagaaaacaccgttacggcaatcagtggtgtggtgccgtcgatgaaagcgggcatgggtggcagatgatagtaggcgaggtagcaggccatgtcggcgataagcaaaatcagcaggacgatggccaaaacgatggcggcggttgccctgagagctccggaactgtgcaacatggtcagcgcacatagttccagcgtgatccacatgacgatgagcaacagttccgtggtgatcggccgttgcaacagtagcgaagtaagcacggccagaatggtataggcggcaacgccaccgaccgcgaaccgctgaatccgccgatttcgccggccctattaagtccctcaactccatcaatcgccgtctgacccatcacatcacgctttcatacacattgccgattgacagtcctagaacacagcctagaactgtcatggcatgttcgtgcagataggggctccaacaaaattggctaaaagagaacttggcaacctataacaaggacgcgcccgtgtgcccttaccgttcagctccgctcacgaatgaaatcgaagatcacgtcgaagacctgctggctccagaaatcgtactcatgttcggcgccgtcgactagcaccagctgcgcgtccacgccgtgctcgaccagtcggtcgcgcatcttgacggattgatgataggggaccacggtgtcggcggtaccgtgcaacaggagcatcggcggatactgttggtcatcccgcacctgcaggtaggggctcatgtcagccgcgcgctgacggacctcggcattgatgccggtctcatgggtcgcacccaccacggccgcgaacgggccgaaataatacagccggaatggattggtctcatcgtcgaatgcgtcgactgcttcaagcatgtcggtgggcgggaagcagctgaccacgtacttcaccgcatcgctctcatcggcattggtgccgtcctcataccgcggatcgtcggcggtcaaccccaccagcagcgacgtgttgccgccggacgacgtgccccagataccgagacggtcggggtccacgtgccattggcgcgcgtttgccctgagatagcggatggctgctttgacgtcctcgagatatgcggggaacacgtcgcggggatcgctcgaggcatcgcgatgattcaccgtggccaccacaaagccttcgcgggccaaagccgagagctgcgggatctcgtagtcgcgatgcggcgtggtccaggcgctgccttgcacgaataccacggtggggtagcggcggtcatcgtcatcgccggtggattgtggtgagatgatatccatcaccaggttatcggccccggtcttgtacgccacgttgcgggtcagcgtggccaatccggcaagcgtgggattgtgcgggatatggatggcattgtttgcgccggcattggcatcggtgactttggctgaatcggcagtgttcatggaatccccctagctctgttgctatagaggtcatcatacaagaaataggcatgattacggcacaacgatgtctcggtcacagcgaagacatgaaggcgcgaagacgcgcccggcagcgcgcgctgcctgcctgcgagttgccttcaagtgcacttcaagcgataaggtgacataagccgcggcaatggagattgctgcccggcaacgaggcggacagtgcccgttcgccgattcgcgataacagaaatgagacactatgaagactcaggaaatcggacaatccggcatgattgcgtcacgagtggcgctgggcgtgatgcgcatggacgcgctggatgccgccgatgcggcacgtaccgtggccgtggcccatgattctggcatcgactatttcgacacggcggacatctatggattccatgatcatgccgcgcacgccagttcgaagcgtttcggccaagcgtggaaggacgcaggactcgaccgcagcaccatcttcatccaaaccaagttcggcatcgactacagtttcggcgaaaacgatggcggcgccaacggatatgacttcagcgccaagcatctgattgacgcactcgatcacgagcttgaggctttgcagacggattacgtcgacgccgtgctgctgcaccgtattgacacgctgtttgagttgaacgaggtcgccgaagcattcgacgcgttggaatcaagcggtaaagtgcgtcatttcggagtcagcaatatgggcccgtggcagatcgaactattgcaaagcggccttcgtcagaaattggaaatcaaccaactgcagttcggcctgatgcatacacagatgctcgacgctgaaatccaattcaatatggcgagcgatcccgcagccgatcgcaccggcggcatcctgccttattcacggctgaagcatatgaccattcaggcatggtgcccattccaatccggcacggaatacggtccgttcgtcggcaacgagcatttccccgagctgaacgccgaattgacccgtcttgccggcaaatacggttccacgcccaacggcattgccgtcgcttggattctgcgtcatcccgccggtatccagccgttgctcggctcaatgacaccggagcgcatccgccagatggcggccggtgccgatatcgaactcgaacgccgtgactggtggtcgctgtatcaggcagccggcaatccgttggtgtgagcgagagatgacgagaccactgccgttgaggcgcgtgttcagcgtgcatacatctcaacggcagtcaatgctgtgtcaatccacccacgacgagaacaacgacacgaacattccgcgaatcacatcagaacgacggcatatcgagcgagggaactgaatcatcggccttactggtcccgttcgcgggcgagccgacatcgtgattgtggaaccactcgacaacccgtgtttcactcatcggcatcaaatcccaagcatccaagccaacattcagtgcctccgggcgtgcaccaccgagtccctcaatctcaaccgtatcgtgcggctccaaactttcgaacaggttaagtgcggggcggtcttccaaccaccagtcgtgaaatacctcatgacagtcgccttcccttttcggcgtgcagcaatcgtttcccatcctaggcgcagccggcacctgtcggttcgtgttgccataatgaggcgcattgcaggggaaccagtgaacgcaagctgccagccatcgtgacggcgaacgggttgagaaaggcgctgtgcctgacccttggaacctgttggccaacaccatcgaagggagcaaacgatgtcttttgacgccgccgcattcggcccgatcaccttgaaccacctgccgccgttcgcccagcgcctacgacatgcagtacacgtggaaacccgaatgggacgtgtgaggcgcacgatggatgagcggtgggcgcgtgctttgcgtgccaagggcattgatattgacgaggctgacggtgctggtgggaaacaggcacacgacggcaaacggcataccgacatcacgggtactggtcgacgccccgagtcccagccggctgccgggctccgcggtcgatccaataccagtacgaatctgccggggccgaaggtgacggcacgcgccacgccattcaaggccaccggtcataagggcggcatcagccggcaggggaattgagctgatcgcagaaccatcgcgcgatgaatgggcgcggccaacgccattccgccattgttgagccgcttctacttggaccggtacctctttgaacggagatatcattccgcaaaaggtcgaatgtacctctttgaacggagatattccatattgaagctattccggcatcatatggtacgtaggaaatcccggatatcggcgatttcctcatcacagatggcatgggccatgccggaatactcgcgataggtcagatgtccggcccgttcaaggacctgatgggccgtttgctggtcgggcagcggaatcgtgcggtcctgcgcgccatacgccaggaagaatcgggtaggggagtcaagcgccgcctgttcctcgcccatgaacgaaggactgagcaggatcgcggcatcgaacaacgtcggatgcaccttgaccagacgatacgacagataaccgccttgggagaaaccgatcaatatcttcctgcgatgggcgaatgccgaggcatccagcagtgaagccaccgcatccccgaccgccgcgcattcgcgttggcgctcgtccacgccgcagccgtcgggataccagtaattgccgcccatatagggcctcgcgtaggtggcgcggaacgagatatagctgggtacggcggcaattgcggccggggccgcatcggctcgcgtcggcgcatatacggcgtcgagaatccgcatcatctcgctttcgtcgttgccgtaaccgtggaacatcaggaaaatggggtcattgccgccggcatcgatctggcttgtcatctgcattcgcatcgtcatcacctcaccagcgagcttacatgcattagacttgtagcgattgacccaccgagcacgcaaggagcaagttatggagccgaggcgcgggcctctcaccgcaggcgagaaagtgcagttcaccgaccgcaagggcaagaagatcaccgatcagcttgtggccggcggctccacgcagaccgagcatggcctgattctgcatgacgatgtgattggcaagatcgaaggcaccgtaatcctcaccgtgcatgccaagcgcgaggcacaggtcaatcaggtctaccccgagaaagacaagaacaagccgtggaaatcgtcgcgcgccatcggcggctgggagtatgcggtgatgcgcccgcggctggccgattatgtgctttcgatgccgcgcggcgcgcagatcatgtatccgaaggacatcgcccaagttattcagctcggcgacatccgctccggcatgcgcgtgcttgagtccggtgccggctcgggcgcgatgagcgtgaacctgctggacgccgtgggcgagcgcggccacctgaccacgatcgagctgcgccccgaattcgccaaggtcgcccaagccaatgccacgctgtactatggcgaggcccccagctggtgggatctcaaaaccggcgacttcgattccgttgccgccgaactgcccgaacactggttcgaccgcatcatgctcgacatgctcgacccgtggaacaggctcgagcaggcataccgcgtgattgcccccggcggcgtgttggtcagttacgtaactaccaccacgcagatgagccgcatggccgaagccctgcgcgcggccggctgctggaccgagccgcagatccaggaatcgttcgaacgcacatggaaggcccagggcctcgccgtacgccccgaccaccagatgatcggtcataccggtttccttgttatctcgcgcgccatggcctccgggttcgaggcgctcagaaagcgcgatcgcgtgaccaaggacacacagaccgacatcgactcgctcaccgacgaacagcgtgaagcgcagatcgaggaactggaactgcgcgacatctccgaccacaaactacgtaaggtgttgcgcgacctcgaccgtcaggtgggagaacttggcaatacgcacgaataaccgccaaacgatgagtttgtgaacgctcacacacctctatactggaagcaataccacaccgccacaccgccacaccgggcagacggttcgtgaagggagccacggatgggcatcaagctgagtaaagtcgccaaagcggcgaagaaatacgaccatattctcatcatcatgaggcatgccaaggctgagccgttcggcgacaagggtgactcggagcgcgagctcaccgacaaaggtctgaaacaggcgaaggccgtgggcaagggcatcgagtcgttgggactggtgcccgaccaaatctcctgctcgtccgttacccgcacgcgccagacgttggaccgcatgctcaagacctttggcgacaagccaatcgtcgactaccgcatcagcctgtatgacgggggagtgcaggcggtgttcgacgagctcgcccacgtcaaggccaagaatcgcgtgttcatgatcgtgggccacgagccgactgtgtcgatcagcgcccaatggctcgcctccgccgactccgacggcgaacgactcgacctgctgaatttgggactttcgcccgcatccatcgtgatcatgggatcgaacaaaccgttcgacgaatggcaggtgcacagcggcgaactgctcgcggtcatcaatgtgaaagacttcgactaaagcggatataaattccatctataacgacactctgcggccatttataagggccggaatccggatgttttgctaccctaagtcgggttacgaacgcatacattggaggattcatgtccactctgacttccgtctccggcttcccccgcatcgggcagaaccgcgaactgaagaagatcatcgaaggctactggaagggtgccaacgacctcgccgccgtcaaggccaccgccgccgaactgcgcgccaagcactggaagctgcagcaggccgccggcatcgacctcattcccagcaacgacttcagctactacgatcagatgctggacaccgccatccttctcaacgtgattccgcagcgttacgcacgtctctccttcgacaaccaggaggacacgctcttcgccatggcccgcggctatcagggcgacaagggcgacgtgaccgccctgccgatgaagaagtggttcaccaccaactaccactatctggtgcccgaagtcgagtcggccgcggagatcaagctcaactccaccaagccgttcgacgagttcaacgaggccaaggcgctgggcatcgacaccaagcccgtgttcatcggcccgtacacgttcctgaagctcgcccgtaccccggaagccaccgaactcgagctcgacaagggcctggtcaacgccgtggccgccgtctacgtcgaagtgctcgccaagttcaacgagctcggcgccgcatgggtccagctcgacgagccgtacctcgtgctcgacaaggagccgggcgacgttgaactcttcaagaccctgtacaccaagatcctgtccgccaagggcaatgtcaaggtgctgctcaacacctacttcggccacatcgccgacgtgtacgagaccgtcaacctgctcggcttcgacggcatcggcctggacctcaacgaaggtcgcgaggagaacctcgaagccgtcgccaagtatggcgtggcctccaacaccaccatcttcgccggcgtgatcaacggccgcaacatctggcgcaacaactacgccacctccctcggcctggtcgacgccctgaagcaggtcaccgccaacgtggccgtctccaccgcatcctccctgctgcacgtgccgttcagcaccgaaggcgagaccggcatcccggccgaagacctcaagcacttcgcgttcgccgtccagaagctcgacgagctcaaggaagtcgccgccctggccgacgccaccgaggacgagaagaaggcatccgccgccctcgccgccaaccaggctctgttcgacggcacccgcgtggccgccgacccggccgtcgccgagcgcatcggcaagctgtccgacgccgactacgtgcgtcagcctgcccgcgaggagcgtcaggccctgcagcgcgaggccctcggcctgccgctgctgccgaccaccaccatcggctccttcccccagaccaaggagattcgcgccgagcgtgccaagctgcgcaagggcgaggtcaccaaggaagcctacgacgagttcatcaaagcccagatcgacgccgtcatcaagaagcaggaggagatcggcctcgacgtgctggtccacggcgagttcgagcgtaacgacatggtcgaatatttcggccagaacctcaacggcttcctgttcaccaagaacgcttgggtccagtcctacggcacccgttgcgtcaagcccccgatcgtctggggcgacgtttcccgcgccaacccgattaccgtggaatggtccgcgtacgcccagtccaagaccgaccatgtgatgaagggcatgctcaccggcccggtgaccatcctcaactggtcctggccgcgcgaggacatcacccacgaggagcagaccaagcagctcgcccttgccatccgcgacgaagtgctcgatctcgaggccgccggtatcaaggtcatccagatcgatgaggccgccctgcgtgagaagctgccgctgcgcaagtccgactggcacgtcaagtacctcgactgggccgttccggccttccgtctggtgcactccgccgtcaagccgaccacccagatccacacccacatgtgctactccgagttcaacgacatcatccgcgacatcgacgcgatggatgccgacgtgatctccttcgaagcctcccgtggcgatctggtggtgctcgacgccattcatgacgcgcacttcgagaccgaggccggcccgggcgtctacgacattcactccccgcgtattccttccgagaaggagatcgaggatcgtatctacgagatccttgacaagatggacgtcaagaaggtgtggatcaaccctgactgcggtctgaagacccgtggtaacgccgagacctggccgagcctggagaacctggtcgccgccgccaaggccgtgcgcgccaagctcgacaagtagcggaaatcaccgagctccctctggatgagggagctcgggtttatgtaaggaaatcagcatgcattccccgatgttcacccttgaggtctttcccccgaagcgcaacgcgcctgtcggcaccatctacgacaccctcgacggactcgaagggctgaaccccgacttcatctccgtgacctacggtcacggcacccattccgaccgcaccgccaccgcgcgcatcgcccacacgatcagcaaggaatacggcatccctgcagtcgcccacctgaccgcgctctactccgacaaggccaagatcgatgaggctctcgacatgttcgaggaagccggcgtgagcgccgtgctcgcgctgcgcggcgactacatcgacggcgagcagctggtcggcgagttcaaccacgccagcgacctcgtgtcatacatccgctccgtgaagccggacttcaaggtgtttggtgcttgctacccggaaggccactatcaggctgactcgctggaccaggacatcgaaaacctcaaaatcaaggttgatgccggcgtcactcacctgatttcccagctcttctacgacaatgaggacttctaccgcttcctcgacaaggcgcgcgccgccggcatcaccgtgccgatcgaggcgggcatcatgccggtgcgtggagccaagtccgtgcgtcgcatggccgagcgcaacgcctcgcgcatcccggacaggctcaacaccctgctgaacaagtggggggacgacatccagtccctgcgtgccgccggcatcctctacgcttccgagcagatcgccgacctcgtggcccacgacgtggacggcgtccacctgtattcgatgaaccaccccgccaccacgcgccgtatctggcgcaatgcggaaccgttgttccgcggtacgcaaggttgacgcatatcgcggcgcggcgcatctcaatgcgtcgcgccgcacgttaatctgctggcgaaacccagagttctcccagcggccgatgggtatcatgaacgtgcaagccaaccaaagcgatggaagggagtccgttatgtgcactggtgtccgtttctccgatgatgagggcaacacctatttcggccgtaatctcgactggagtttctcatatggggagaccatcctggttactccgcgcggctaccactatgacacggtgtttggtgcgggcggcaaggcgaagccgaacgcggtgatcggcgtgggtgtggtcatggccgataggccgatgtatttcgactgcgccaatgaacatggtctggccatcgccggcttgaatttccccggctacgcctcgttcgtccacgaaccggtcgaaggcacggaaaacgtcgccacgttcgaatttccgctgtgggtggcgcgtaatttcgactccgtcgacgaggtcgaggaggcgctcaggaacgtgacgctcgtctcccagatcgtgccgggacagcaggagtctctgctgcactggttcatcggcgacggcaagcgcagcatcgtcgtcgagcagatggccgatggcatgcacgtgcatcatgatgacgtcgatgtgctgaccaatcagccgacgttcgacttccatatggaaaacctgcgcaactacatgtgcgccagcaacgagatggccgaaccgacttcatggggcaaggcctccttgaccgcctggggtgcgggtgtgggcatgcatggcatcccgggcgacgtgagttccccgtcgcgcttcgttcgtgtggcctacaccaacgcgcattacccgcagcagaacgatgaagccgccaatgtgtcgcgcctgttccacaccctcggctccgtgcagatggtggacggcatggcgaagatgggcgacggccagttcgaacgcacgctgttcaccagcggatattcgtccaagaccaacacctattacatgaacacctatgatgaccccgccatccgttcctacgccatggccgattacgatatggattcctcggagctcatcagcgtcgcccgatgactccttcccggctcatgccccattcggagggcatgagcgtatatagtggaatcttatggaatcgtcgatcttcaaacccagctccatggacctcatcagggcaggtctgcaagacctcgacaaggcccgcgccttgttcgaccagctcaaggcggacgacattcccgatgagcgatgcgccgaactgctgagcgcgctggcccacgcctgcgaccccgatatggcattgagcaatttcgtggatatcgtcaacgcgatgcaatccagccagcgcgatctggaacacgtcatccccgacaacgacgccctgaagcgtctggtcacggtgctcggcgtctccgacgcgatgggcaagttcatgcgcttcaagccgcagcttgtggaggcggcagcagtcgacaactgcaacagccatctgttcaatcacgcgcaacgccgtgcacgtctgctcaaggcggtcggcgcggacccggacgaaccggccatgcccgtcgcctccaaggatctggccgaagcggccacggccctgcgttccagctaccggaaccaactggccgccatcatcgcccaggatgccgtggcggacgacccgacctccatccaaccgaccatcagccgcgaactgtccgacctcgcggacgcggcgctcgaaggcgcgctggccatcgcccgccacgaaaccgagggcagcgagcacgtgcgcttcaccatcatcggcatgggcaaactcggcgcacaggaactgaactacgtctccgacgtggacctcatctacgtggtcgaaccggccgacaaggatgtggaccatcagacgctgattcgcgtgggcaccaagatgggcaccatgttacagcgcgtctgccagtccgccatcatgggcgtggccgagcagccgctgtggcagatcgacggcggcctgcgcccggaaggcaaggacggcgcgctggtgcgcgtgctctcctcgcacaagaactattacgagcagtgggccgagaattgggagttccaagcgctgctcaaggcccgcccggtggccggcgaccccgacctcggtcaggcctacatggacatgacccggccgttcgtgtggagcgcatccaagcgcaagaacttcgtctacgactgccagaaaatgcgcaagcgcgtggaggatttgattcccgcgcccctgaaggaccgcgagattaagctcggccgcggcggtctgcgcgatgtggaattcaccgtgcagatgctccagctcgtacacggccgcaccgacgaatcgctgcgcaccagcaacacgctcgactcgctgcagcgcctgtccgaaggcggctatgtctcgcgcaagcaggccgtgcgcatgtcccaggactaccgcttcgagcgcgtgatggaacatcgccagcagatctggtccctgaagcgcacgcacctgttcccggacctcggccgggcctcggtcggaggcctcgaaaagaagcgcgacatcgacgtggacgagctcaaccagaaccaggagctgcgccgactcgcccgcgcattcggcctgcacccggaagaactcgtcgacaagtacgacgacacccgccgcgaagtacgccacctgcacctcgacatctactatcgcccgatgctgccggtcaacgcccagatggagaacgaccagatcgtcctgagcgtcgaggcagcacaggaacgattcgaatccatcggtttcggcgacccggacgccgccatccgccacgtgcaggcgctcaccgccggcgtggggcgcgcggccaaaatcaaccgcatcattctgcccgccgtcttgcagtggctgggcgagggccagaacccggacatgggcctgctcaactggcgcaaactggaggagaacttcggcaccgaatccggctacctcggcttcctgcgcgactccacctccgccgcccagcgcctgtgccacatcctgtccaactcacgattcctgggcgacgcgctcaacaagtcggtcgaatcgatcagctggcttggcgacgacgacaatctgcaggcccgcacgcgcgaggccttggacgtgcagaccggctcggcgctggaacgtttcggctcgaacatcaacgagttcgccacctccatgcgcgccatgcgccgccacgaaatcgaacgcatcggcctgtcttggatgagcggtgtgatcagcgactccgacagtctcaaggccatgaccgacgtgtatgacgcgatcatcgatgcctccctgacctgggccgtgcgccaccagatcgccgagttcggcgtcgaaaccgcgccggccggcatcaccgtcatcgccatgggccgttacggcgggcgcgaagtgaacttcagctccgatgcggatgccattctcatctaccgtccggccgacgatgccgacgacggccaagccaacgccttcgccaagaaggtcgtggaagacctgcgcaacatcctgcaaggaccgacgacgctggaacccaagatcgaactcgacctggacctgcgcccggaaggcaagaacggcccgctcgtgcgctcctatgcctcctgcgaggaatactacgaatcctgggcttcgacctgggagcgccaggcgctgctgcgcgcccggtacgcggccggcgacgctgaactggcgcgggacttcctaatcaacatcgccgacccgttgcgctacccgaccacggagctgaccgaggccgaattgcagaacatccgcaagctcaaggcccgtatggaggccgagcgtctgccgcgcggcgtgcgtcgagaacgtcatctgaagctcggcaagggcggtctgtctgacgtggaatggaccgtgcaactcatgcagctccagcacgccggcgatatcaaagatctgcgcgtcaacggcacattggaggcattggacgtgctggaggccaagaagctcatcagcgctatcgatgcgattcagctgcgcaaggcatggacgttgtgcaccgcggcccgcaacggcagctatctgtggagcgggcgcgccaaccaggccgatattctgcctgatgacatctattcgctgggcggcatcgccgtctacctcggctacggcgcccaccgcggccagcatttcgagaacgacctgctggccgtgatgcgcaaatgccgtgacgtatgccagcgcttgttctatgggaagaccgaaggcgaggcggctgcggcaaccaccgccacggcctccgccgcaacgcagcagccgcaaaccgcccctcgcccgcgtatgcacgtgatcgcaccgcgactggaacgaaatcgacaccgcgcgcagcgataaggtagcatattcgttggattttcaggtggacactcggtgaatgcggctgtccgaaaaatggcgtaagttagattaggtcacgcaagggtggccacctgaaaaccacgagcgaaaaggtgagccttgtctgaagaaacgccaatggtcggcaaaagcgtcgtaacgctggacggcctgtctacaaaccagattctcgacctgctgcataaggccgaatacatcgattcccaccgcaaagagattgcccatacctgcgatgggcgagtgctggccacgctgttctacgagccctccacccgtacgcgcctgagctttgagaccgcaatgctacgtctcggcggcaaggtcatcggattcgccggcgcgcagctggcctccgtgaccaagggcgaatccatcgccgacacgttgaagaccgtgtccaactacgtggacgtggtcgccatccgtcacccgaaggagggtgccgcgctggtggcctcccgcgccgcatccgtgccggtaatcaacgccggcgacggcggccacatgcaccccacgcagacgctggccgacctggccacgctgcagtcgcgcttcggccgcatcaccgacctgaccgtgggactgtgcggcgatttgaccttcggccgcaccgtgcactccctgatcgagaccctgtgccgcttcggcaacgtgcgcttcgtgctcatcagcccggacgagctcaagaccccgcagtacgtgatcgaccgcatcaacgccaccgacagctgctcctacgtggaagtgcgcgacctggcctccgtgatcggcgacctcgacgtgctgtacatgacccgcgtacagaaggaacgcttcttcaacgaagacgactacctgcgcctgcgcgacacctacattctcgacgaagagaagctgcagctcgccaagccgtccatggccgtgcttcacccgctgccgcgcgtcaacgaaatcgccgtggacgtggacgacgacccgcgtgccgcctacttcgaacaggtcaagaacggcatgctcgtgcgcatggccctcgaaagcaccgtggtgggcgacgaactgcccggatacgaaccgctcaaccccaaggaggttcaggcctgatggaagtcaccagcattcagaacggcatcattatcgaccatgtgccggccggaacctcgctgaaggttctcgaatacctgaaaatcgacccggccaaaaccaagcttgcgctcatcatgaacgccgactccaagcgttacggctccaaggacatcatcaaaatcgaagatgacaaggacatcgacctcgacgtgctcggcttcgtggcccgccaagccaccgtggacgtggtgcgcggcggcaagatcgtcgaaaagaagcagccgaacctgcccgagcacatcgtcggcgtgatttcctgcgtgaacccgcgctgcgtgaccaccgccgagcccggcatcaagcagatgttccacctcgtgcactccgagcggctcgaataccgctgcgactactgcgacgaggaagccaaactgtgagcatcaccctacgcaacatcaaggtctggaacaccggcgaggtcatcgacctcgtggtgcccgggaccgctgccgcctacttcgccgacacctccgccgtggctgacggcgccgacatcgacgccaccggcctgaccgtggcccccggtttcgaagacccacacgtccacttccgcgatcccggccagacctacaaggaatcgatggtctccggctgccgtgcgtccgcatccggcggatacacgaacgtgctcatcatgccgaacacgttgccggcactggatgggcagaccgtgtctggcccggaagcgaccggtgcaaaagaggttctggatgccggcttcgacaacgtcatcgacttcctgcagcagtacgatactgcgcatgacgttcaattgccggttcgttacgatctgtgcgtgtgcgcgtccaaggatcgcgccggtcatgaggcaagcgacgttgccgattggctcaagtacgtgcccggattcgaggacgacgccaagacgccggccatgctcacgcaccccatcaccgcaatcagcgacgacggttccgctgtgacgccggagatcctggaccaggtgctggagaacgtcaaggcctccgacctgtacctgatcgagcattgcgagcatcacgatacaggtgccgtgaacgaaggccccgtttcccgcgagcttggcgtgcccggcattccggaagacaccgagctcaagatcgtggcccgcgatatcgaagcggcccgccgcaccggtgtccacgtgcacttccagcatgtgagcactgccatctcgttcgaggcgattcgcagggccaaggccgaaggactgccgattacctgcgagaccgcgccgcactatctggcgttgagcgacgaggcgctgctcaagtacggcacgctcgccaagatgaatccgccactgcgctccgaagcggaccgcaaagccaccatcgcggccatcgccgacggcaccgtggatctgctggctaccgaccatgcgccgcacacgttggcagagaaggaactcggcttccttgaggcgcccaacggcatcatcggactggaatgcgcgtacggcgtgtgccacaaggtgctcgtcgacggcggcttcatttccgatgagcgtctgatcgagctcatgtccgttggacctgccgaactcatggggcatgtgccaaccgacgtggccgcgctggtcgaggactacgccgaacccgcgcccaccggggatgatccggatggcgtgattgcgggggagagcgacgctcagccgcagcgtgaaggcgtcaaccgactgctcgacttgagccgcgtggatgacgccgacaatgtcgacctcgtggtgctcaacgccgccgaggaatggaccgtggaccccgaacagttccactccaaggctcgtaacaccccgttcggcggctggcaggtcaccggacgccccctcgccacaatcatcggctcccagctgatgttcagccgtctgtagataacacaaggagcagcatggatcgcctgatcgaagcgattgacaacactcagaaccccagcgtcgtgggccttgaccccactgaggcgctggtgccgccgcaggtcgtggcgagctttgccgacgaggtgcgtgactcggtcgaatccccggaggaagtcgaatccgcgcagctggccgtcgcctacttcgaatacaaccgcacgatcattgacgccatcgccgacatcgtgcccgccgtcaaaccgcagatcgccatgtacgaggcgctcggccccgccggcgtggacatctacacgatgacctgcgaatacgcggcccagcagggcctctacgtgctcggcgacatcaagcgtggcgacatcggctccaccgcagccgcctacgcccaccacctgaacggcgtgggcgacttcgacccgtggcatgaggatgcggtgaccgtcaacccgtatctcggcaccgacggcatcaccccgttcgtcgaggccgccgccgaagccgacaaggacatcttcgtgctcgtgcgcacctccaacccgtcctccagcgaactgcagatgctcgatctggccgacggcacgaaggtctacgagcacgtggccgatcttgtggaaggatggggcgccgagaccatcggcagccacggctactcccgcgtgggcgcggtggtcggcgccacccaccccgaggaaggcaaggcgttgcgcgcgcgcatgccgcacacgttcttcctcgtgccgggctacggtgcgcagggcggcacggccgcggacgtggcaggcatgttcgacaagcagggcagcggcgccatcgtcaactcgtcgcgcggcattatcggcgcatggaagaagagcggcaagtactccgaatccatgaccgccgacgaggcgctggaccttgtggcgagcagcgcgcgccaggcggcgctcgacatgcgcgataatctgcgggttgccgtatataggtaggtagattgtccggctgtgggctatacgtgagtgtgggctggaaaccggagccgagtgtgtttaactacctctcagtcaacctgcggttgaccgctcccctgatagggggagcttgatgtgctgaataggaatgaaatgacaactttcacccccacccatgatgtggttacggaagcgactgcggccggattcttcccgccgcgccacaacgtcgaaatcacgcaggttacggaactgaccgaccgcgtgatgcgactgacgttccgcgacccgttcatcgcctcccatgccaagcccgcccagttcgtcaacctgttcacgcacgacgacttcatgctcatgccgcgtccgttcggcgtcagcgaagtcgacggcgacgaagtcagcgtgatcttcgccgtcgtgggacacggcaccgaacagttggcaggactgcaggccggcgacaccgtcgacgtgctcggcccgctcggccgcggcttcaacctcaaggaagacgccaactacattcttgtcggcggcggactcggcgtgcccccgctaatctacgccgcgcaaaagctcgccgaacacgacgcctcctttgccaccgccgtattcggttaccgcaacgaccacttcgccgaggaatacgtctcccggtacgcggactggtcgtggagcatcgacgacgccgaaggcaacgtggtcgacctgctcaacaaactggaacaaggcgacgacctgaaggcctacgatcgcaagccgatcattctgtcctgcggaccgctgcctatgatgaaggccgtggccgactgggccgccgaacgcggcatccccgcgcagctgagcatggaacagcgcatgggctgcggctatggcacctgcgtgctgtgcaccatcgacaccgtggacggccgcctcaaggtctgctccgacggacccgtgttcacccgcgaacagctcggatgggggaagtgacgatgagcgcaaacaaccagtccgcgcagggcggcgacaaccacatcaacctgtacgagccccacgtgtggaagcaccacaccaaggtggccggtctggaatggaagaatccggtcggcaccgcctccggcaccttccagtacgccgccgtccgctggttctacgacgtcagccagctcggcgccgtatgcaccaagggcgcctcgcccgtaccgtgggaaggcaatccctcgccgcgcaccgccgaatcgccggccgcgaacatcaacgccgtgggcctgcagaatcccggcatcgaccattacttggccgaggacctgcccaagctcaaggccgcgggcgcgttcgtcatctccaatgtcgccggacattgcgatgacgattacgcggcggtcgtggaaaagctcgccgactccgacgcggacatgctggaaatcaacgtcagctgcccgaacgtttccgccggcggcatgagcgtgggcaccgacccggtggccctcgccaatcttatggaccggctgcgcccgatgaccgacaagccgatgatcgtcaaactcacgccgaacgtcaccgacatcaccgtgccggcgcgcgcggccgtggaacatggcgccgacgcgttgagcatgatcaacacgctcaaaggcatgcgcattaacattcgcaccggcaagccgatcatcgccaacgtcaccggcggcgtatccggcccggccgtgctgccggtcggcctggcagccgtctatcgggtgcgcaccgcactgccggagattccgatcatcggcctcggcggcatcgacagcggcgagaaggcgctcgaatacctgtacgccggcgcgaacgccgtcgaagtgggtgcggccgcgctcttcgacccggtggccccgctgcgcgtcgcccgcgaactcgacgacctgttggacagccgtcccgaactcgctgctaaactggccgcaggacagacttggaggtaaggaacatcatggcagaaacactcgcacatcgcttcactgaattcctgttggaatccaacgcgctgaagttcggcgacttcacgctgaagtccggccgcaagagcccgtacttcatcaacgccggcgccttcgacgacggcaagaagatcgccgcgctcggcgcgttctacgccgaaaagattagccaggccatcgtgcacaacacgattccccgcaacatcgacaccgtgttcggccccgcctacaagggcattccgctggccgtgtccaccgcgatcgcgctgaccgccggccacaacatgaccgtcggatacaccttcgaccgcaaggagaagaaggaccacggcgacggcggctggatggttggcaccccgctgaccgacggcatgaaggtgctgctcgtggacgacgtgatgaccgccggcaccgccgtgcgcgaagtcatccccaaactcaaggccgaggcgaacgtcgaggtcgtgggtctcgtgctctccgtggaccgcatggagaagaccaaggactccgacatgtccgccgtgaaggccgtggaagccgaattcggcttcccggtgctctccatcgccaacgtgcgcgagatcttcgacgccgccgccaagatgaagaaccccgacggcaccccgctgctcagccacgacatccagcagcgcgccgccgcctaccttgaggaatacggcgcctgatcgtcttcaatctaaaaaccaaaagcgggcttgcgagcccgctttttttattacgttccatgaacagcagcaccatattaaggcaaaagctttggcaaggagcgtgctatgaactggttagttgatatagggctgtttgcgctcgtggggatatgcagttacttcggcatcgagcatcatctggacagcaaagcgaacaagttgtcgcaaggtaatgaagaagaccgccgagatgctgatgcccaagtagaagcagcatgaaaatggcggaatgacgttggggtgacgccgctcatactcgggatatgacggatgaacagcctcttgaaacggagataaatgtctccagaaggccaaatcagctcccttgaaagcgagatagggttctaaactctgggaccgactcgcctgtgatgaaaacccgctcggcgtagaattaccgtaggttcgttgcattcgaacaaggaaggccgctatggggaacatcaccgacgatattcggcaacatttcgacactttcgccgaactgccgttcaccgaggcggatagcctcgctttgtcccagttggcctatgctcgcatgccggataacgtgccgcgctatcacgagaatgcagagaccgccgacggcatgatcgccacggttccgattcacgatttgctgcgtgccgaatgctatgacgacatgttcggcaaggtgtggtcgccttcgatgaatgtcgatctgttacgtgcgatgagcgagagcccacgttggaggaacctacgcgtgggcgcatacgtggacgaattcgatgctgcaaccaccaagcagttctcggcctgcgtgttcgaactgggtaacggcacgctctatgtggcttttcgcggtaccgacagctcaatcgtcgggtggaaagaggacttcatgatggcgttccgccgcccggtcgcctcgcaggaggccgccgcgcgttatctgaccgagctggctggccattgggccgggccgattatggtcggcggccattccaaaggcggcaatctggcggtgtatgcggcggccaatgtgcctagcgagattcaggaacgtatcacggtcgtatattcgcacgatgggcctggattcgatgaggtgttcttcgatgaggacgggtacgtacgcattgcgtcgaagatccataaatcggtaccgggctcgtcgatcatcggcatgctgtttgagactcgtgagcatgtggaagacggctatacggtggtcagcagcgacggtgccagcatcatgcagcatttcgcattgcactggcaagtcgatcatggccaattcgtacaggctgatggactgacaagtagcgcgcaatacctggcacgcacgatcaacggatggatggcaaaatacgacgacgagcatcgccgcaagttcatcgaaaacctgtttgccatcttcgaggctggcggatacgacacattcggcgacctcacttcgcatttgacacagtcactgccgattatgctcgccgcggcccgcaacattgatgtcgaagatcgcgacgtgatgattgaagtgctcaaaggcttcgccgcgacagccgccgcgtcggtaatcttggccaagtagtcggaggccatcaaactggttttgccagtcagtctcaatagcgcaaaagccggcccctgagatactcaggagccggcccttacttccatttccccagcggggttggcttaatcgcagtatatctcactgctgaccatgcctgttttacttactcctaatcaatgagcttgtagccgtggtcggagactacggacttgagcttgtcgagataggtttcggcggccttggagagcttggaacgctcgttcgtgatccagccgaccaacatcgtttcgtcggtgtcgagcggcacggtgacgatcttctcgttgttgaggtcgccgttgtcgatgccggtgcacaccgtgtagccgttgaggccgatgatgaagttcaggatcgtggcgcggtcggtcacgttgatctgcttgggggagtactccggccagaccgcttcctcatagaagtagaacgagccttcctcgccctgctcgtactggatgaacggataaggtttcaggtcctccatggtgatgaccttcttggcggccagcgggttgttgcgcgagatgaacacgtgcagcggcgcgcggaagagcgggtggaattcgaggtgcttctcgcgcaggagcttgccgatcacgtccttgttaaaatcggacaggtagatgatgccgatttcggactgcatgttggcgacctggttgatgatgtcgcgcgtgcgggtctcgcggatggtgaactcgtattcgtcggacttgatggagttgatcatctccacgaacgcctcgacggcgaacatgtagtgctgggtggagacctggcacagctgcttgcgcggtttggcatgcttatagcgctcttcgagcaggtcggcctggtcgagcacttggcgggcgtaggtcaggaattccgcgccgtccacggtcagggcgatgccctgcgaggagcgggtgaagatctcgatgcccagctcgttctccaattccttgaccgacgagctcagagccggctgggagacgtacagggcatgggaggcctcgttcatcgagccgcactcgacgattttgacgatgtatttcagctgcagcagtgtcataaagtctatttatatcgctagggatagtcgccacacggccggtcaccgtcgtcaaggacgggtccatagacttcaactgccgcgatgcaacgtttggcgacttacagacgtacgccgagttctgcgagcgattcgcgtgcctgcaacgcgttctcgaagaggatgccgtggatgccgacctcgttggcgccgacgatgttcttggcggtgtcgtcgaagaacacgcagcgctcggccgtgaggccgaaacgggtcagggccagctcgtagatgtcggcgttcggcttatgcatcttctccacgccggagaccacggtgccctgcaacagctgttcaaggcgcgggtacttctcgaaggccaggtggaaggtctcatgcgaccagttggtcagaccccatacgccgtagccgtgggccttcaaatccgccagcagctcgaccatgcccggaagcgtgcggggcagcgcgtccgcgtagtggccgatgtagaacttgaagatgtcggcgagttcctggccttgttcgcgtaccacatccgggtagatgtccgcgaaatcctcgccggtgtccatgcggtcctcgtagcggaagaagccgcaggggtcgtcgtcggcgcagatgcgttccacgatctcatcggggaatcggccttccaggcatgcgcgggtgttccagtccagcagcacgccgcagaagtcgaaaatcacgtcggtgatgggggagttggccatgatgctccttgtgttgttggggccgttgagtggggtctgcgatttagtatagggggtttcatacgttggctcccctctctgaggggagccaacgtacggaatcatgcgatgacgtcggcgatggcttcggggatggcgtgggccacgtcgccggccacaatcgggtggccgagcgtcatgaagcgctggcgatgctcgcggccgatcagttccggctcctgccagccttgttgctcggattcggaggcgatcgccgccgccaggccatgcaggtaggcggccgaggccacggtctcgcccgtggtggccacgtcatcctgctgggcgagcagggcgccggttagaccggccagcacgtcgcccgcgccggcggtgcccagccaggccggtgcgctacccgacgcatagacgtggtcctcatccaccacgatggtcaccgcgcccttcaacaatacggtggcgccggtgagctcgtgggcacgcttcgcgctggccaacgggttcaaccgcacgtcgtcggcggtgtacggctcgtgcgaatcggcatgctccgcggtgctggcggcggtttcgaaccggttgagcagtttcgccatctcgccggcatgtggcgtgatcaccacctggccgggcacacgctccggcagcaggtcgagtgcgccggcatccaccacgattggcggcatgtcgtaggcgtccttgttctcatcctcgctgccgagcgcgtaatgcttgagcaatgcggcgatggtgtcccgctgcatatcgccgtcggtgccctcgacgctagcctcgggcacgccggaccccacgacccaggactgcacatgtcccttgccgatcacggcttccggcagtgcggcgagcaccatgttctgcgcgcgctccgggcccagataccggaccatgccggtgttcgcgcgggcggcggcgctggcggtgagcacggcggcaccggggtagcgctgcgagccggtcaccagaccaaccacgccccgggaatatttggaatcctcgaacctggggagacggaccgcgtcggacgcgaacgaattatccaccacctcgacgtccggatccttgtcgtcgatatcgaatccgaaatcgagcaactcgatacggccgcaggcgaacgtggcgggcggcagcaccgcgcacggcttcatcgcgccgaacgtgaccgtgaccgtggccggaatgtacgggccgggcagagaaccatcgttcacaccgacgccggatggcgtatccacggcaagtaccagcggaaaatcgcctgacgactcacggtttggcagggcgggctcatcgggagcctcgccgtcgagaccaagggcggaggcgagtgcggcggggatgccgcgtagcgagccttggatgccgatgccggtcatcgcgtcgatgatcagatgcgatttcctggccacggcgatggcggtctgcaatcgctcgccggcctcaccggcggaaaacccggacgcgcaaccgggaatatcagccgcgggatcaagcaccagcaccttgcctccggcgcgcacgaatgaggcgaatccggcctcatgcaacgaccggcccacggcgatggcggtgacgttcgcgccctcctgggccagcgcggcggccgcgaacagaccatcgccaccattgtctccggccccggccagcagcacgatcgacgtgtcctccagcgccagatcctcgtcgtccagcataccggccgccatgtgggccgcggcctgggcggccatgcgcatcagcggcacgcctttgtccagcaggggtcgctccatggcccggaccgtatcggagtcataggcgctgtgcagcagcagttcgcgacgatcggcgtcttcggtgtattccatggcaacccctttcttgtgtttgttacttgcggtccgtgtttacaggccgtacacctcgtgggcgaacttttcgaacacggggatcgagcgcttgaccttctccgtgtcgatgcagtaggccatgcggaagtatccgggcacgccgaagctgtcggacggcacaagaatcaggtcgtattccttggccttcatgcagaacgccacggcgtcgtcctccagcgccttggggaagatgtagaacgtgccgccggggcgtaccacgtcgaagccgatgccggtcagcgcatcgtagagcaggttcatgttcgtctcgtagacgttgagatcggcggtctggtcgatgaccttggccacgcccagctgaatcgagctcggcgggcagttgtggccggtgccgcgcgagatctggcccatcatgggcacgagcaggtcggcgtcggtggctgtgggattcaccgcgacatagccgatgcgttcgccaggcaggctcagcgacttcgaccacgagtagcaggtcagcgagttcgcgtagaagctggccgggtagggctgggtggcgccgtcgaacacgatttcgcggtacggttcgtcgctgatcaggaagatatcgtggccgtattcgacctgcttggcggtcaggatcgcggccagacgcttgagcgtgtccgctgaatacaccgcgccggacgggttgttcggggtgttgataagcacgacctgcacgttcgggttaagtgcagcctcgaatgcgtcgaagttgatttggaagttctcggtgtcggccggcacgatggtcagcttggcgccggcgcccttgacgtacggctggtattcggggaagtagggggcgaaggtgatgatctcatcgcccggcttggtcaccgcacgcatcgcgtgggacagcgcgcccgccgcgcccgtggtcgggaagatgtggttgccggtgtatgccatgccgaaacgttcgttgaggttttcggcgatcgcgtccttgacggatgggataccgagcgagggagagtagccgtggatggccaccggatcgccgttttcgtagaggtcgaccatggcgtcggtgaaggatttcggagccggcaccgagggattgccaaggctgtaatcgaacacgttctggtagccgatttcggcaccgcggctcgtggcgtactcgctcagctcgcgaatcacggacttgccgccaagcatggccttgtattcctcattgatcatggctgttctcctcgcatggttgtactggtatgcaccacgctactactatcgcggccggtttgcgccatttgccgcgccgtgcctaagctggctgttctatttgttctatttgttctattaactgtcgaaaccgcggaataacgccgatttccgctacagctccatgattatccacaaccgttcatagcgagcgctgtgggacggcgggcggaaaacggccgaatccgcgtgccgtcccacacctcgtgcaatccacgtttcgggaaagcaccaccgtaagaccggcgcgcatccgcatccacgacaggagccttaccggccgtaatcccgcactcgattattttttctgacagggaatcgaacccgaaacactaacccatgcacgccccaccgcaaacagcgaataaccaaatgtatgcattttcggcaccatgagcgaaggagttcgcaaacacaacagtgattggcatatacggcatcgaccggatgaacagcatcgcgtcctcataggtcaagacccactgggactcgtcgcccttgggtatagggacattgcctgtgtcatagtcgttaagcagcacaagactcggcaaatatcgttccaagatctcggcggtgccagcaatttccggttcggtggacctcgatagcaccttgacgacggcgtgaagtgcgtcaagccgcttgcgattgatggtataaccatcaacgagatgctgcttcagaactgagttggcccatcgccggaaatagatgccttccttggatttgacgcggtatccgaccgacaggatcatatccaggttgtaatgctcgacttggtatgtcttaccgtcagatgcagttgtcgcaaattttgcgacaactgaaaatccattgagctcttcccttaatgcattgccgacatgcttgccgattgttttgatatcgcggccaaacagcaaggccaattgctgtctgttaagccacaccgtgtcctcgtctaccttcacatcgaggtgcacggtgtggtccgcgctctcatacaaagcaatctgccgcttcagttcctcgccagtcatgagatcgcctttcttttttcgggcgtctgtaaatcatgtcgttgtcgtcgctaaattatgcatccagtttatcagggcagtcgaacgtttgttcgattactgtatctctcatatttgtatgactttcccggctcccgccatcaatcaccagtcgcaggtaatcgcggtcggcggacttgcggcgtggcacgaaacgactgatgatggagtccttcttgccgcggttcttcacgtacaggaaaccgaacacggagaacacgaccgcgccgatgaagttgacgaccagatcctccatcgtgtcgatcagaccgatgtcgaggtagccgccgaggcccaggtcttggccattgaccgtgacctgggtaatgtcgttgatgcgaatcgcatggttggtgtgcgtggggtcgagcatcaccgagctgatggaatgcacgatggcgtccttctgcatgtcgaacccgaacaactggtccatgccgaattcgaagaactcccagatcacgccgatggtcatggagaagcagaaggacacgatcgccagatacaggggcgaaagctcgaacttcacccggtcggaccggttgagcaggtcgaccagcgagaagccgatcgccgcagcgaggaagccgttcatcgtatgcaacaccgtgtcccagaacgggaagatctcatagaacgaactgatctcgccaagaatctcagccgagaacacgaacaccagcacgatgacttccagcaccgaaggcagctcgatgcggaactgcacctggatgaacgccggcgccaacagcagcagcaacgtcaggatgcacaggaacacattttcgtagtcgccgttaaagaactggagtattgccatggcgagcaccagcatgcgcagcaccacatagaccgcgaatgagcttttgtgttcgcggatttccatgcccacggctcggctcatggttttccagcgtacgcgccaggacggtttgcgttgtgcgtcgtgctgttgcgactgtttccgggtcatccttacctctttctcgcattgttctcgcgccagtctatccgaacctgctcacaggcaatcggcaagaacgggcgatagtctggccgcacgaaccgaacggaaaccgatactgtctcgattgtgggccacgcgaatcatccgacaatgctcgatgaggccattacgccggctcctcatggctactggtcgtagggctggcaatcatggccatgccggtagtttgggctatcgtgaggtgtgcgagatgggctttgtgccggctggcagcaaatccaagcagcgaaacaacggaatgaacgaagcgaaaggaacggtatctgatgactccgattgaattgtcaacccgacgccgggttacgggactgacttcggatgagttcgccaggctgttcgtctctttgcagcgtgaagtggacggcgaagccgcgcattggagcgccacggatgtcgaatcctgggagctggtcggcccgccggtgaccgccgaacagcatctcatcgacacgttcgccgcggccaacgaattcgtggccacgcttgcggaccgcctgtaccacacgattatgccagtcacggaagaatcggtcatcaccgcatacgctgatgacctcacattctgggcatcgcatccggaccttggcggagtgccgtgcgcattatggaacatcgccgcactgcaggcggccgaatgggcccgcaaagaaaccggcatcgcctgtgaactggacgtgcgcgaaccgctggtgtgacagctgagctcaaacatgcgtaggtaacggcatggtttgaggactatggtgttgcgttatcggtcggaaaggatgtgatggtggggcgtcatagcaaaaaagcgcgtggccagtcgaggagatatgcgcgaaagccctccgtttggagcgaaattcgcggctatctgctgacagtgatcgcggtgatgctggtcgtgttgctgggacgtaccttcgtgttcaacgtatatgtgattccatcccgcagcatggaagacacgttgcaaatcggcgaccgcgtatttgcctcgcgattgactccgagactctttacactgcaccgtggcgacatcatcgtgttcaaagatcccgcagactggatggagggggagcagcttcccaccaatctgatgtcgataatcgacagcaatcgttacctaatcaaacgtgtcatcggtctgcccggcgataccgtcgcctgcaagggatccggggagcccatcacggtcaacggcaaacccattgatgaaagcgcttatcttaagtccggcgtgaatccaagcgacagccctttttccgtaaccgttactgacggcaacgtgttcgtgcttggtgataatcgctccaattccagagattctcgataccatcttgacgacggcaacaatgggctagtgccatacgacgatatccaaggtgtggcgttgttccgcttctggccatttacgagaatcggcatactgaactgagtttggcgtgaatccacgagttgatacgtgccgcacggtccggtgcatcctgcagccggaccgttaccggaaccctccccccgaaatctgacgacccccctgtctcacagctatcgtacagctccgatacgggaaacgtgcgggtgattccataacgactacgtacttcaggaagtgacgtgtatcacactatggtcatgtgttcagtcgcgcgcgacccaaagcgtatcgaggtcgtcggcctcggtcgcctttttgcgcttgcgtacccactgttgcaggaaatacgccccatagcaggccacgatgaacacgagctcggccacgagcgcgaaccgttgctccacgtcgaaaatcaccaatacgaacgatgcggtgcacaggatgaacgccgcccaagacacgtacggatagccgggcgtgcggtatttgagttcgctggtggaatggccggactccagccaacggcgacggaacacgatctggcagtaggcgatggcgatccacaccaccacggcggacaggccggaaagcgccaccagcaccaggtacacagtcgaggcggcgatcacggaagacaggagcgccagcaggccaccggccatcgcggcgcacaaggcgagcatcggcacgccgcgacggttcgttttggcgaaccagcgcggaatcatgccttcgttgcccatcgaccacaccatgcgcgtggaggcgtacaggccggaattcgaggcggagagcacggccgtgagcaccacgaagttcatgatgtctcccgcataggggatgcctatgccgttgaacacgagcacgaacgggctttcgcccacgccggccttgcgccacgggatcagcgcgcacatcacggtgattgagccgatgaagaagagcaccagacgccacagggtggtgtggatggctttcggcacggcggtttgcgggtccctcgtctcaccggcggtcacgccgatgagttcggtgccggagaacgcgaagttgacggtcagaatcgtggcgaacaccggcatgaagccgttggggaagacgccgtccttgatgagattgacgaacatcggggcatgttggtagccggcgaccgggatgacgccgaagatggcgagcgatccgatgacgatgaacgcgcagatggcgaacaccttgatcgaggcgaaccagaattccgcttcggcgaagagccgcaccgacaaggcgtttaaggtgaagatgagaatgatgcacgccgcgctccacacccatgtggggctgtccgggaaccagcgttgcatgagcaggccggcggcggtgaattcggagccgagcgccaccgtccaggtgagccaatactggattgcgatcacgaagccggtgccagggccgatgaacttctcggcatacacatggaaggagccggtcaccggcatggccacggacagttcgccgagcgtgagcatgaccaggtagacgatcagcgcgccgatgctgtatgccaggatcgtgccgatggggcccgcctgctggatggtgtatccggagctcaggaacaggccggtgccgatcacgccgcctaatgagatcatctgcaggtggcgggattccatgccgcgcttcaggttggtatgtagggcgtgctcgtctttgccatcatgtgacgactcggactggctggtttgcgctggttggttcacctgttccgaatggcttcgacggccatccgtctgaatctgcggttcctgttgcgaggacggcgactgtgccgccgtgtcggtgtcgggctgactcatgtttctctctttgccgtgcgtgcgttccataggcgtcgtcgtgacggcccggaatagtatacccgcaccgaggatatagctgcgctgcatgatgctgagtcaaaatcagccccctgaaacggagataggcactcgcagcggctacttcaccttctggatgcgcagcacggtggccaccacgtacaggccggtgctccacaggaggccaaaggccagaaacccgacggcaaatcgaatgttgtttgtttttttccatgttctcggacatgttcgatggcctcctatggttttcgttgacgttttggttattttgtcgaccatctcatattgtggaattccgggctttttgggcgtgctgttgcctttgttgcgccgttgcgatatcggtcttgtgaacggttaatctactcaggactcaaaatacattccagcctgcggcacgttcggtgttgcaggacagtaattcgaggatgagcgactttgatatgcagtgatacgccagtggcggagcgctacaagtcatggtggatgagatgtgattttcgtcgaattggtcagtgcttttggacaataccgaattggcgtcgaatcgggtatatactgggaccgtcttccaggcggaagtatggttcagaaggaatgggtagaacatcatgaacggcattgcacttggcacccggctggggtttgccgtatgcgtgctgctgatgatgccagttcttctgcccgtggcctgtgcggagtcgttgcggcagcgtttggccggtgcgtggacgatggctgcctcgcgtgggcgggtactgtcgcgtccgatgccgatggcggacatcatcgtgttgatgacgttgttgttgttgtcgttgagtgccactggctgctggattgccggcggtgattcgcagactgccctggccgccatggtcttcgtcgccacggtgacggctgtatgtgcgtgctgcgcggtcgtgctgttgtcgttcgtaggttcggccggccgccgaccgttgcccgccagcttccgcttcgatgcgacggtgatgaacgccgtccgctcatgggcccgcccgcaatggatgccacgctggccccgttacacgctccccgattcccgaatctgatttagcttctcttttcagctctcatcgttgcgccccacggtctaacgcaattgtgttgtttaggcgacatgtggatacgcatttatgcgatgttcttgtttccccctaatttggttcccctctctgaggggagctgtccgcgaagcggactgaggggagttcccagctgttgccgtaccagattgcagttgcttgaactcggaaacacatcccagattcgtcaattcatcaggaatcccaatgaacttcatcaatatcctcaaccacatcctgcgacccctagaatgggttgtcgcccaactgctcaccctgtttcaccacgccctggtcacgtttggcatgactgctggccccagccccgcgtggggcatcacgatcatgtgcctcgtgctcgtcatccgcatctgtctgctgccgctcttcctttcccaaatgcgtgcgatgcagcggatacaggtgctccaaccgcagattcaacgcatccagcacaagtacgccgcgcgcaaggacccgcgttccaaagaagccatgcaacgtgaaatcatggccttgcagcagcgatataacgccaatccgcttggctcctgcctgccttcactgatccaggcgcctattttgtgctcgctgttctacacgctgcaatccctgcctgcaatcgccgatgggaatgcggaaccgttgggcggcatcgaccacaccatggcgggcgacatcgaatcatcgtccatattcggcgtacgcatcgccgactcgttcggcacggttgcctcgccgcagtcacgcatcatcatcggcgtggccgtggcgttgatgtgcctgacgttgttcgcgatccagtggatgctcattcaccgcaatacgtcgaaagatgctatggtctcgccgcaattccgtgtgcagaagatgaccgtgttcgtctttcccgccatttacgtggtgtcgggtgccacgttgccgttcggcgtgctgctctattggttgaccaacaatctgtggaatctcggccagacgctctgtcaattgcgatggttccccacgcccggttcggcggcaggcgagcgcaaggccaggcgcgactacgagcaggacaaccgtcgccgtgccgcagccggtctgccatccctagaggaggagcgtgcgatggccgcccgcgaggaggcgaaagcccgacgcgagcgcgaaaagtcggccgccagccgcaaccgcaaacaacacaaaaccccacacctcgccaagcgctcaatcgtgaaacggtaacgcactactcgtctactggctcccctctggaggctgagccgttaagcaaacagcgaagctgtttgtaagcgagggcgaggcgacagtcgagctatgtagcgcggtcgccagaccgtcttcattacggctgaactggcgccgtagacgactgaggggagttttgctaaggccgcatgatgttgtcacattgtttttcaatggttttcacttggcgtgtattgactgattacattggagtacaacacaattgacctatacggataaatttcgcagctcaaagatggggaaacgatatgagactggcgatggcgcagatggcgatgaccgacaatatcgacgaagacgccgatagggccttggcctactacgatcaggccggtgaggccggtgccgatctgttgttcttccctgagatacagttctccccgttcttcccccagtatgagaaccgcgatgcgtcgtgatatctcatggacctgaccgaccgtcacgtcgccgcattgcagagcaagactcggcaacatggcatgtacgttttcaccgaacctgtacctcaaagctcaggacggccacaactgcgacgcttcgctatggatcaacgaacaaggccatatcagcgccgaaccgttggagatgttcctgtgggagattcgcgtccaggtcacgcagaaccaggtggccatcgccatgggcaaccgggtcggcacggagggtgatgtggcgttcgccggccaatcagtggtggtggacccgtacgtcaacgctgccagcgaggccgacgaccaagaacagttgattatcgccgacatcgatctcacacagaccgcagcagcgcgcaaacagcggccattcctaggactgcgccggcctgaatggtacgtctgacaagaacaaaccgacgtcagcccggaatcttctcgacgatggtgttcaaggtgtcgaaagcctcatcgatttggtccactacctgcttgccctggttgaccatttcggtgatctgttctgtgtggggttgcggcagcgcataaatcgacgtcttgacgcgcttcaagaccacgccggcgtcggacagatcctgcttgatggaggcgattttgggaatggacagcgtgccgtcggagaagttcatgccggacagcagctcttcgatattgaagtccaccaacgtgccctgcgcggcactgtcgattttgggcagggcgttggtcgcggcgtcggcggccgcgcccagcatgccgcgcaccgccttcacgtccgaaccgtaatatggcacgtattcggcggcctgccatggcatgccttgggtttcatcacgcgccgtgacgatgtgactgccagcgctgcccatctgctcaagcgcttgcttgaagtcgccctgctcgacggattactgcgcctcgccgattacccgttgcgccgactgccagaacagccagccggaaatgcccgacgccagcagagccgcgaccagtatcgtgagaattacggtgccgatatgtttgcgcttagccataggaccaatgtaccttttgtcccatctagcgccattgtgttctggcctttagtccatcaaagtgtccaacagacttgtcttctctgaagaagcgcatggaaatcagttatagtcgattctctcctgtagctggcgaaaaaacagatataactgattccttaacatctatcggtgtctttgcttggcttttgttgagtaacgctctgccgcatcatgcaagtgcttgaccgctatgcgtttgcactgaacattatcgttggtggtgcataggctgtgctgtccgggcgcatcacgtcggcgcgcgtggtcggcacgttgttctccatcgaccccgccatgagcgtgatcatcgccgcgccgatactgcgccagaccattaccgcggtggccgtgcttggcgtcatcgtcgtctccctcgcgggtaccctgctggtgtgggcctccggcggcgatgacgcgaatggaaaagtcggtcaataagttcctgggaaaggaacatcgaatcctgtaagagcgatgatggcgcggtccagttctcgtcttctcgtcgtcctgtttttgttttcacacgtaacgaaccccacaatcgcaccatcaacatcgtgatctcttcgggggagggcgatgtcgcttgggcgcggctgtggggattcgcggcttacaggtcctgaacgttcatacgggccagctcggcgcgacgattgatcttgtcacgctgatacaagtagatgccggccagcacgatggtggatacgttgttggacaggaacgcgatgaatgcggaaagcacgacgttccacatgttgccatacgcaccgatgtccgccctggcgaagacggtaatcgccgccacaagcgacagcagcaatgtgatggcgggcaataccagaccgggccacttgctgtccatcttcgaaagcctgatctgcaatatgatgaagccgatgcagatggcgatgagaaacacgaaaaacactacggcaaatattgtggcgccaatcatgattactctccttgcttgagctgcttgcgatattcgctgatgaggattttggcggtgtcgaagtcgagcttgtcatcgaccgcgagccgtttgatgagcgcgatatacggctcgttctcgatctgctcgcccaactggattttctggatgagccggtcgagccgaagccgaacggtggggtaggagacgccgtactgcgcggcgacctccttcatggagcctgatgcgagcagaaaccgtttgatgaacgtcatatcctcgtcatcgaggttcgacatccacggcgggatcatcgtcatatccatacctgcctccttcaatccacggcgggtttaataaaattaagtataccataaataatattaaaatcaaatagatatctgtttaaagtttttcgtagattagtttgaggtcgtgatgtaagaatgcgtacgcggacgcgaaggaccggcacatgtcggcacgcatgtagaagcatcggtcaatcggatatgcatcgacagcaccctgaggcattgacggatagccgattcctgtcatgcgatcgcttgacagcatgttgtctgattgactctttgagtgccataattgagatggcatgcgtacgcgtcggactttatggaatgcggggacgatatggttgcggacgatgaggtgcgggcctcccatggtgggcgtcggaatcaaggtctgctgtggtttttcggcgcttccgccacattgggcgtggccgccgtcacggccatcacgtgcgccgtcatccggtacggctggaatgacggggagttctggaagctggtggtgccggcggccgtggcgttggtggcggccatcgtgtgggcggcgctcggcttcatgcgtcgcgccgggcggacgcctgacgttccggccgacgcgaacgataccagcccggccgaatccaggttcgattcggcggccgcccagattctggcgatcgtcgccatcaacgtgtggggcgtcatgttcatcgtcttcgatacgttccagattgacccgtggcggtacgtgacatgggtcgtgcccgtgatgttcctgctttatctggcggtcttgggcatcggcagggcttgtttccgcaaacgacagaaggatattcgcttcccggaggaaccaagtatgacgagcagccgtccatcatacttggcataggcgggcagttggacgatgccgggcaggtcctcgttgtcgctggtctggttgagggcatattgggtgccggtcatggaacgctactggaatctgtcaccctagggtgtcactttccgtgtttacctcgacctgccatgcccctggcgcgaaggttgagaaaaacggcgtcaactttcacgacagggggctacctcatgccttggcaaaatgccggcacaccgattcaggcgctcggactggtgaaacggacagggttcgatgctcgaaccgcctcccgacccgcaaacacgcagactgttctcaataatgtttcgttggatatcgatggagcgggcttgacggcgatcgtcggtccgtccggcgcaggcaagacctcgctgctgtatgtgctgtccggattggacaggcccgattccgggcgggtgaccatcggcggtaccgacgtctacgcactgaatgaggaacggcgttcgcggttcattcgcgggcatatcggtttcgtgttccagcaatacaatctcgtgccgtatctgacggtcgaggagaacgtgatgttgccgctctcgctcgcccatcgcaaggccgactacgtgcaggtcacgcagctgctgtcccggttcggtcttcgccagagggcgaagacgacggtaagcgccctgtccggtggcgaacagcagcgcgtcgccctgtgccgtgcgctgctcatgcgtccggcggtggtgttcgccgacgagccgaccggcgcgctcgacaccgcgaacagcgagcttgtgctgcaggtgctgcgcgagctggcggatgcgggctccagcgtggtcatggtcacgcatgacacggatgccgccgctttggccgaccacgtgatcttcctgcgcgacggtcaggtcacccacatcgctggcagactcaccgccgagcagattgccgatggcatacgccgcactttcgtaccggccgggtcgccgccgctggttgcgccggcgcggtctgtcggcccgatgatggtgaacgcccagcctatccaatccgtccaaccgggccgaccggtccagcgcgtggcgtatccgcagcagcggaaggaggctcatcgtggctaggtatgtgctgcgtgtgttccgtgacaatgtcacgggatgggtacccacgattctggtggtcgcggtggtgaccacgctggtgggcatatgcatgaaccaattcgtgtggacctcgtctccgtcgttcacattggccgcgcggcaggcgggtcttgatccggccgagttcggcatggtgtcggtcacgatctatgtggtggtgtcattactcgcgttcttctcgttgacggtggtcggctcggccacggtcaaccgtattcacggcacgttcgcgcaatggcggcttatgggcgccagcccgagtcaggtgcttgccagcatgtggatgctcgtgggtgtggcgagcctgttcggttccctgatcggctctctggctgcagtgccggccagcctgctggcggttcccgagttcaacgccatggctgcggaaagcttcgccgatggattcggctcgttcgcacctcctgcgttcacgccgtcgatggccgcgtggctcggatccctgctgttgggtgtggccacgtgcatgttgggcgcgtccatcccctcgctgcgcgcagcgaagatccgtcccatcgaggtgattcgcggcacgggagccatcgggatacggcacggttggcggtcttgggcgcactgggcacttggtttgattgtcatggcggcggcgctggcattggcgttctccggcatgggcacgccacggacgctcgcgttcggccaggaggcggggcagacattcaacagcgcgctgtgggccggcatcatcgcctcgttcggcatgtacatccttgtcagcatgctgattccgattctattgggcatcggacgtgtcgtgcgtcgcctgtgcgggtccgcgaccggcgtgctcgccgcccgttccgccaaggcgaaggccgccagcaacacgaacacgattgccccgctcgcccttgccatgggactgtcggtcaccctgctgacctgcgcgcgatcctatggccggatactcgccttaggcggccatccgaagagcctgaactacgcggactcgctgctgctcataacgatgctgtgcatcgtgtccctggccaccagcatggcggtcattgccctgtcgaaccgcagcatggtcgccgaccaggcattgctgcgcagcatcggcctgtccccacgtcgtgtgatccgcatgtatctctggcagagcctgcagctggccgccggcgcggtcattctctcgctcatcccggtcgccgtcagcgcaagcgttttcgccgcaaaatccgcggcgctcgtcggcatccccgtggccgaaatcccatggccgggcgtaatcggcatgggcacggcctgctggctggcattgttcctcatccagttcacgcagattcgccccgcgctacaccgcagcgtggccgacacgatacgcacatgctgacatgcacgcaacatcatacaaaaagagccacaatgggagccatgaaaccgcaatccgcgcaggccaataaggtcacggtcctggccgtgccactggtcatcgccgtggtcgaatgtgcagcgatgctgtgggagcatgcgatcggagcgccggccgacaccatgtatacgtttgccaaagatccgctgggattggctctgctgctggcgatgaccatagccagcagtgcgatactgcttgtccgttactggctgccagccgttgccttggcgcttgaagcggtattgttaatagttgcctcgtactggcggttggactcaatcgtgatgattcagacgctcgtcgcctgctatgcgttcgcccggacagcgagggggcgcgggctgtgcgttggaggcatcggcatgatgctgtcgatgaccgcgtcggccatcatggtgcatccggacgttctcgcgaccgaatgggtgagtcgagtggtaacgctggcagccgtgggaggcggcgcgcttgcagtacgtggcaggcaacaggccaaggaagccgaacacaaagctgccgaggaatgccggcgggcagccgagctggccttccaacgcgatgccgcaatacgccgttcgcgcatagccggtcaactgcacgacagtgtgggccagggtctgaccgtaatcatcgcactgtctgagggtctggccggcaaaaccgatgacccacgcgtggaggatgcgctgcacggcatcaacgaaatcgcacgagagagtctgggcgacacgcgcaaagccgtccgcgcactgaccgagttcgatggagcggcgaacggtgacgatacgcacacccaagaatccgaccagcattcatgggatgacattcggccgattctcgcgcacgcacgccggctgggcatcgtcacggtgttcaccgagactggtacgcgcgccgatgacgaagctcaggctgatttgtgtttcgatgtgactcgcgaagccatcaccaacgccatacgtcacggacagaacgtggtgcatatcagcatcgcctggaaccacagcgagaacggcaccgtcgccgtgattatccgcaatgacggcagtcccgcgcgcaaggacgcgcgcaaggatgacggtactgggctcgtccgtctattccaccgcgtcgaatcggcaagcggcatcttcgaatacggtccaaacgaagacggcgaatgggtcgtcgaggcgaccatcccgtccaacggagtgaacgaaaaggaccacaccgcatgattcgtataatgctcgtagacgaccagcgtttcgcgcgacttggcttccaactcatgcttgacgatgcttccgacatcgtcgtcactgcccagtccgctgacggccgatccgccatcgagacgctcgaacaggtcgccgttcagcatcgtccattgccgaatgtaatcctcatggatgtgcggatgcccggtatggacggcatcgaagccactcgccgcatcaccagacgctggcccaccatcagcattctcatccttaccacgtacgacgaggacgattacgcctttggcggtctcgacgccggagccagcggcttcctgctcaaggacgtcaccaagcacaacctcatcgacgcggttcacgccatcgccaacggtgacgcaatactcaccccacgaatcaccagacaagtgcttgaacgaggcgttccgcatcccaccagcagccagcgccagcaagaaatgcgcaaagctttcgacgcactcacccctcgccagcgtgaaatctgcgcactcatctccgaagggctcatcaacgaggaaatcgccaatcaactcaccgtcgaacctgcctccgtcaaacgtgccgtgacccgtatcctcgcaactttgggcctgcgcaatcgcactcaaatcgccatcggctggttcaaagcaggcatgtagacctgctatttgctcagcagctcattcaagcggattgttgttacgaatgcgactaccgcacgccctcccaagacggattccatgttcgacaccccattcggcaaggtgggcttggcggattttagtgatggttgcaacacctgtgtgttttgccgctcttgatggcggtcttggattggtgcgatcgtatcatgctgtgttgatgagttcgagtattttctcggatggtttcctgtagccgagtgttttgcggggccggtcgttgagttcctcggcgaccgcgtcgaggtggtcctcggggtatgcgctcaggtcggtgcccttggggaagtattggcgcaggagcccgttggtgttctcgttggtgccgcgctgccagggtgaatgcgggccacggaaatacacctgcatgtccaatgtggtcgagatgcgtttgtgcagggcgagctcgcttccctggtcccaggtcagcgagttcctcaggagcttgggcaggtattgcattttccggatgacggcctgctggacgtgtttggcgtcgtgcccgtcgggcaggtgcaggaggatcgtgaaccgtgtcgagcgttccacgagcgtgccgatcgcgcttttgttggccgcgctgcagatcaggtcgccttcccaatgaccgggtatcgcccggtcctcgacttcggcgggccgctcgctgatcatgatcatgggttcgcggaaacggggcttgcgcgagtccgtctgcccgtgcggccggcgttgggcgcgcccgctcctcagggccttgatgacgtcctttttcagttcgcctttggcctggacgtagatggcctggtagatcgtctccgcgcacacatgcatagcatcattatccgggaaatcggcgcgcaggcgccccgcgatctgctcgggactccaatgcgcccgcaatcctgcgcgaatgtatgcgagcaggccgggcaccgtatggatcttcgcgggcttgggtcgtctgggccgtccgcgctcatctgctggggccggtacggctcgtacatgccggtcgcgggattcgtgttgcgcaccagctcgcggctggcggtcgacgcgggacgattgagcgtgcgcgcgatcccgcgcacgctcatgccggccttccgccagtcggcgatgctgatgcgctcgtcctggctcagatacctcgaactgatcttttggggaatgtccacggtggaacgataccagtccaccgacggtttctcgttcctgccgttcgatcgtgtccttccgttgcgccacaccttgccggtgcgtttggacacgcccaccgcccgcgcggcctgcgtgaagttcatgcccgcctcgagatgctcgacgtaccggcgtcgccgcgccgcgcacatctcgccacgcgtcgcgtactccacgccctcgaacacccacctgtccacctggccctcccatcagtcagccaggcgttgcgacgatcactggaacccgcccttcgccatttttttgggggggagagaccggtggcggcaagtgtgcgatggaagtcggatgcatcgtccttgcggatgatgcgcaggttcattcctttggccgatggatagtttcggcaaatcgagggagcatggagcaaccgtcatgcgattgcctgacatgatgttgcgtttgcggccgctgaagggtgaaatggcggcgacattgcaacgcgcgggtctgggcaaggcatcctgcctttgccttcaggcccgcctttcgtgaagggtgattatgccagttatatcggctgcgaatctctcgatcgggtacaagggttccccaatcgtcagcaacattaacctgcggttgagcacgggtaggatcatctgtctgcttggggcaaacggcgcgggcaaaaccacgttgatgaagacgctactcggacggataaagcccgtgagcggagaggtcacgtacacagggacgaatatcaatgagatgtccgcggcgatagaccatcccagtttctttccttacctgagtggtagagagaacgtcgaggtggtctccgcgttctggggtctggatgtggacccggaggcggcgttggacggtgtgggcatcaatcgcgcggcgtatgggcggaaggcgaaggactactcgacgggcatgaaagagcgtctggagctgtgcctcgcccttgtgccgcatccgaggttcctgttcctcgacgagccgcagaacggtctggaccccgatggcatagcctccttgtccgaaacgcttcgcgcctaccgggacaaggggaactgcgtagtcatctccacgcatctgcttcatgagatccagggcgtcccggacgagtgcatcatgattcgtcacggccgggccgtgcaggtcacggatctgaccggggtgaacctcgcggatctgtatcaggggaggtagggtcttgaacgccgtttcccctgttcgcgcgttggtcgcctactactggaacacgtggtatttcctcgccgcggtgtttggggccgtctcgtcccttctgctgggtgcgtggatctcaagcgcggcgaacggaaccccgataaccggagggtattgcgtctatttcaccgccacccagccgttgatctgcctttcgctgctcttcgcatgcgatgccagggtcgcgaaggcgcactacggtggcctgccgcgccacgtgtattccgcgtggacgccatgctcgctcagggccgtgttccgggccctgatcctgacctccgtgaacctgattggcgtactgtgcttcgacgccatcatggtcctgacgggtaccggaattcacccgcatctggcagctgtcctgtgcttcgtcgtgctgcagagccttgcgacctccctgatctactcgatcgtcgagatcgccgccgatcccagaaccgccggaatcgtctcggccatcctttgctatgcatggattctcctgccgggcgaccttcccgactatgcgacgccctacgtcgcgaacgccctacggaccgtcggacttaacctgaacggcaccgtgatgtcgccggcggaagcggcgagtcgagcgtccgtcggccccgtgatggtcgtcgtcccgatcgtggtgcttttggttgcctatatgctgttgagccggttccgtcgcgaaggagtggagaggaaatgaagtccctattgcgtattgagcgtgtggcggtgatccgctggtcgacgctcgccttcgtggccgtgctgctgtttccgttgttctttttgcgttacgggaacacgggtgcggtggtgcagtcggcgatggtgatggcgcttcccgtaaccgcggccggtctcgtcttctccaatgcaagggtgccctcctcgtaccgttccttcagcatccacgaccggctcctgcttcgcttcagcgtgaagtcgctgtcgctcggcgtcgtgatcaacgtctgcctgactttgctgtacgggcttgccgtcggattcgtcgtcaacgagacgctttcgtcgcgtaccattctgatgcttgcgttcaccgccgtcgtcctttccctggcatgcttcgttctgcgactctgggtcagtcctctcgtcgcctggaacgtcgtcgccttcttcatcgtcgccggacttacggtgagttccggcatgttcgaggacgcgccgatgctgtacgccgtcataccaaccacatgggtgttgaacggggtgaaattcgccggttacgtgattccggtcggcgtcgtcatcgccgcgataagcgcatgtctgctgttcaaggcggtgaaacgtgtctgaccgaagccgtatacgggtgcactgtttcggatcgtaatcgtccggcagccagctttctcaccgtattccgttgcgggagtgagcctgccgctttccgctgatcccgccatacaaagtcgactccgcacgtcgcgagtcttcgccgaacactgtcattggtgacgcagaggtcgtgtgggaatggccgtgacaggggaggggtattgggcaagcttcgggcgccgcgttcggcgcgtggccgtgtgatggcggcggccggcatggttatggtgggatcgttgggcatccagacgtcgtcgtccctgtcggcgtcgttgtttagtgcgttggggccgattccggtcagttcgatgcgcatgctggtcgccgcgatcgtcatgctcgcgctcgtccgtgtgcttcggcctgtacacgctcttcgccgaccgggtcggcaagacgggcaccgggctcgacgggctcgccttgtcggtcacggtcgcggcgctggccacttcgccggtatccatcagtcacgccccgcacatgtcggccgcccagtggggcatcatcgccgcctcggcggtgctgggagtcgcgattccctacacgatggacacgttgtccgggcgtatcacgtcggcgcgcgtggtcggcacgctgttctccatcgaccccgccatgagcgtgattatcgccgcgctgatattgcgacagaccatcaccgcggtggccgtgatcggcgtcatcgtcgtctccctcgcgggtgccctgctggtgtggtcatccggcggcgatgccgtaaacggatgattcttgtcatacgattgcttgacatggctggtctgcgaatgcatgttttaccggccgccatcgattggaatgccagcctccagctgccagtgggcttgttcggtgtgggtttggaaggtgccgacgtgtgtttcgatgatggtttggtagcggtcgaggccgagtctcgtgtcatcgggtgtgatggtgtcgctggcggagacgtggatggcgtccgtgtcgaaggtgacgcagatggcgtaccattcgcccggatggcgtgtttggcgatgttcgcgtacagttccgccagcaggttcgacagcaggcccgccagcagtcgcatggtctccggcgtgagcggccggtgtggttcggcgagcaggttgtcgccggtgaatcccggggcttcgagcctggcctcctcctcgtcgatcagcgattgcagcccggcacgctgcgcggcggcatcgacttccgtggaatcggctgtgcggggttgcttgctgccgtgcgagccttcatgcgatgggtcggatggacgttgcgggtggttttcgagcgagtcgatgacctcgtgcgtgtggcccatggcccggctggcggcgtcgcgcaattcgtcgagctgttgctggtattcgtgttcgtcggcgggcatgccttcggtttcggcgtggtcgatgcgcaggatcaggtaggccaggtcgttgccgatggtgtcatgcaggctgcgggccgtctccccgcgttcgtgttgtcggcgcagcaggtacgagtcatggtcgcgttggcgcatcacatgtaacagcaggccggtcaggagcggaaagcagtagaacgccagactctgcaccgcggccaccatcacccggctcctgctgagatcaaggccgtccatggtggaggcgagcaggatcatggtggcggatgacgccggcccgcgatctcgtcggtggtcagccgccgcgcgtacaggcgcaggatctccttctcgcgcaatgacaggggatccctcatgtcaacagacatcttcgccggcaccgtgccggacagtagcccataggcggtctgcgcgtcacgaaaacccacagcggcctgttcgtcggcgggaaggccttgagccgcccagcgtatcgccacggcgatatcggtcctcagtcgttccttcgcgaacagtccctgagcgccggacgcgatcgcctcccgctggtagacgtccacggaatacgaggtgacgcacacgatgcctgtcccaccggtcctgcgccggatgcgccggcacacgtccgcgcccgtgatcccgcccaatgccatatccagcaccaacacctccggcctggtatgcgggttgtggcaatgctcaatcgccgccgcgggagagcccgtgctccacatgacgcggaagtccttggaaacggccgagatcatcgcgcacatcgcgtccaaggcgaacggatcattatccaatacgccgatacggattgcccgcgccgaaaccccaaccatatcatcatgcctcatgccgctcatcgtagccatgcccacagccggatgaaaacctgttgtcatgcgattgcttgacacgatgtcgcgggcacgtcgcagccggaccatattgggtgttgttgattccgagtagaagaggggagctgtgatgatagagatttccggtttgtcgaaaacgtacggcggcaaacaggcgttggatgatgtgtcgtttcgagccgagcagggcaaggtcaccgcgctaatcggtccgaacggtgccggaaagtcgacgttgctgcacatcctgctcgggttggagcctgccagtagcggcgcggccacgttcgatggcagccgatacaacgaactggggccatctccgtgcaatatcgtcggctcgttcatcgacgggttgacgccgcatccgtcccggacgggactcagccatctccgttggattgcactggtcgccggcgttccgttctcccgatgcgacgaatgcctgcggctcgtgggattgcacgaggcgcgcagacggacgttcaagacctattcgcttggcatgaaacaacgtctgggcatcgcggccgcgatcctgaccgacgccccgtatctcatcttggacgaacccttgaacggcctcgacccggaaggcatccaatgggtgcgcgacttcatcaaggattacgtttcggatcaccgtaccgtcatcgtctccagccattacatggccgagctcgaactggtgaccgatcacgtcgtgggcctgtcgaatggccggaaggttctcgatggtgacatcgctgcgttgctcgaccagtacggcagccttgaacaggcgtatttcaacgtggtgaagaagtgaggctgatgaagatgacatctttgccccgccatctgtcctgccagctggtgcgatactgcgcaaactggcaattctactggtccgtatgcgccgttctggcactcaccgcgctgttcgcggtgctcgacgtgcagacgatttcctcgacggtgtccatcacggcaaacggtaccgtacaatcgcacgacgcattggacccgaacctggcgcatatcgtgtccgacgccatgctcgcctcgccctaccagacctcaatcattctcatccctattatcgtggcgttgattgtggcggcgggattccggccgggcgatgaacgccagctgcggctgctgtataaccggccctatccgttcgcggtcagtgacgtgctcgcgaccgtgctctactgcatagccgtctcactgctgtcatcactgctgaatgcggcgatactcgtggtgatgttgaatcccgcgctgcgaccgatgttcctcacggctacggttattaccacacctctgagggtgatggcgttcgccgtggtcatgggactgatcggctatatcgcggccttgtccacgaagcgtgacgtgccatcactggccgtgattctgctgctacttgtcgtttcgctatccggcgtgctgaaagtggttcacgctgatatggtgctgccgacgatcggcgggaaaagctttgcgttcggacgggacgatgaggcaggagaatttccggtggccgcatccgcaatcgtcatgacgtgttggctggtggcggtgtttactgcggcggtgatggtgcgtagccggcttttcctgaaatcgaaagtatgagaggggcgtgatgtgacgagcatggttaaagccctgatatacaaggacgcgacaacacgaatcctgcgggtcgtttgtctgctggctatgtgctgggtgtctctcgtgtacacggtcgctctgatgccgattagtttggacgcttccggaaccaacccgctgaccgtcgaaagcagcacgacacttgcctcgcaagcgctcgtgatcatcgccgctgctctggccattatcgaaatcaattcgggcgaaacggcgatagcggctctcctcgtcggttcccggcggcgaatggcgttttccctgatgacagcgaaagtcgtgagtatcgtcgttgtcgggttgatgctgaccatggtgaacgccattggaaacttcatcgcctacggacacggcgtcagcggccgtctgatgatccggtacatgatgctggtagtgatgaacggcgttgcggtactgtcgctttctttgcttgccgggaatgtgctgctcggactatccatctacttcctggtgcccatactgcttaagccgttcatcgtctatttggtgccggctgtcagtgacttgttctattcgtcggcgattcgctcgctggctgatggtgcgttgcctttgcagaattcattagtgtcgctcgtgtggttgctggttttcctgctcgcgggatatttatcaatagtcgtgcgaatccttgaatggtgagagtcgcggacgttgtagattgcgggatgagtgcgggatgcaacgtgaatttcagcgtttttcgtctatcatcccgcagcatttcttacgagtgattatggctcaacatggaaaatggcgtaatcccgcgattttaataattaatgatgtgggatgctacgtgcgtcaaacgattgatctcgatggcatcccgcagtactgcgggacgtcacgcaaaaaatggccagatctgtgtgtcatcccgcaaatgtgaagatatatttgagtacatgcatgccgtaggaatttcgggcacaagctgattgactagaagaagcgaatcatatccgtgaacaaggggagaagctcaattgaatttgaaaacagaactgcagacggaacgacttctgttacgcccgtggaaaatcgatgatgttgccgacgcgaaggcgctgttcaagtatgcaagcaatccgcacatcgggccggccgctgcatggccggtgcatgccagtgtcgaggacagtgcgcgggtaatccgtaatgtgctgagcactcccgaaacatatgcggtcgtcctgaaggagacgggggagccaatcggcagtatcggattggcgccgttgtcggacgcagtcgaccccgagcgtcgcgagccggagtcgacgcgcgagatcggctattggatcggcgaaccgtattggggccaaggactgattcccgaagctgggcgggaaatactgcatcacgggttcgaggacctgcaactgaccgcaatctggggcgtgcatgacgtcaacaaccacaaatcctcccgcgtgatggacaaactcggactagcacccgtgcgcaccgcccgccatgtgcatctcaaactgctcggcgacgtatatcgcgacgaactcgtacgccgcatcaccgcagacgaatggctaaccagataaagttcgcgcccgttggccgagcagtagtagtatggtctgctgtatcaacaggaggagtgcgaccgatgcggctgatcgagacatggctggcggatccagaacgtgcatttgacttgttcgcgaaattcccggcggaagagacgggattcgagaacccggcggttggcatggaccgtgaacaattcgccgcatacgtgcgagggttgcgtgatgagtcgcttggcgtcggcctgccggacggctgggtgccagccaccaaatacattctcgtcaacgatgagggcgactatgtgggcatcttcaacctgcgtcaccggctcaccgacttcctgcgcaacggtccgggccacatcggctacggtatcgcccgcgaataccgcggccacggctacgcgaccgccgggctcaagctcacgctcgccaaggcccgcgagctcggcatcgaggaggcttacctgagtgtccacaaaaccaatccggcaagtcttgcggtgcagcagcattgcggcgcacgtatcgaccatgaggacaagacggaatactacacacgcatcgccacctgcatggagagcgatggcctctatgcgcgaggcgattgacggcgcctcttgcgtgtaaatggccgattatcaatcggttttaatcgatttcgcctcggtcgatagagtcgccgtcgaggaaccaataatcgtgcggatttccgcgtaacgccatgaacggcgtgagttccacgccctgtgtctcagctctgctcagcagataggcgcggataatccacggatactccagcacgcccgacttgagggtgatgatttgctccactctgctgccgctgacgccaaaatccttgccgccgttcggcggtcagacccagccggctcatgttctcctgaaattcgcggatagtcgccgcgcgttgctcactgttcaaagacatggcttcatggtagcgccggacgcgtgtgggaggtcgggctgctcactggaatacgccgtcagagtagttgatcatttcgagttccgggcccatgtcttcggtttgagtcaggccggtctcatggaagccgatgtgacggtagaaaccttgggcgttggtgttgaatccggcgacccacaaggcgagccgatcgttgccgatggcgcgttggcctgcctcaaccaaagcacggccaacaccatgacgatggcaagattccagcacatatagcgaagccagttccgcagcctcggaccgtttgattggcgaacgtggcgtttgcagaagctcagcaaaaccaatcacgtggttgttctccaaagcgaccaatacgacctgattggggtctttggcgtgactgcgcgtcagtttgagcgcgaattcgggagtgatcgcatccacgattccctgcggaatatgcccctgattgagttcgcgccacgtgcacgactgaacttgggccttttcctcaaaccatggcggctcaatcggaacaatacgaatcgtcatgccgcccatagtaggccggttcgtgagtacagtgtcacttgttgtcatgtgattgcttggcatcaggttgtattgaccgtaatggaggccactggatcagcgccggaaactcatggaattcgggctattatgatgggagtaagaaaagcacagcacaattgaacataaagacgatctggagcattgcatgagcgtcaatacggcatttgaaaccagtgatttgcccaaagcggagtttatgtttcctgggcctgaacgcgatcgcttggtgaagctcattctggacggcgtaaaaaccgccaccgctgcgctgatgattgaatatgaggaagaggtcgaaccgctgccgtgcgttggcgcgcattcggtgttggtggattccgatgaacgacccgtagccgtactcgtcaccactgcggttgacgtgattccgctcggaaaagtcactgaccggtacgccatcgatgagggtgaaggcgacgtcacggcggcccaatggcggagcgcacacgaatctttctggaattcggcggaataccgcgatgaattcgccaacccaatctttccgttgaacgacaactcgctcatagtattcgagcatttcgaagtcgagcaacggttggagtcgaataacgcattaggttaggcgatagcaaaacttttcttcaggcaactctccgagctccgcaacatctgaaggaatgcccatgtccactagagcgacagaagcggaaagcgtattgaaggagcatatgggatatcttccggtatcggaaatggagcgtcgaggagtttcccgcacggagatttcgcgattcgtgcgtgaagccaagcttgagaaagcggcaaagggcttatatgtttcaccgaatgcggagtccgatccgctgttcgaattgcagtatcgatatccgaaagccattttttcgcatgaaactgcgttgttcttgcttggagagggggcgagccccccctgacaccgacgattaccttaccgcaatcatcaggtacggctcgtctcaagaatgaagacgtaacagtgagaaaggtggccgacaatcgctttacaattggcctggcgtcggctatcactatgttcgggcatacggttcgcgtttatgatttggaacgaaccatttgcgatttgttccgctcccgcagcacagtggatccgcaagatttgcaatccgccttccagaattacatgagatccgcgcacactgacttggtcaaactcatgaactacgctcgcgaatttcggctcgtgaacgtgatgcgcccttacctcgaagcggtgatgccggcatggttcaccggcgaattcatcttgtaggcagattcagcatcttgtaggtagctggccttggcgagaggtcattgcaatggcggtattccgatcatcgccattggaatcatctgcctacaagagcacgaaacaccctacaagatgagacgggccagttgggtcagtcccattcatcctgccggttcgcaggccgcaattgtcagtcacaactggtgcatcttcctcatccatgcgaatgatacgaatcgcctttcatcccaatgatttcgctctcatggccgatacccgcatgccgtcatgttccgtaccttggaatcagaagtcgagagtcatggtccgaaaccgaacggagcgggccgaagcagggagcattgaagatgggatttcttaagaacttttccgaaccgtttgcgttcgcgctggcattgtggccgtttgtgtccatgctgctgacggtgccggtgctggcgctgctgtatcaccgcgacaatcgcatccgactgtcgtcggccatagtggcgtatggcacggtgctgtatctgctcggcctgctgtgcttcacactgtatccgatgccggccgatgcggcggcctattgcgccgcgcaccatctgacaccgcagatcaacccactgcagttcatcggtgacatccgtaccgatggtctcaccgccgtactgcaaatcgcgtttaatatcgtgttcttcctgccgttgggcttcatcatgggccgtatctggcgttggccgctgccggttaccgcagtactgtcgttcgccacgtcgctgtttctggagacgatgcagctgaccggcctcatgggcgtgttcccgtgcgcctaccgtctgttcgacgtggacgatctcctgtggaacacgaccggcgcgctgatcgggttcgcgctggccatgttctcgctgcgcctgattccggcgcgggtcgccgatacgacgccgaccaccacacccggcttcatgaggcggctgatcacgttcatcatcgacatgacgctgatcgggttcgccgtgatgccgacgcatctgttcgtcatgatcgtccaatcgaacctgccctcgggctccaacggctcatggcagtcgatggaaccgttcgactggaccggctcgatcctcttcctggcggcgctcatcctcttcgagggcgtggtgccatggttgcgcggcggctgtacgctcggcggcagcttcacgcatatgacagtggaaacccggccgcgagaaggctggcggcgtgcggcgttctatgtggcgcgcatggcgacgctgatcgccgtggtgtggtggcatagcggcggattcaatctgctggtgttcatcggcctcggcatcttctggatggtcaagcatcagatgccgtacgacctgatataagacgtaattcgccgaaaaagtggggctcttggctttcaaggggctgatttcgtccggtggggacatctacttggctttcgaggggctgctcaaacgccaaaccgcaagtataaacggctttgtggcaacgacataacgccatttcagagccttgtctacttgggcatcagccccttgaaacggggatagacctccggcgaacgccgaatcagcccctcgaaaccgagttaggcgctcttttcgtgtttgagctgccgttcgagggcgtaataggccgcataacagcaggcgacgaacggaatcatgcaatcagggtcgaacgttgcgtctcatcgagcaccacgagcaccagcgcgccgatgcacatcacgatggccagccacggcagcaccgggaaaccgggcgcacggtagtcgagctcatcggcgctgtgcccgtccctcgcccattcacgccggaaacggatatggcacacgcacacggagaaccacaccaccagcgtcgccaaaccggatactgcgaccaacaccaaattacacggtcgaggcggcgagcacggaagacagcagcgccagcagcgaacccgccatgctgaacagcacggcccacaccggcacaccacggaaattcgtcttggcgaatcgcgcgggaatcagccgctccttggccagcgaccataccatgcgcgaacaccaccacaatgaacacggccgaccacacccaggacggcgaatgaggaaaccatcgctgcatcagcagcccggccgccgtgaactccgatgcgagcgccaccgcccagttcagccaatacaggatagcaatggtgaacgcggtgccggggccgatgaaccgcttcgcatacatgtggaagctgccggcatacggcatggccacggacagttcgcccagcgagaccatcacacagtagacgagcagggagccgaccgcgtaagcgaggatcgcgcccaacggccccgcctgatgaatcgtatagccggagctgacgaacaggccggtaccgattacgccgcccagggagatcatcgtcaggtggcgcgactccattttccgttcgaggccggtatcgtccttgggtgtgccggctgccgccatgctcgggtctcctttggtcgggtgaacagttgtgtctcgtgtcggttgtgcgggcggcgctcgatgcctcctaccatatgatagcggtaacacgaacagcgagtggaacacgaggaatttggaatgacggaactgtatatcggatcgcatctgtcgacggccggcggatggaatgcgctgctggaacgctcccatgaggagggcggcaccgcgttcgcgttcttcccgcgatctccgtatggcaaacgttccaaggcgctcgacccggccggtgcggcggcgttcggtgcgcgtctgaaggctgagggctatgggccgttggtcgtccacgcgccgtacgtctacaatctggccggcaaggatgaggccaagcgcgcattcgcgatcgaggcgttggccgaggacatcgagctgctgaccgccatccgcgcggccggccaggaggtatatatcaacattcatcccggcgcgcatgtgggccaaggcgccgagaccggctgccggctgattagcgaggggctgaatcaggtgttcgagcgtgcggatggcgtcatggtgcttctggagaccatggccggcaaaggcacggaatgtggccgcaatttcgatgagctcgccacgatcatggatggcgtggagaataaggcgaacgtcggcgtcacgttcgacacctgccatgtgttggatgctggctacgatttggagaacgactacgacggcgtgatgcgccagttggatgaggtgatcggcttggccagggtcaaggcgattcatgtgaacgattcgcagttcggcctcggctcgcataaggaccgtcacgccaacatcggcgaagggcagctcggcatcccgttcttcacgcgactggtcaacgatccgaccatggccaagctcccgatgattctcgaaaccaaggagcagacgccgaccacgcaccgcgacgaaatcgcgctgctgcgcgggctggtggactgaatcacatcggcagttcagcaccaccaccggcagcaacggcacctactggtccacctaccaacggtgacatcgttgtcatgcgaacttcatataccacaattccacaatatgatttcatagttatgacactgtgatacatatatagcaaacaatgattcagtgacgatctctcgtcaaagatgttccgtcaaaacaggcgcatgggctcggtcgaatccaacggctgaatcaggcgtttgccgtcgccctgcagcggggcgacctcgtgaaattgcaagcggcgggataacgcagtgcctgagttccgcacgccggcgagcaaggatgcgccgtcgattgtgcggtccagccacggcgtcccattccaagtcgagcgcgaaacgtctgtacatgcgtgccagtttatgccaatgttctgcctaagccggaatcgcctgcgaaagcccaaaatgtaggacgggttcggcaatcgggacaggacgtgacctagagtggcgcatgaccgaacaccaacaaagggaggaccatgtcggttttggacgaactggtggcgggagcgctggaggatcagcgcacccgtgagctcaccgtatcgcttgaggatgtgaagaaggccacgctggcggccccggctccgattgacgcgacacgatggcttaagcgcgccgacggcatccccgtgatcgccgagatcaagcgcgcgtctccgtccaagggccacctgtccgacatcccggacccggccgcgctggcccgcgagtacgagaagggcggcgcaagcgccatctccgtgctcaccgaaggccgcaaattcctcggcagccttgacgatttcgacaaggtccgcgccgccgtgcacattccagtgctgcgcaaggacttcatcgtcaccgactaccagatcttcgaggcccgcgcccacggcgccgacctggtgctgctcatcgtcgccgcattggacgacgcccagctcaagcacctgctcgacctggcgcacgagctcggcatgaccgtgctggtggagacgcacacccgcgaagagatcgaacgcgcccgcaaggccggtgccaaggtgatcggcatcaacgcgcgcaacctgaagaacctcaaggtggacgtgaacaaatacaacgaactcgcggccgatctgcccgatgacgtcatcaaggtggcggaatccggcgtattcggcgcggtcgaggtcgaagactacgcccgcgcgggagcggacgcggtactggtcggcgagggcgtggccaccgccgacaatcatgaacttgcagtggaacgactagtaaaggcaggagcacaagtgaaagcatccgaaacgaccccgctcagcgaacatcagggaccgtattggggccagttcggtggccgctatgtgcccgaggccctcatcaccgccctcgacgagcttgagcgcgtgtacacgcaagccaaggccgaccccgaattccacaaggaattcatgacgctccagcagcgttacgtgggccgcccgagcccgctgaccgaagccccgcgcttctccgcacttgtcaaagagaagaccggtctcgacgcccgtatcttcctcaagcgtgaggacttgaaccacaccggcgcgcacaagatcaacaacgcgctcggccaggccctgctcgtcaagcgcatgggcaagacccgcgtgatcgccgagaccggcgccggccagcacggcgtggccaccgccaccgtgtgcgccatgctcggcctcaagtgccgcatctacatgggccagatcgacgcccgccgtcaggccctcaacgtggcccgcatgcgtatgctcggcgccgaagtggtcgaggtgacccttggcgacaagatcctgaaggacgccatcaacgaagccctgcgcgactgggtcaccaacgtcaaggacacgcactacctgctcggcaccgtcgcgggcccgcacccgttcccggccatggtgcgcgacttccagaagatcatcggcgaggaagccaagcagcagctccaggactggtacggcatcgaccatccggacgcgatctgcgcctgcgtgggcggcggctccaacgccatcggcgtgatgaacgccttcctggacgacgagcgcgtgaacctctacggctacgaagccggcggcaacggccccgaatccggcaagcacgccatccgcttcgcccccggcaccggccagctcggcatgttccagggcgccaagagctacctgctggaaaccgacgaaggccagacgctcgacacctactcgatctccgcaggcctcgactacgcttccgtgggccccgagcacgcatggctcaaggacatcggccgcgtgaactacagctgggccaccgacgaggaggccatgaacgccttccgtgacctgagtcagaccgagggcatcatccccgccatcgaaagctcgcacgccgtggccggcgcgtacaaagccgccgccgatctgaaggccaagggctatgacaaggccgtgatgatcgtgaacatctccggccgaggcgacaaggacatggccaccgccggcaagtggttcggctacctgaccgacgaccaggccgccgcgctcgatgtgaccggcgcccacggcaatactgtcgcctgaaccagaagaggagatttttgattatgaccaacgaagcaaccacgccgtccggccagccgctgggcatcagccacaagcccagcaagtcgggcgctatgttcaccaagttcaaggccgagaacaagcccgccttcatcggctacctgccctacggcttccctaacccggacgtctcgcttgacgccttcaagacgatggtcgagcacggcgtcgacgccgtggaaatcggcctgccgtactccgacccggtcatggacggcccggtcatccaggctgccgcctccatcgccctgaacaacggcgagaccatcaagcgcgtgttcgaggccgtcgaaaccgtggccaacgccggcggcgtgccgctcatcatgagctactggaacctcgtgtaccactacggcgtcgagcgtttcgcccgcgacttcgagaacgccggcggcgccggtctcatcaccccggaccttatcccggacgaggcgggggagtggatcgaagcctccgaccgtcacggactcgaccgcatcttcctggtctccccggactcgtccaccgagcgcctcgaaaccgtggcccgcaacgcacgtggcttcgtgtatgcggccgcccgcatgggcgtcaccggcgaacgcgccaccatcgacgcctcgcccgaactcctcgtggaacgtacccgtcaggccggtgccgagaacgtgtgcgtgggcatcggcgtgtccaccgccgaacagggcgccaaggtcggctcctacgcggacggcgtcatcgtcggctccgcgctcgtgcacaccctgctcgcggacgacaacaagaccgcacgcgacccgaaggaaggcttgaagctgctcgccgccaagagcgaggaactggccgaaggcatccacaacgcccggtaaacacccggtgcgcctcacgcgggttgtgccgtgacacggtagggtagtcacagagcgtcaagcacaacccgcgcgtggacacacaccatgagcaccagcaagtagaggcacgatgaatctggcttatattccctcgccgaccttctccaagttcgagatcggcccgttcactatccacatgtacgcgatctgcatcctgatcggcatctgcgtggccgtatggatcctcgccacacgttggaagcggtacggcggcaccttcgaccagattctcgataccacgctcgtcaccgtgccctgcgcactggtgggcgcgcgcctttaccactgcatcaccacgccggccgactacttcccgcccaccggcaacttggtcaacatcctcaaggtgtgggaaggcggcatggccatcttcggcggcatctccgtcggcaccttggtggcgttcctgtggtgccgtcacaagcactatccgttcgcgatcttcgccgatgccatcgcccccgcgctgcccgtggcccaggccatcggccgactcggcaactggttcaaccaggagctctacggctggcccaccacgttgccgtggggcctgaagctcaacgacgcggacgccatcggcaaatccgaaatctgctattccggcgcgcaatgcccggactacaggaccacgctgttccacccgacgttcctgtacgagatgatctggaacctcattggcgccgcgctcatcatctacctcggccacaagcttgccgaccggctcaaggccggccagcagttcgccatgtacctgatgtggtacggcctgggccgcacctggatcgagaacgtgcgcatcaactattccacggtgatcctgggcctgaggaccaacgtgtggaccgcgatcatcgtcttcgtgctcggctgcatcctgttcgtcgtgctctaccagtacggtccggaccccaaggcgcaggcgcgcgggcttgcggcggtcaccgccgacgagctcgaacgccagagcatcgaagaggaacaacttcgccagaaaaagcaaaccaatcgcactaagtgacaccacgataaacagcgccgaaacagcgcgaaacacggggctccaagtcccattgcacagataaggtaggaaaccatgagcaatatcgcaatcgcacccagcatcctgtccgctgacttctgcaacctcgaacgtgatctcaaggccatcgccaacgccgacctggtccacgtcgatgtcatggaccatcatttcgtgccgaacctgaccctgggcgagccgatcgtcggccgcatctgtcaggtcaccgatctgccggtcgacgtgcacctcatgatcgaggacccggaccgttgggctcccgaatacgccaagctcggcgccgcctccatctccttccacatgggtgccacccacgcccccgtgcgtctggcccgacagctgcgcgagatgggctgcaaggcctgcttcgccgtgcgtccggccgaaccggtcgagccgatcttcgatatcctcgacgagttcgacatggtcctcatcatgaccgttgagcccggcttcggcggccagaagttcctcgacaaccagatggccaaggtccgccgcctgcgcgatgagatcacccgccgtggcttgaagacccgcatccaggtcgatggcggcgtgagccccaagaccgcgcacatcgtggccgaagccggcgccgacgtgctcgttgccggttccgccgtgtacggcgccgagaatcccgcccaagccatcgacgacatccgcaccaaggccgaggccgcgttcaaggcctgagctccaagcctgaaccgcaatccacctttcatccataaccgcaagaaaagaatctgaatcacatgaagacgtttgaatccctgttcgccgaactgtccgaaaaggcccagacccgccccgaaggctccctgactgtcgacgagctcgacaagggcacccacttcatcggcaagaagatcatcgaagaggccggcgagacctggatggccgccgaatacgagggtgcggaccgcaccgccgaggagatgagccagctgctctaccacgtccaggtcatgatgatcaagcacggcctgacgctcgaagacgtctacaagcacctgtgagaggaacgcaaatgctgagaatcgcagtgcccaacaagggcatgctatccgaacccgcgtggaacatgctggccgaggccggctaccgtctgcgcaccaaccctcgccagctggtcgtgcaagatcccgacaatggcatcgagttgttctacctgcgtccgctcgatatcgccgtatacgtgggccgcggcgccatcgacgtcggcgtcaccggccaggatctactcaagaactccggtaccgccgcgctcgagcacatgccgctcggctttggtgcctcgaccttccgtttcgccgcaccgaacgaatccccgatcaccaccctggaggatgttcagggcaagcgcgtggccaccacattcgataagctcgtacacgactatctggtcgagcacggcatccaggccgagaccatccatctggacggtgcggtcgaatcctccgtgcagctgggcgtggccgacctcatcgccgacgtggtctccaccggtaccaccctgcgcaacgccggcctgcgcgtgtttgccgaaccgctcatgcactccgaagcctgcctgattcgttcgccgcgtctgaacgagcaggactcacgtctggccgtgctgacccgccgtctgcaaggcgtgctcactgcacatcagtatgtgctgatggactatgacattccgatcagcaaggtcgccgccgccgtggccgtgacccccggctttgaaagcccgacgatctccccgctgcacgataaacagtggaacgccgtgcgagtcatggttcccaaggccaaggtcaaccagctgatggatgatttgtacgaagtcggcgcacgcggcatcatcgttaccgctctacaagcctcccgcatgtagactgttagtcgatatgaccaaccagaaagtcaacaccagatacagtccggaagcacgtgacatctatttcaccgtgcccaatttgatcagcgcgctgcgaatcatctcgattcctttcatcagcgtgctgatatccaagcacgagatgattgcggcgctagccctgatcgccatttcctcggcttcagacggacttgacggcatcatcgcgcgcagattcaaccaagtgagcaagatcggtcagattcttgatccgatcgccgaccgactgctcattttctgctcgattctggctctcagcgtcgccggcatcatcccatggtggatgctgattatcgtgggactgagggatctgtggatggcgattcaggtgctatggcttgcccagtacggttatggtccgctgcccgtgcatttcgtgggcaaggccggtaccgcgctgctgatgatttccatcgtcggtctgattttcgccgatttgggcaccagtacgtttttccacttgctctacatcgccgcgctggccgccggcatctggggcatcgccatgtattggctcgccggatatatctataccaagcagggcgtcggattgctacgcaaggaactgggggagaagtatggcgcttgaggccacggccccggtctcattccccgtacccaaggagaatgagccggtacgacgccgcgccgtgttctcccactcagtccgaggcgcggaatcacatcatgcgctttccccggatgacgccgccgccatccgcaccagacgtcgccgtaaaaccaacgacgattcgcttcagctcatcgatgatcttgtcaatcgtccgatggatccgatgttctccgactcacgactggtccatgagcatcgttcgaccttctccatctggtttaatcgcatcgtcgtattcatcatctgcgtcggcgttggctttgcctgcagcctattcgtgcaacagttgcaatccgatccgcgtaagcaggtacggcagactttggccacgcaattggagaatcgcaactcgcaaatagacgaactcaccacggacgtcaataatttgcgctcccaagttgacgaacagtccaagaaaatatccggcagcgtgaaaagcgatacgcttatccaagacgaaatggtcaatggtgccacggtggtcgaaggcgaaggaatcaccatgacgctggccgatccaatcgcggcaagccagtcggatcaatcctcctcgacgagagtcggcacctccacgaacatccgagtcatcaccgatctggatctgcagcaactggtctccctgatgttccaaaacggagccgaagccattgccatcaacggtaataggctcggcgcgcaaacctcgatacgcaaggccggcgggcatattctcatcggcatgaccgcgatacaaagcccctataccattgaagccataggcgataagagcgccttggccgaagcgatggggaagaagaaacttgcaagtctttacgattccttcaaggaagccggtatctacccgcaggtgagcaaatccaattcgattacacttgaggcagcagtcactggcgaagtgaagtacgcggaaaggaatgaataatggcagccgttctgggactaatcatcggcgtcgtcatcggcgtgttcgtcaagccggacattccgatcatcgtgcagccttatctgccgattatggtggtcgctgctcttgacgccctgctgggtgccgcgcgagcctatttcgagcgcagcttctccgaccgcgtgtttgtgatctccttcctcgccaacgtggtgacggcaacactgctcgtgttcctcggcaaccagctcggcgtcggttcgcagctgcagacagccgtcatcgtcgtactcggcatccgcatcttctccaacgtgtccgcgatcagacgcttcatcttccgaggctgacaagggtactgacgtatggcacgtaaagcacaatcagacaacatgctggagaaaatgcgcgaccagcatgcacaagacaaggtcaacgaccggatggaaaccgggtcgtttcccacggtgcgtaagaagccccggaaggatctcaaccgtgccagcaacaaatcacggttactatcctcgattctcatcgctctgatgtgcgcgttgttgggtttcgcctacatgagccagatcaataacactaaatccacgtacgaaacgatggacgagagtgaactggtaaggctgctgaacgagtcgaatatgcaaatctccaatctcgagcagcgtaaaacccagttgaacagccagctcaactcgctgaaatcggcggctaacgagcaggagcaggcgcgtaagatcgccaagcaaaacgaggagaccagcggcttgatctccggcagactcccggcaaagggtcaaggcgtgaccatccgaatcggacgaggcttgacgactaaagtggacgcctcaatcatgttcaaccttatcgaggaacttcgcaatgccggtgccgaggtaatcgccatcaataacgtgcgcgtcatcacctccacctacattcaggacgccgaggaaggtttgatcgtggatggcaccaccatcaagcccacatacacggtgaaggccattggcaatccgcaggaactgtccaacgcagtcgatatcgccggcggtgtgggcgctcagctccaggtgaaatacgggtccaacgtcaatgtacagccttctgacagcatcattatcgacgaagtacgcgaagctacgcaaaaccagtatgcaaagacggtagaataggggattatgaccaacccgattcctagcgcaggcgaaaccaccattatcggcctgcccgcgattaatgtactgcccattaccaccaccggcgatcgaccgctgactcaagaggatctggacaccatcaccagattgtccgagggaacggcattgctgatttccgccaggggagcggtctcaggttctcgttacttgcttgacgaggatgaaatcaccgtcggccgtgatccgcgagctgatattctgctcgacgactccaccgtatcccgtcagcatgccgtgttccgcagggtcaacggtcagttctttgtggttgacgcaggaagtctgaacggcacctacgtgaaccgtcagcgtgttgatcaggcgacgctgaagaacggcgacgaaatcatgatcggtaaattccgcctcgtgttcttcacgaaatctgccattatttcccaatagtccacacccagcacggggttagactgattgcagaaattgcaatcatgtgattacaccagtgtgagtcatatgcgagacacgcatgagttaggggagtgccatgggacagaccgggctgcatcttcatgtttcgcttgaggaccgtcagaatctgaacgctgacgcgattcagggggagttgttctccaacgtcgatactgaggagatcaagcgcggctaccgtggcactgtggcctccaaggtggccggcatcacgtaccgacagctcgattattgggcacgcaagcagattgttgagccgtccatcacgccgtctcatggctccggttcacgacgactatactcgtttaaggatgtggtgattctcgctgtatccaagaagttgcttgatgccggtgtgaatctgcagaacgtaacggcggccatcggattcttgactcaacgcagcaccgatcagctggccaatgtgaccatcatgtgcgatggtcaaaacgtacatgaatgcacaaccagcgaacagatgctcgaactgttgcaaagcggtaaggcagtgttcgccgtgtcggtgggttcgttgtggcaccagattgagacggccttggaacaggaagaatatgttgatcttgaggccaagccgctgacgattgccacgggccgtccgattgatgaactgactgccatgaggatgcgcaagaagctcgaggcacagcgcttgcaacgcgcaaccgcctgatacatgtatggttgttggcgacttgccggctttggtcggcaggtcgctttgttgtatgtgttgcttttgttgcctgccatcttatgtttttatatgttgcggtgattattatgactgattggaggaccgggtgaacgggattgttgtcggattgttgccgggcgttctgtggatggtcgccgtcatctttgctgtgtccatcatcactataacggtcagccgaggtcatctgttcacgccgaaacgccggcgaccgccggtcgatccggtcgactggtcgatggtgaaaacgcatttcatgtcgtttgcggcggcgctgatcccgtttcccgtgttgacgtttacagcggatctgatgaacgctcgcatgctcgcgttctacgaccacgcgcaattgcccggagcaatcatcatattcgcgctggtgctgctggaactcatcgccatgtatctgcaggcacgcaacgcttcggaaaccgaaatggacaagcgtttgggcgttgcttctcaccggaataaggatgatgttgcgaagtagccgattctctgcggcgaggctaatccgcaactagatactactggttcggctaaaatcaccacgtactattagccgataatgtacgttatgtcagattagttatccttgacaaggattcggtcgcctgtatcaactagtccacgcataccaaggccgacagccaaaggagcaccggagcataccaggccaacagccaaaggagcaccggagcgaccaccgcaattgcaagaatcgccgtgcctttcagccaatccttgtcatctcgtttccagtggaatgctcgccaaatgaaccatatcagcatgggaatctcatacagcgacagcaatggcaaaccgatgaaaaccaggtcgaagcccgcggcgcaggctccatcgcatcccatcatgaagaagtcctcgccgttgtgtttcagtgcgtttggaaataacggtttacggcttcttcgatctgctcgggcttctcgaggatctcgtacgcgccgtgttcctccatctcaccggccggagcgtagccccagcggcagccgatggcgtccaaattgcaggcgtgggcgccgtcaatgtcggtgtagcggtcgccgatcatcacggccctgtcccccgctgcagcatcaaaaccgattttgtcgaagcagtaccgaatcacctgatctttgtccagacgggaattgtctttggaagcaccatagatgccgtccaacagttcggtcaggtggaaatggtcgcagataggcatgcactggtattcgggcttgcagctggccagtgccaggtagtaaccgtcggcatgcagtttgagcagctgttcacggatgcctgggaatacgacgttcaccagtcgtccgggcaccttgttgccgggctcgttcggatcgtcgaacacggcacggtctccgtagtagctgcggtagatgtccacggcccgatccagatcttccgcaggcacatgattgcgacgcagagattcaataatcgccggtccgatgaagcgtcgcagttcggcggcgtccggaaccggtcgaccgatctcttcgaaggtcttgatgacggagccgataatgccgccgtcggacttggtaagcgtgccgtcgagatccaacaggaccactttcatcggatgctgtgccattgagattccactcccccttgttcatgtcgactgctttgaatggtcgtcaaacaatgcgacttgttccaacaatgattatgcccagtcgggatgactgggcatcaagttcacgtgttgttcagtaggagatcactcgtagtcaggaatccaaccgtcacggtgcatttgcaggcgcttttcgagcagggtggccagttcctcttcgctacggcgttccagcagcatgtcccagtgggtgcgggtgggtttgctgatttcgtcgccctcacggtcggcgtcgccctcacggtgggccacggaaccacaacggcactcccactcgtccgggatttcggcaccctcggcaaacggcaggatggtgcggtggcccttcgggcatacatacgccacatcgtttcgtgcggcgaaatcgacgttgtcgtcggactccagcgatttcgctccgatgctcatgcccctgaggctacgttctgccatatcggcatcctccttgaaagatctttaaccctactaatttacgcaacagttcggacttggccgctattccaagcttccgacgccggctgacaaactcccatcaaacggcccccgtcagtccacgccggagtaggccaccacgccacgattgacccggtcggccgcttcgtgggcgaggcctgccagccgctctcccccgtcgaacggcagcggctgggcgacagcgatctgctgcagcacgtcagccagtcgtttggcagtgcgcacgaagtcgccgccggtcatgtcggtgccgtacaggcacgatcccagcgaaccgccatccgcccattcatacatgacgtcgagaataccgaagtccggccgctgcatctcgtccagaccgtgatcctcgcacaggatatcgatgtcttcacaaatgcccttgagcttggacgaagcgatggcgatgggcccggagatgccgcccgggtagtgcctcggttcgctgtctcccccgcgtctggcctcgtataccagtgaagagagcacagcggccagtccgttggcgtcgagcttgtcgaacgtgccggcgagcagcgcctcgcacagttccaggtcatgttcactgtagatgcggcgcagcagcgagcctttttcggtcaacgtcatgtcaatgtggccggccgcatcttcatgacgttcgaggtaaccaagcccggtgagaatatcgcagatgcaatcgaactgacgtgccacggacccggtacgggagtcgtagcgatcggtgacgcgctgcagttcgcgggtctcgcgggcccagcggtggccccacttgaggtgttgctggaggtccgggcagttgcggcatggatgctcgtgttccgccttgcgcaaatcgcgaatgcgctggtcaaggttctggaaggcgcgtgaacgctcctgatcggtcaggaacacttcgtgcttcagtttgcggcggccttccttttcgatgtcgctcagctccatacgcagggtcatgaactgtttgaagtcgccgtgttcgcatgcgaacgcctgttcgtatccggccagtgcgttcttcagtgtgttgatctgcgattccagctgccaggccgattcgttggcctcccactgggcaaacgactggtccagggtaacgcgcgcggtctcgtagtcgctggagttgagcaggttcacggccatgttgaacgtgggtcggaagctcgagtgcagcgggtagacacgcttggatgacagcgcggcggccgtggcgggtacaaaaccgtgatggtcgaccacgatggcgtggccgatggtgtcgatgccgcgccgaccggcacgaccggtgagctgcgtgaattcgccgggcgtcaggcccacatgaccggtaccgtcgaacttctcgagtttctctaccaccacgcagcgggccggcatattgatgcccaaggccagtgtttccgtggcgaacaccattttgaccagaccttcttcgaacaatcgttcgactatctggcggaacagggcaatcatgccggcatgatgcgaagcgaagccttcttccaacgcaaagcggaacttggagaactgcagggctttcaggtcttcctgagtgagttgcccctccaccatctcatccacgatgcggcgaatcttggtcacttcctcatcggtggtgagctccagtccagcgttgatacactgttccacggcctggtcacaaccgttgcgcgagaagatgaagtagatgccgggcaacattcccagaaagttaagctcgtccaccacggcccagcggcgcggggtgtggcgttccgctttcggggcatggcccttggcgcctttgccgccgcggcctctgctgaagcccttgcgcttatcggggcgttcctcgccgcgccggcgtgcggccttgcggtccaactggtcgagccggttgatgagttcggcgttgagcttggtggtctgctcgccgttgccgtcgcggcgatagagatccagcacctcaggctcggtgtgttcgtccgcctgcacgatgacgtgctgttccaaaggcacggggcggtgttcgctgatcaccagtttggtgtcgcctcgcaccgaggcaatccagttggagaaatcctccacgttggacacggtagcggacaggccgacgatcttgaccgtcttgggcaggtggatgatgacttcctcccacacgggcccgcggaaccggtcggccagatagtgcacttcgtcgagaatcacgtagcgcagtgcgttcagcgtggtggaacgctcgtagagcatgttgcgcaacacttcggtggtcatgaccacgatgtccgcctcggagttgatcgaggtgtcgccggtgagcaggcctaccttgtccgggccgtacacgtcgaccagatcatggtatttctgattgctcagcgctttgatcggtgtggtatagaaggctttgacgttgcgttcctgggcgagataaatggcaaaatccgctactacggttttgccggcaccggttggggccgcgaccagtacgttgctgccggcttcgagcgcgtcattggcttcggtctggaagtcgtccagttcgaagggcagggattcggcgaatcgcgctgctgcggacgcccgatggcgctggactttttggaatgatgcgtaccgctgcgaagggctcagcgtctgggaatcggcattgcccttatggtgttggtgacgtgccattgctgctttccgttagttgttgaatcgcttccagcgggcccatgcctgggtgtggcgttcgcgcttggcggccttgctgcgaatcacgtccgcatgggcctcggcataacgattctgtgccacgctgagcggctgagtgaacagaggcggctcgctggtgtcggcagaggtgccagactcccccatcgcggccacgcgttcaccgagctggccgccgatgtcggacatgtctttcaaggcacggattccatgaagggctgcatagatgagtccggcaacaatcatggccagcatgaacagggccagaatcagccatatccaccaaggcatgaaaggctccttacttgttctcgctgatgctcagttcgcgttcggcgcgtgccacgatcatggtgcgcaacgtttccggggcgaccgccgtgatatgacgcgcgtgtgcgatgcagaaggccacgaaccaggagtcggaggaaacggtcagatgcaccttttcaccggcaccgcattgttcgacggtagcgcccggcaatgtcttgatgaatgccagatcgcgctgatcggtgatgaacaccgcgtcggtaccgttgtcgaaactccacttgcgcagttcgctcaccggcatgttcgggatgttgatctgcttggtgggcttgaccagttccgccttttcgatacgggccaagcgcagcacctgccagatgcgcggcttgccgttcgccttgtcgatggtcttgtctttggagacgtaggccttcttgtccttaggggcggcggaaccgacatccgtgtagacggcggcataatacacgccttcgtcgatgaaaatcttggcgggggccaccagcttgcgacgggtactaccggtaccgtcggagtactccatgtccaacagcgaatcggtgttgatcgcgcgcttgacgatggagaagcttcggggctccagctcatagccggtcaggctcagccacggggtctggcccgggctgacatggcggcgcaaacgctcatacagggattcggcctgcccacgctgcttgtccggcagtaacggcgaatgcgccaagtagctgaccgaggcggtgagcatgctgaggtattgcggcgaaatgccggcaagacgttcaaggcccaacgaattggtggcggaaacaataccctcggcatccagcagcggccagtcgatatcgaagaactggctgccagccatctcaccatcgtcggaaacggtggtcagggtgttgatgtccttatgaatgatgttgacgaatttcttgagctcgtcgtcgttcttcggtttgccgataaagcgctcggccagctcgctcatcgagaattcctcacccaggtgagcggagaggaacagcatcagacgcaggcgacgatccacctcgctgcccgtttggaaagcggggccgttcttcttgttctgggccttgatcgactcgggatcacccggctcacgaacatcgcgactaatcgacggggaaaccaccgaggcgcttacagggctggcggattcgtcagccagagtgaatcggctggcggcgtgcaggcggcgatgataggcgtccacagcctcctgcgggctgacaatcgtggcacccggatgctccagcacaaacatggccaaatcgtcggaatcggtgtaggccacgttcaggtgttcgccgtccacatcaacggtggcggcaaagcgacgcgaatcgataaccttgaccagcgagtccggaatgggctgcgtgcccaagccaggcgcaatcgaatccaaaccgagaccgggaataggggtctgcggcacacgcggcgtggtgcgcgacgcatgttgggcgagctgggactgatccggctcggaggaaatcgacatcgaacgagccagatagttggcggcggcaagcaccggcatatcttccggctcgaacatcaggcggatgcgcggttcgtcgcccaactgcagacgataggacgcgaagtcctggccttcagacttggacgagtactcaggctgccgtgattcgatggcaatgcccatcgcagcgagcttggcgcgatcacgctggaactgcttggcgaacgcggccttggcggcctgatctgccagctctccatacgagtcggcgtaagccttgacgcgctgcgcaatttggcgggatgtgagccattgcgggaacgcggatgacaacacagccagtacgtccagctcgtgcttgccccatttgtcggaaaaacgccgacgtccgcttgtgccctctgccattagtcctcacgtatagttattgtttcgttataagtgcgtatgagtttccccacactcactctatcttagaggctttttccacagttgagcgccatttcacaaaaataatatcttttttatcgttcgaccgtgttgtaaatcacacccaatcgtccggttcgatgccttgcgggccaacgtattcgccgttcggcacgtagctcggctcacccttatcttcaagtttggcgtcggcgaacatcatgacgtcacgtccgaatgtccagtcgccctgaatggaaaccgagttggctgcggccaaagatggcacggcgtaggggaaccgttcgtcgaaatcgcggatgttcttgtagtatcgcggatcaagttcgacgttcgggaagatgtaattgccgtcttccatctcatacgtgtccgtcaggtggaagcgatcggaacgcataatgaacaaatcattggtggttttcaccggaaggaagcgcatacgatccacttggacgcagatggaaccgttgaacagaccgattgcggcacccatggcggtttccagctgaatcacctgttcggagttcgggtccgtgggattcacggtctttttgttacgaatcaccggcaacggcaacacaccatcgcattcggcgagcttgtctttcaaagcgtcgatgcgaatccagatcgagttggtgttgaagtaaggatgcttggcgatgtcttgggccgcttccttatcatccggatggacctggctcatttcacgcaggatcaggcgaccagtggccttgtctcgcacgatatggcctcccttgcgatcggccttggtgcggatagccacttcggccatgaacggggcacctgtgttttcgaagtgctgggccaacgtacgcgaggggcgtgcaccgagattgtcggaattggagatgaacaggtacttgaagccgcgctcctccaatacgtcaagcaggccggactcccagatggtggagaacaggtcgccgtggccgggcgggcaccattccagctccgggttcatggggtagctcaccggttcgccggtggcggccacgagtttgggttcctgatgctggatgatttccatcggcacgtcatgctggctgaacttgcgatgatgcttgagcgccttcatcgtgtccgccgaagtgcggaaagaattcatgaacgtcagcggcagttcgacgttcaggcgggtgcgagcggtaagcacctgaccgatgatgatgtcgatgaagcgcatctgcttggccttgtgcctacgcaccggcaacagcgacttggccttgtccaatcccatggaggtgcccagaccgccattgagcttgaggaatgcggtcttggcgaaggcgtccacggccttgtcgtggttgatggtctcatagacgtcgtggaagctgggcacgtggccaagcggctcgatgtcgtcctcgcgaatccagctggaggcttcttcatggcgccatacgtcatacaaatggtggaactggttgatggcggtttcgctcatgccatgctcgcgcatcttggcggccgaaagctcgaaagtctcatccacttcgggggtgtttacggtttcttcgggggtgtccgaggtaacggcgtcggtgtcgtcagcggcggcgatatccagttgggccttatcgtttatttctgtcaattcgggtccctttcgtcaaatcaataggaaccagtctagcccctgtttggggcaaacgcatacgacgggggtgcggaggcggtgaattgtcggtgataattcattacgaatggcttacaaaggtaagtccgtcgtcatgttgtctcatattgtctgaaaacggaaaaaccccggaagacaaccactcaaaagtggcagaattccggggctaatcggtcgggccggcgggatttgaacccgcgaccccttgacccccagtcaagtgcgctaccaaactgcgctacggcccgatggtgcaaaagcaccgagtagataatttaccagatatttgaaatctggcaaattacgcgcgtgtcacttccgcttcttcttctcgcggatgttcacggagatctgaatcggcgtgccttcgaagccgaattcctcgcgcagggaacgctcgatgtagcggcggtagccgtgctcgaggaagccggtggcgaagatcacgaaacgcggcgggcgcgtggatgcctgcgtggcgaagaggattcgcggctgcttgccaccacgcaacgggtgcgggtgggcggcctgaattttgccgaggaaggcgttgagcttgcctgtaggaatacgctgatcccaggattccaaggccttatccatggctcgcgtcagacggttggtgtgccagccggtcttggcggacagattcacacgctcggcccacatcacacggtcgaattcggtgttccacaggcgttcgagacgctgcttgtcgaactcgtccatcgcatcccacttattgaacacgagcacgatcgcacggcccgcatccacggctgtggacatgaccttcaaatcctgatcggataccggctgcgaagcatcaaacaggatcagcgccaattcacagcgctcgatggcggcctgcgtgcgcagagaggaataatattccgcgcctgtgagcttgtgctggcgtcgcttgatgccggccgtgtcgatgaacagccagtcctcgccatcgatgttgacgatttcgtcgacggggtcgcgcgtagtgccggccaaatcgttgaccacggcacgttcttcgcgcgccagctgattgagcagagacgacttgcccacgttcgggcggcccaccagagccacgcggcgcaggccggaaggcgtgaggtagccggaagtcttctcggcctgcttgagcttgtcgagcgcgacgtccagcaggtcgcccactcccctgccgtgcatggcggaaatcgagtatggttcgccgaggccgagcttccagaattcggcggcaaggtattcgctggcctggtcgtcgatcttgttgacggccagcacgaccggcttgccggcggcacgcagcatcttgacgatgcgctcatcggtggtggtcatgcccacttgaccatcgacaacgaataccacagcatcggccaaggtcacggcaacctgtgcctgtgaggcgatggcggattcaatgccttccacgtcggcttcccagccgcccgtgtccaccagcttaaagtcggtgccggcccattccgcgtcatagctcacacggtctcgcgtaacgcccggcgtgtcttccacaacggcggcacggcggccgaggatacggttgaccagggatgatttgcccacgttcggacggcctacaacagccagcacacccaccggcttggggccggccttgcgcgcgccttccgtgaaaccgcggccggaaatcagatcctcatcgccttcgtccagctcatagccttcgagattggcggcatactgctcgtactcctggttctcgatggcgtcctcgaccagaccgatgagcagatcgagcgtgtgggcgaagtccaaatcggaattgtcgatggtagtaacgccatcggcggcggtcaggaagctggtgaccttggaatcggccttgtcgcgcgcagccacatcctcagcacccacgcccttgacggcttggccggtgcgacgggcctgacggacctcctcacgggcggtcagcagcacgcgcacctcggcgtccggggacaccacggtggtgatatcgcggccctcggccacgatgcccaaacccccggagaaggagtcggccgacgcttcgcgggcgatgtaggcgcgctgggcggcgatgagcacgttgcgcaccgggatgacgttcgacaccttggagacatggctggagacttcggaggaacgaatggcctcggagatgtcctcgtcgtcggcgaatacgcgggggttgtccgggtccacggagatatcgaaatggtcgccggtgaagaactcgcccaccgcttcggtgatgacacgctcatccacggtttcggcgtccagatcgatgccctgcttcaggcaccaccaagcgcaggcacgatacatcgcgcccgtgtcaaggtaggcgtatccgaaatacttggccagcgccttggacgtggacgacttgcccacgccggcggggccgtcgatggcaacgcgaatcacagaccaacctccttggacagcgaacggacttccgtctgggacagcacgcggtaggaaccgggcttcaaatcaccgagcttgatcgggccgatctgggtgcgcaccaagcgcttgaccgggaagccgattgagccgaagatacggcgcacgatgcggttcttgccggagtgcagcacgaccttgaccatcgtgtggtcacgcgaggagtcgatgatcgcgcagtggtcgagcttgatccagccgtcgtcgagctgcacgccggtggtcacgagtcgacggcacacggtgccggagatcttgccttccagcgtagcgacgtaggtcttctcgacctcgtacttggggtgcatgacgtgctgcgagagctcgccgtcgttcgtcatgaggataagaccctcggaatcgtagtcgagacggcccatgtggaagatgcgctcgtacttgtcgcccacgatgtcgcgcagcgtgtagcggcccttcgggtcgtccatggcggagagcaccttgcggggcttgttcagcgccagagtgacgtggttcggattgacgcgtacgcgcgaaccgtctacgcgcacctgctgcttatgagggtcaacgcgagttccgagctcggtgaccagttcaccgtcgacctcgacacggccttcggtgatcatgtcctcgcacttgcggcgggaaccgaatcccgcttgggcaagcagcttctggagtcgaatggaattggaatcgtcttgcgctttcgcagcgcgggaatatgcgtttggcatcgttctcccaacgtggccggacagattctgtcatcgcagagactgtcgatttgtatacatacttcagagttggcggactggaatcccagtcaattccaacctatatatcataccgcaacgtaggactgctgctagactggcaaccgtttgtgcgggttcgcccgttttccaacagatgaaaaggaatgaacaatcatggaagaaaccaagcaacagccgctggctctgcgcgtgtgcgccgaattggccggcagcttcctgctgtgctttgccatttacgccttctccacatggggttcggccgtgtatggcatcaatatcgtgttcttcgcgttggctaccggcttggcatatgccgcagtcaccgccatcttctcccgcgtgtccggtggccagctgaatccggccatcaccgtagcctccgtgctggtttccaagacgaaaatcctggatggcatcctctatgtgatcgctcaggtcatcggtgccatcgccgccggcttcgccgtggtcaagctgctgcccacatccgagcaggtagctgccaaagtgtggctgactccggccgttaacggtttcgaaaacggctccgtgtcttactcgctgctgacccagtatggcattacgttctcgattacgctggcgattgtcgtcgaggtcgttgcctctctgattgtcgttgccaccgccatgtcttctctgggtgatcacggcgagtcctcggaccgtcatgtcattgccatgggtcttgcctatggtctggccaccgccatcagctacccggttaccggtgccggtctcaatcccgcccgttccaccggcatcgcactggccgcgatgaatgagggtcttacgcaaaatccgctgcagcagctgtgggtattctggattagcccggtcttggccgccgctgtggtggcgttggtcatgatcatcgcgcagatgatgaccactcccaaagtgccggctgccgccgatcttccgcagacggatgccgatgcaaacgcggacacgctcgacgatggcgaattcttcgatcaggccgcctcgtctgatggcgattcagcggaaaaagatgttgccgaagagtccaaagaagctgaagtaggtaatcagcaggccgattcccaaggcgatgccgatgaaggagtcgaacgccactgagcgcactttccatgggcttctgtcctgaagaatcaggcgaacaagcccggtgatgatggccgtcacggcaagtatgaccgtggcggccatcgtatatccgaaagcaaccagcagtgtgatgacggcgacgacgccgagtacgcaccattcaaaccatggcttgccctcatgtgcttcggatacatagggatggttgtgcatgttgcgattccttctgtcgaacggttacgtgaccacaatagcaggcgaatagcaaaggtgggattccgcttggacccgttgacgggtcaggcggaatcccacctttgtgcgttttggctgagctgctcccctcagagagtcccgatcagtggaagaagtggcgggtgccggtgaggtacatggtcacgccggccttcttggccgcttcgatgacctcctcatcgcggatggagccgccaggctgcacgatggccttgacgcccgcgtcgataagcacctgggcaccatcggcgaacgggaagaacgcatcggatgccgcgaccgcaccggtggcgcgatcggcaccatcggccagcgtgttggcgcgctcgacggccaaatggcaggagtccacgcggttgacttggcccatgccgatgccaaccgtggcctggtcgtgggccagcaggatggcgttggacttcacgcagcggattgcacgccatgcgaacacgaggtccttcagcgtgtcagcgtcggcggcctcgccggccacgagcttccaggcgtccggatcgtcgccgacggcgttgatcagatcagtgtcctgcacaagcaggccgccatcgatctggcggatggcctcgtgacccttcggcggctcggccacctcgaggatgcgcaggttcttcttcttggtctgcagcagttcgagcgcggccggctcatagtcgggggcgacgatgacttcggtgaaaatcgggcgcacgctttcggccatctcaagggtgaccttggagttgcaggcgatcacaccgccgtaggcgctcatcgggtcgcaggcgtgagccttcttgtgggcctcggccgcggtcgcgccgatggccagaccgcacggattgttgtgcttgactacggccacggcaatggcgggagccatatcccatacggtgcgccaggcggcgtccgcgtccacgtagttgttgtagctcatcggcttgccgccgagctgctcggcgtgggcgaaaccggtctggttgagcgggtcgatgtagagggcggcctgctggtgggagttctcgccgtagcgcagggtgtgcgcacgatcccaggtgcgggtgaactgggccgggaacttggcggaatcgacttcagtgccctgatcgtccttgtccacctcgacggcgtccagagaggccggcttgggccagtgcttggcggtccactcgttgatggtggcgtcataggcggcggtgtgcgcgaaggccttggcggcaagccacttgcgctcgtccaaggagaagccggtgccgtcggccacgcgggaggcgaccagtgcataatcggccgggtcggtgacgatggccacggtggcgtggttcttggccgcgccgcgcaccatggagggaccgccgatgtcgatcttctcgatggtatcggcctcgttggcgccggagcgcacggtgtcggcgaacgggtacaggttgacgaccaccaggtcgaacggcttgatgccgaactcctcgagctgcttggcgtgttcggggttggtcatatcagccagaatgccggcgtgaatgtacgggtgcagcgtcttgacgcggccgtcgaggcattcggggaatccggtgacatcggacacctcggttaccttgacgcccagttcggcaagcttcttggcggtcgaaccagtggaaacaacttcggtgccggccttcacgaacgcttccgcgagtacttcgatgccttccttatgaaagaccgagaccagtgctcgacgtatcggtcggttcgtgtttgtcatcctgttcctccttggattcttgtggttgtgacgctaggaaccgcgcctgatgaacggtggcggtcttcgatgtcgcggcggtggtgcgggaatccttgattctctcaaccaaccagactatcggaaaaacgagcgctatgccaatcagcgcgagcagccatgccgcggtaagtcccagtgcggtcgaatgaccgacgactctggtggaggccatgacgtcgacgcctatgtgagcaagacgatgatcgccaagcgatccattggacagagcgaacagcaatgtggatgccagtgagatcagcatcgcgctcaggcagaatgccccggcggagtagatcagcgaaaccagtaccgggccgcgggtggacgtattccgtacattcaacggtctgcaggcgaatccttgcggtaggaatacagccagcaggcccacgagcgcagcgatggcgagaggcgcgttcaaggcaacggtacgccatagttcactgctgaccggttcgggcagaataccgaataccggaattgcaggaagctctttggattggccgagccataatgtgaaactggccaaatcaccgatggcgaatccgccgccgaagagccaggaaacagcccagagcatgacgttgggtagccagatcagcatggcgacggtggtgagaattcgtgaaccggtttccatcccggacaattcgaacaacgatacgacagcggcatggttgcgtaccgaccatacgatgacggtaatcaatccaattgccagatatatgctcagtatcgcgacggccaaggcgacgccgattttcaggcagtggcgtatgtccgccggcacctgcttgcgagtccagtccctgaatgctcgcattttggctgattccggtacggctgcgcataggaaaccgatcgagaatacgatggctgctttcagcaacaccagccactggtcatcgacaagacctaggtgcacggattgccggaatgcctcgttcaacccgagccaaacaatcaatccggcaacatacgcatgcggcccgtatgctttgattcgcatgatgagtgcattgatcagccatatcagcagtatggtcaacagcaatggcgtaatggtgagggtgaacgaatcggttctaaagcccgatccctcactcagaagcacaacggcctgtgtcagcgaggttgtgccgacggtgagattgtcgccgccctcttccatagagacgaccaataacatcagcgctgtatagcagcctaatgcaacggcatagatggccatggatgcgagggcgactatggctccccgcacccattggcgaatcacggctttcatcacgattggttggaaccgatcagtcgatgttggccttggcgagtacgtcacgcatgatttcggcggcctggcccggggtcttgcccacggggatgcccgccgcctcgagcgcgttcttcttgtcctgggcggtgcccttgcctccggagacgatggcgccggcgtggcccatctgcttgccttcgggggcggtgaaaccggcgatgtaggcgacaaccggcttggtcatgtgctccttggcccatgcggcggcgtcctgttcggcgaagccgccgatttcgccgatcatcatgacagccttggtgtcggggtcggcttcgaatgcctgcagggcttccagcagcgtcgtgccgacgatcgggtcgccgccggcgccgagacatgcggtgaagccgatatcggacaattcgcccatgagctggtaggtgagggtgccggatttggagaccagtccgagcgggccgcggccgacgatgccgtcggggatgatgcccagattgacgccggggttgccgagcgtgatgagaccagggcagttcggtccgatgatgcgcacgcccttcttgagcgccagttcgacgaagtatgcggaatcggccaccggaatgccttcagtgatgaccacgatgagttcgatgccggcttcgacggcttcgaccacggcggacttggcgaacttcggcggcacgaacaccacgctggccttggcgccggtggcttcacgtgcttcgccgcaggtggcgaacacggggatgtccgcgtcggcaccgttcttggcaccggggaaggtgacggatgtgccggccttgcgcgggttcacgccgccgacgatattggtgccggccttgagcatgcgagccgtatgggtcatgccctgatggccggtcatgccctggacgataacgggagcgccgtcttcgatgaacagcatcagcgaacctccttggactgggtcgcctcaccggcgagctgcgcggccttggctgccgcgccttccatggtttcggacacatggatattcgggttattggcggaggcgaggatatgcagaccctcggcggcggcgttgccatcgaagcgcacaacgatcggcttggaaccgccgagcttggcgaccgcttcgaggatgccgttggcgacttccacgcaggaggtgatgcctccatagacattgatgaacacggattcgacctgagggtcggacagtacgatctccaggctttcggccatgacggctgcggaggcgccgccgccgatgtccaggaagttggcgggcttgatgttggtgccctgttcctcgccagcgccggagacggcatccagggaactcatgacgagtcctgcaccgttgccgatcacaccgacctcgccgtgcaggtgcacgtagtgcaggccgtgttcgcgggcgcgctgttcgaaggggtcgggaacgatgggatccacgaaacgcgcccagccgtcatggcggaaggaggcgttgtcatccaaggagatcttggcgtccaaggcgctcagctgcttggtggattcgtcatccgggtcgccgatcttggcgagcggattgatttccacgagcgtggcgtcgttgtctttgaagcagcgccacatcttgagcagaatctgtgcggcctgatcgacgtccgcgtggtagaagccgatgctctgtgccatttcggtggcagcggccaggtcgaagtcaccgagcgcatcgatgtgcaggcgcttgacggcctccggatgttccttggcgatttcctcgacttcggtgccgccgttagcggtggccagcacgtcgaagtcgcgcgaggtgcggtccacggagatggacacgtagtattcgtgcaggatgttcttggcttcggctacaagcacgccggaaaccttgtgcccgtggatggtcatcggcaggatggactcggattcaagaatcgcctcgtcgcggttatgggcgatcttgacgccgccggcctgaccacgatgaccgatcttgacctgcgccttgattacgcagggatagccgattttgtccgccgcttcagcgacttcatgggagttctgggcaaagatggcgtccggggtgggaatgtcctgttcctcgagcagctgacgcgcctggtattcgtaaagatccatcgatccttccctgactatgtaattggtccggcatgtaactgtacacagtacatgccggaccttgaaaactgactgtacgttgggtgagacgaaatctcaggccggcatcgcgatcagcgagctgctgggcttgccgtcgagcttatccagaccgtcgaggccatcgagccgcatcacgaaactgaagcccaccacggtgccaccggccttttcgataaggtcggtggcggctttggcggtgccgcccgtggcgatgaggtcatcgacgatgagcactcgcttccctgcctgtacggcgtcggtttcgatttcgacactggccgtgccgtattcgaggtcataggattcaccgatggtttcaggcggcaacttgccggccttacgcacggcgatgaaacccttgcccaaatgggcggccatggccgggccgaacaggaacccgcgcgattcgagaccggcaatggagtcgaattcgctcggggacaccggcagggcctcttcaagtgctttgagcagaatcttcaagcccttggggtcggcgagcactggcatgaaatcacggaagatgatgccttccttgggaaaccccggtacggaacgcaccaaggacaccagatattcggcgtcctgttgccctaccttgctcaatgcgtcgatggtgatgtccgactgtgccatagtgctcgccccttttatgcctttgcgatgcgatacgcggatggtgctaccgaatcgaacagcttacttcgtcttggtttcgttgtcgtcaccggtctcgtcagcggtgtcttcctcggacacgacggacgcctcgatcggaacctgaccagcctcatcgttagccggagcctcggtgtcttcgtcgggcagcgggttgccgttctcgtcgacctcatcatcggacacataggccgggcgggtgtactcacgggcgatggcgttgaagccgaaacgcagcttggagccttcggagtcgatgacgatctcctcatactgctcgtcgacttcgacgaccttgccgatcacctggccgatggtgatgacctcggtgccgggctgcaggttgcgacggaagtcctgcttctcctgctgttgctgcttggccttcttggactgccaccacatcatgccgccgaacacgacgacgatcacgatgagcataatgtactgttgttccacgaaacaactccttcaaacgagcgacattgacgaaacgctgccgagtgtgcaaacaggagaaagtctagaagagcttgctgacatcatctttgggcgtaattcccaaatgctgccatgccttctcggtagccacgcggcctttgggcgtgcgaatcataaaaccttcgcgcacgagatacggctcgcacacggtttccacggtttccgattcctcgcccaccatggccgccagattgttcaggcccacgggtccaccgttgaagttgcgcacgatggcattgagcacggcgatgtccagccggtcgaggccttcggagtcgatctggtacagggccagcgcctccttgacgtcgtccggccgcaccacgatcaggtcgtggacgatggcccagtcgcgtacacggcgtagcaatcggttggcgatacgcggcgtgccgcgcgaacgcaacgcaagctcatgagcggaacccgtatcaaggtttacgcccagtacgttggccgaacgttcgatgagcttttccaactcctcatgcggatagaagtcgagatgtgcggtgaagccaaagcgtgcgcgcaacgggcttggcagcataccttcgcgcgtggtggcaccgatgacggtgaatcgcggcagggtcaacgggatggagcttgcgcccgggcctttgccgaccatcacatcgacgcggaagtcctccatcgcgatatacagcagctcttcggcggcgcgcggcagacgatggatctcgtcgatgaacagcacttcgccgacgtcgagggagctcagaatcgaagcaagatcaccggcatgttgaaccgcagggccggaagtcacgcgaatcggcacttcaagctcattggcaacgatcatggccaacgtggttttgcccaagccaggagggccggcaagcagaatatggtccggtggcacatcgcgtttgcgggccgcgtccaggaacagttgcagctgggccttgagccgtggctgtccgataaagccttcgagaacatgggggcgcagctcctcgtcgctgaccggctcgttgccgatcggctgggaggagaccatgcgcaacgactcttcgttggcaccggtgttggaggctccgtaatccgttgtctcgctcatcagcggcccctatccatcagcgccaaagccagacgtagcacacgcggcacatcgtcggtggcaagcggcgtgggaatatcgttttcggcgcaagcctcggcaacggcctgttgggcgtcctgctgacgccagccaagtgaaatcagtccttcgacaacctgttccgtaccggtatccaccggagacttggatattgccgcctgagcggaagcaccctcgatctgactcaaatcaatagagcccttaagctcgaggatgattttctgtgcgcccttcttgcccagccccggagccttggccagcgcggtggcgtcgttgtcggcgatggcgtgggccagctgactcggcgtcagtgtggagagtaacgattgggccactttaggtccaatgccggagaccttgatgagttgtaggaaggttttcttggcgtcccgatccaggaatccatgcagggtaatggcatcctgagagaggttcatataggtgaagacgcgggtgtcttgcccggcgtgcagacggctcaggtcggtggcggacatgcgcacttcgtagcccactcccccaacatcaatcaatgcggtatcggtttcgaccgattcaacccgcccggtcagcatgccgatcatacaggtactccttcagggctccaggattcaagactcgaacaactgttcgaaagtatactacatgcctcggtcgtggttgatgcggcggcgcgtggatttctgtgcggcctcagcccactggcgttgcgcggcggtcagatgttgttcgcgttcgccgccctgcaatgcgcctgccgggcgcagcgcatggcaaatggccaaagccaaggcatcggcggcatcggcgggagtcggcattttggtgaggttcaaaatacgtgtcaccatacgctccacctgaatcttctgcgcctgcccgttaccggtgatagccagcttggcttcggtaggcgtatgcaacgccacgggaatattgcgttgcgcggcggcgagcatggcgaggccggcggcctgtgcggtaccgagtacggtgttgcggttggattgtgcgaacactcgttcgatggatacggcatcgggtgcgaagcgatccattttctcggacaggccgttgtagatggccagtagacgcagatcctgggtgatatccggtgaggaccgcaccacgtccacgtgaataaacgaaagccggcggtgctcgccggcttcgatcacgccgaccccgcaacgtgtgagcccggggtcgacgccaaggataatcacgaggattactcctcgtcgagctgggccatcacctcgtcggaagcggtccagttggagtagatgttctgcacatcgtcgaggtcatcgaggttgtcgatgagcttggacaccttgcgggcatcgtcgaggctcaactcgacctcgttcttcggctgcatgacctggtcggcggaatcgtagtcgaagccggcgtcctgcagagccttgcgcacggtgaacaggtcggacggaccggtcacaacggtgaacacctcaccgtcatcggtaacgtcctcggcaccggcttcggcggcggtttcgaacagcttgtcgaagtccacgccctcggacggcaccacgatctggcccttgcgctcgaagttgaaggacacggagccggaggtggccagggagccgttgcccttggtcagggtggaacggacttcggcggccgcacggttgcggttgtcggtaaggcattcgatgatgaggccaacgccggcaggagcgtagccctcgtagacgatgtcttcgtagttggcggcgccgtcttcagcaccggcaccacgcttgacggcacgagcgatgttgtcggccggcatggaggccttcttggccttgtagatggcatcgtacagggacgggttgccgtccgggtcgccgccgccgaggcgggcggcgatttcgatgttcttgatgagcttggcgaagagcttgccgcgcttggcgtcgatggcggccttcttgtgcttggtggtcgcccacttggaatgacctgacataatgctcctagcaattattgaaacggatgatgtcaaacgaaacgattgtaggccgttaatcagacatacccgtaatgtttccgatgattgtcttattgcgcgtaccgataaaaccggttgcgcgggtgccgcacccggtcaggcaagcggcaaatgatactgcggggccagctgttcgaatgcctgggcataggcatctcgctggtcggacagcagaatcggcatggtacgcgtctgggcgacgatgggcatgaagttcgcatcgccattccaacgcggcaccacatgctggtgcaggtgcgcggcgactccggcacccgcgacctcgccctgattgatgccgatgttgtatccgtccggacgggagacggtctccatcaccttcatggcgagggtggtggccttctcgaattcgaacagttcggcatcgtcgagttcggtgatgaatccgacgtgacggtacgggcaaatcatgagatgcccgacattgtatgggtagaggttcatgatggcgaacacgtgcgtgccacgccaggcgatgaggccgtcttcgtcggattttttgggtccgacgcagaacgggcattccttcgtcttgggcttggttgggcgatcctcgctgttgcgcagcacataggtcatgcgctgcggagtccacagtcgttcgaccgtgtcctcctgaggcggaaagtccgccggattatcgacacgcacgtcagtcattttcgcgccctttcttggctcccctcagagaggggagccagtaccattcacatcactcagccacagcagcgttgaagtcgtcggcggagttcacctggacgcgcttcttgatgacggtgagaatctgctcgcgagcagtgtccaccggcacaccgttgagctggctaccgtcgcggaagcggaagctgaccgcgttgttgttcatgtcttcctcaccgacgatgaggatgaacggcaccttggacttggaggcgttgcgaatcttcttgccgaagcgatcgtcggagtagtcgatctcgcaacggaccatctcatcttcaagggacttgacgaagccggccagatgcggggcaaactcgtcggcaaccggcacgccgagcacctgcacgggggccagccacgccgggaaggcacctgcgtagtgctcgagcagcacggcgaagaagcgttcgatggagccgaacagggcgcggtgaatcatcaccgggcgctggtgggtgccgtccttcgcgatgtactcgagctggaagcgctccggcaggttgaagtcgagctggatggtcgagacctgccaggtgcggccgatggcgtcgcgggcctgcacggagatcttcgggccgtagaaggcggcgccgcacggatcgtcgacgagctcgaggttggattccttggcgacctcggcgagcgtgttggtggcctcctcccagatctcgtcggagccgacgtacttgttcgggtccttggtggacagctcgaggtagaagtcggtcaggccaaagtccttgagcaggttcagcacgaaggtgagcaggctggtgagctcgtccttcatctgctcgcgggtgcagtagatgtgggagtcgtcctgggtgaggccgcgcacgcgggtcaggccgtggacctcgccggacttctcgtagcggtacacggtgccgaactcgaagaggcgcagcggcagctcacggtaggagcgctgacgcgacttgaagatgaggttgtgcatcgggcagttcatcggcttgaggtagtagtcggcgcccggcttggtgatgttgccgtccgcgtccttctcctcgtcgaggtgcatgggcgggtacatgccgtccttgtaccagtgcaggtggccggaggtctcgtacaggccgcccttggtgatgtgcggggtctgcacgaagctgtagtggtgcttgcggtgcatctcacgggagtagtcctccatagcgttgatcacggcggcacccttcgggtggaacacggccaggccggggccaatttcatccgggaaggagaacaggtccatctcggcgccgagcttgcggtgatcgcgtttggcggcttcttccaggcgggtctggtaggccttgaggtcttccttggtggcccacgcggtgccgtagacgcgctgcatggtcgggttcttctcggaaccacgccagtaggcggcggcggaacgctcgatcttgaaggccttgatgtagcgggtgttcggcaggtgcgggccgcggcacaggtccttccaaaccacattgccatcacagtctacgttgtcgtagaagctgagctccttttcggagatctcggtggcggcggccgggtcgaggtgtgcttccttgtcttcgatcagttcgatcttaaagggctggtcggcctcttccttcagagcctcttcctcggtcacggaacgacggcggaaggactgggaggacttgatgatgcgctgcatgcgcttctcgatgtccttgaggtcgttcggggtgaagggctggtcgacctggaagtcgtagtagaagccgtccttgatgacggggccgacgccgagcttggcgttcgggtagacttcctgcacggcctgggccatgacgtgggtggccgagtgacgcatgattgcgaggccgtcttcggagtcgagggcgatggggtcgacggtgtcgccatcgttcagcggcgtgtacaggtcacggttctcgccgttgatcttgaccgcgatgatgttcttgtcttccgcgaacagttctacgccggtggtggttgcttccacctccttcgcttcgccgttgacggttatggagatggtagcttgcgccatgatttgtcctttgctatcggggcccacggtactaatgtgcaggcctggactggttaatcaacgtaggacacgataggttgggcgtgcgacaaataccaccagcatctgaaccaatacgaaaaaacctcgccgaagcgaggtttcgttgtggagcggacaacgggactcgaacccgcggtctcaaccttggcaaggttgcgctttaccaactaagctatgtccgcaaaggaatccgccgtgagaagcggaatccagtgggcgatgtaggaatcgaacctacgaccccttcggtgtgaacgaagtgcgctagccgctgcgccaatcgcccgagcctgtgatgaaaaaaccggcaacattctgccggcgattcatcgagtgggcgatacaagattcgaacttgtgaccccttccgtgtcagggaagtgcgctaccactgcgccaaccgcccgggtcatatttcatcccattgaattgcttcgctggtctgagaggtgggtacgagagtcgaactcgtctatacggctttgcaggccgctgcctaaccgcttggctaacccaccgtaaggtctgtcaactcacggacctagagcggacaacgggactcgaacccgcggtctcaaccttggcaaggttgcgctttaccaactaagctatgtccgcgtgtgtttccttggcgaggtctccctgccgaagcacgagtgtttactatacacacatgcgtgtagttcgtccagctgcggcgtgtcgcctgtaattgcatactctcgcttatggctaaagcgtgcgcttcgggcaatgaactccagttactctagaggtatgagtgaagcagcgaaggacaccggcgcagtattgatcgccgcattcgagggatggaatgatgcctgtcaggcggcgacgaacgcggtgcgccatctggtcaagcgatatgagtcccgcgagattcgtcatattaaatgtgatgatttctatgactatcaggttgcccgtcctatgctgtgccatgtttcgggacgcaccaatcttatctggccgcagaccacgttctacgacatcacgttggacgcaggcaagcatatctatgcgcagatcgcccccgaaccaaactatcggtggaaggaatactgtagccagagtctggccattgccgatgagctggatgtcaatcggatcattacgttaggttcgatgttctccgattgcccgcatacccgtccgttgcccatcgccgtcagcgacggagactgtcaatgcgaaggagaccggtcgtataacggcccggtaggcattcctactgttctggatgtagctgccgcacaacaaggatttgctcattcctcgatgtgggtgtccatcccccaatatttgggcagcgacgaatgctctgccggcactatgcgattgctggatgcgttgggcaagcatatcggcttcaccttcgatacggcagatctgaagcagaaagccgaacagtggaaggcgcaggcatcgatactggttcgttgcaatgaccagcttcacgattacgtggagcatttggagcacgactacgacttgcagcagaaagccgaggcggaggcttccttgggagcgccccaggctgaacaactggtcaaagaagcggaagcgtttctacgccagatgggcaattagcccatatatggtgtgctcccgctggatgaacagccctgtgggctgttcatagcagtgcaccatgtgcacgtcgcacaaaatgtcgggagctggctcgcgtagcgagactgagggtggttctgctggcatattccagtgaccacccccagtcagcttcgctgacggctcccgccagcgggagcaccattatattggagtcgtctatcgacccgtcttatgccgcagccgccacggagggatcgatggccggcagcacgcccacaatcagcagcaaggcgacgaccacagccaaaccgatgcggtagatggcgaaggccttataggagaagttcgatacgaacttcaggaatccgatgatcacgatgtagccgagtacgaagctgatgaccatggctacgagggtcggcccccagccggggaacatcgcatcggttttgtagttcttcacggccttgatggcttcgagcaaacctgagccgaacaccgcggggatggccatcaggaagctcagacgtacagcggcctcacgcgtgtagcccagtgcgcgaccgacggtgatggtgccgccggagcgggacacaccaggaatcagcgccatggactggcccaaaccgaagaggaacgcatcacgatacgtcatatcattcatggttttgttctggcgagccttggcatccaccatccacagcagaatgccgaataccaacagcacggttaccgtaatccacaggttgcgcaacgaggtctcgatgacgttctgcagagtgaagccgaggatgataatcggaatcgagccgacgataatgttccagccgagtgtggcgtaattgtcgccgcggcccatgcgggccttccaatccttgccgttcttgccgaacaggcagctgaaccagtgagtaaggatattgatgatgtcgtgacggaaatacagaatcaccgcaagttcggtgccgatttggatgatggcggtaaacgccgcaccgggatcagagcccagcatcaaatcgccgaaaatacggatatgcgcgctggaggataccgggagatactcggtcagcgcctgaacgatgccgagaatgatcgcttggaaaaaattcatgacccctcgtgatttctaagtatttgatgtgttatgacgatgaacaccctatccaagggggtgtagaacaacactaagaatcggtaacatccacggcttctacaatgaaagtggatatagtacgtaagcgacgaagggagcattatggccacgtatcgcaaaagcagggcattcgcaccggaaggattcttcgaatgcgagggtcgaggactcgaatggttgggagcggctcatgcgcagggcggcccgcgcgtggtgcaggtatacggctggggcaaggattatctggatatcgaacgtgtgggcagcgcgtcccccacgcctcaggcggcacgagcttttggtgcggctctggcccatatgcatgatgtgggtgccgaatatttcgggtctgcgcctgacggatataacggcacatgctatttcggaccattgcaggacccagtgaaaatggataccggcgagtggaccgacccgatcagctatttcgctgatggacgtctgcgcccgatggtcaaccttggtgtgaggcgtggcgagctggataagcgcgatgtcgaactgaccgagcgcgtgattgaagcgttgccggatctgatgggccgagccgcgtccgacaagccggcgcgcatccacggtgatctgtggagcggcaatgtgatgtggaccgccgattccgggcagcccgaggctgtgctcatcgacccggcggcacatggcggtcatcgcgaggaggatctggctatgctgcacctgttcggcatgagctatctgagcgaaatcaccgagggctaccagtccgtgcatccgttgaaggccggatggcaggagcgtatcacgctctggcagctctaccccatcgccggccactgtgtcttcttcggcggcggctacgtcaacgaataccgctccatgtgccgctccatgctgaagtaacagacttggctcccctctctgaggggagccaagaacgcatccactctcagctcagcgcgtccttcaacttgctgaagaaacctttcttttgaccggcctgtggacgggatgcctgggagacgtgcgtggcgcctgaatcgtgcgaggcggcgaactgttcgatgaggccacgctcggtttcgttgagcttggtggggataagcacattgacgtgggcgatgaggttgccgcgctcgtccttgttgcggatgttcgtgacgcccagtcccttaagcgtcaccgtgtcctcagtctggcagccggccgggatggacacggtcttctcaccatcgaacgtatcaatggacagatcgtggccaagcacggcccagctcatcggcacctgaatccagcagtgcaggtcgtcgccatcgcgggtgaactgcttatccgccttgatgcggatgtcgatgtacaggtcgccggcagcgccgccgccctcacccacttcgccctggttggccaaccgcagacgcgcgttgtcgttgatgccggcgggcacggtaacgcccacggtacgcgtggtgcgcacacggccgtggcccatgcagctggggcacgggttctggatgatggtaccgtggccctcgcaacgttcacagggggcggaggtcatcatctggccgagcatggtgcgcacgaccttctgcatgaatccctgtccgtggcagtcggggcaggtgaccggctgtgcgccgccctgggcaccggagccaccgcactcctggcacagggagaacgtattgatcttgacatgcgcggtgccgccgaacaccgccgtcttcaaatcgatggacgccgaggccaaggcatcgcggccgggctgggtacgcggcaccgggccctgtgagccaccgccgaacgcggaaccgaagaacgtggagaacacgtcgctcatatcgccgaagcccgccccggagaagccgccggcaccggcgttcgggttgttcgggtcgactcccgaatcatacatacggcgtttgtccggattggacagcacatcgtaggcgttgttcacttccttgaacttgtcctcgaactcagggcccgcgatgtcggggtggtacttacggctgagcttgcggtatgccttcttgatctcgtcgtcactggcgccgcgttccacacccagcgtctcgtaataatctgccacttgattgatcctttgtgttcgtttggtctgcgggtcattgtgccacagacggcggtcagtcttgagtccggccctcggagaggaaggcggtcaaatatctggctacggccctgacggcggccatagtggccgcgtagtccatgtgggtcggccctatggagccaacgaaggcgatgggttccgtgtcgttcgtctggctctccgtctcggattcggtttcgggttcgcctacgggatcgttccccgccggttcgcccgccgctccgctgcgcccatagccactgctgaccacggaagcatgcagtagtccgggggtgtgcatttcggagccgatggccacgcccacgccggatgcattcgtctcctcgctcaggttgctcatgagcttcatcagcacgacctgttcttccagcgcgtcgaagagcggggccagatcggccagggaccgggagtgggccaggtgcgaggtgccggacatgtacagttcgttcgcgcgttcgtccaatgccatcgattcgaaggcgtcggccagcgcgtcggccacgccgcgcaccgactcgtagccggcgctggcggcgatggatcgcacggtctccgcggatttcgatagggacagtccgacacattgttcgttgacggtgttggagagccggttgatctcgtccacggcgggcatggatgcgatggtcaggccgtgctgggccacgcggccggtgtcagtaatcaccaccgcgagcaacgtggtcatggcaacgggcaccatctccacgtgccgcaatgtggccttggccagcgatggcgaggtgactatggccacttgaccggtgatttcggacaacagtcgtgccgaacgctgcagcgcgtccttgagactcaccgatccggacaggaagctgttgatgccgcggcgctgcgcctcgctgagcggcaccacggtagcaagtcggtccacaaagtatcgatagcccttttcggtgggcacacgaccggccgaagtgtgcggctgaatcagatatccttcatcctccagagcggacatgtcgttacggatggtggccgaactgacgccgagatcatggtcgcgcgtcagcgaagtggagcccacgggctcctgagaacggatgtaatcctccaccacggcgcgcagcaccagcatgcgtcttgattgcgtcatgcgcgcctccttatacatacatacatattcatatcagtcacggttcactcagggcgtaccccgacggtcggttcgccacgccgcgacacgcgggaacccagaaatattgcctctttcttggctccgccacgtgcaggtggcgcacttcaccctagaacattgtattagcactccttaggcttgagtgctaatgcgttcgtttgcagcgtagcaatgttcactgtgaacgctaacagaacacaaactaccaaaacacgccaaaactgcaccacaacgtcgcaaaccgacgctagcatggtaatcgcaatgtgagggcgtcaagcgcccggcacaagccggatacgcggcccgaccaattggaaggaaagtaatccatgaccgaattcaaggagaccgagctcgacgagcgcgccatcaagatggcgaaggtcctttcggctgacgcggttgagaaggcaggctccggccaccccggctcccccatctccctggcgcccgtcgcctacacgctgtaccagcacttcatcaagcacgatccgaatgatcccaactgggaaggccgcgatcgcttcatcctttccggtggccacgcctccctcacccagtacgtccagctgtacttctctggctacggcgtgaccttggacgaccttaagaacttccgtggcggcgctgccacccgcaccccgggccacccggagtacggcctgaccccgggcatcgaaatgaccaccggccctctgggccaaggcttcgcctccgccatcggctttgcctacggcgagcgtttccagcgcggtctgcttgacccggagaccccgaaggaagattccccgttctaccacaagatctgggccatctgcggtgaaggcgacatcgaggagggcatctccggcgaggccgcttccctggccgccaaccagaagctcggcaacctgaccgtgatcttcgacgccaaccgcatccagatcgaaggcgacaccaacctggtgctggccgaggacgtgctcaagcgcttccaggcctacggctggtacaccgacgagttcagcttcatccagcccgacggctcctacaaggaggacatcgagggcctggctgacgtcatcgccaaggccgagaaggccgctccggaccagccgaagctcatcaaggttcactccctgatcgcttggccgaccccgggcaagaccaacgacccgtcctcccacggttccaagctgggtaccgaggctgttgccggcctcaaggaagccctcggctacgatccggaagagaacttccacgttgacgaagaggctctggctcacgctcgcaaggttgccgagcgcggtctcgaagcccacaaggaatgggacgagaagttcgacgcttggcgcaaggccaacccggacaaggctgccctgtacgaccgtctgaaggccggtgaactgccggaaggcttcgacaaggctcttgacgaccttgaggccaccttcgaagtcggcaagggtgtcgccactcgtggcgcctccggctccgtgctcaacgccatcgccgctgtcatgccggaactctggggcggctccgccgacctcggtggctccaacaagaccgatctcaaaggcgctgccaccttcgccccggccgagtgcgccaccaagcagtggccgaactgcaacgagttcggtcgccagctgcacttcggcgtgcgcgagttcaccatgggctgcatcaccaacggcatcctgctgggctcccacacccgtccgttcggcggcaccttcttcatgttctccgactacgagcgttccgccgttcgtctggccgccctcatggagattccgaacctgtacatctggtcccacgactccgtcgccgtcggcgaggatggcccgacccaccagccggttgagcaccttgcttccttccgcgcgattcctcagcttgaggtcattcgcccggccgacgccttcgagaccgccgaggcttaccgttacttcttcgagaagaagaacaccctgcctggtgccatggttctgacccgtcagggtgtcccggttcttgccgagaccgccgccaaggccaaggacggtgtcaagaagggcgcttacgttctggtcgacaccgagggcactccggacgtcatcctcatggcttccggttccgaggtccagtgggctgtggctgccgccaagaccctggccggcgagggcgtcaaggctcgcgtcgtgtccgtgccgtccatggaatggttcgaggagcaggacgccgagtacaaggaggccgtgcttccggccgctgtcaaggctcgtgtctccgtcgaggccggcgttgccatgccgtggtacaagtacctcggttcctacggcaagcctgtctccatcgagcagttcggcctgcagggtgacggcgctcagaacatgatcgacctcggcatcaccgccgagcacgtggtggaagccgccaaggcctccatcgccgaagtcgaagccgccaagtgagcaactaagcaataattcaataattgttggctcccctccctgaggggagctgtcaggcgaaagcttgactgaggggagcaatgcttgagcccactcccctcagtccgcgttgcggacagctcccctctcccaggagaggggagcctagggcttgaatccaaggagaaaataaatgactgaagcaactcagcgtacgtccgacaacggcgtttccatctggctggacgacctgtcccgctcccgcattgagtccggctccctgcaggacctcatcgccaacaagaacgtggtcggcgttaccaccaacccatccatcttccagaaggccctgagccaggtcggcccgtacgacgctcagctcaaggagctcggcaaggttgacgttgagaccgctgtccgcgagctcaccaccaccgacgtgcgcaacgccaccgacatcttccgcgagatcgctgaggctaccgacttcgtcgacggccgcgtctccatcgaggtcgacccgcgtctggcccacgacaccgagaacaccgccaagcaggctgtggaactctgggagaaggtcaaccgtccgaacgccatgatcaagattccggcaaccctcgaaggcctgccggccatcaccgccaccctggccaagggtatctccgtcaacgtcaccctgatcttctcgctcgagcgctacgagcaggtcatcgacgccttcatcgagggcatcgcccaggctgacgccaacggccacgacctgaagcacatcggctccgtcgcttccttcttcgtctcccgcgtggacaccgctgtcgacaagctgctggaagccaacggctccgacgaggccaaggctctggagggcaaggccgctgtggccaacgctcgcctggcttacgagctcttcgagaagaagtttgccgaggatccgcgttgggccgacctggctgccaagggtgccaaggttcagcgtccgctgtgggcctccaccggtaccaagaacgccgcctactccgactgcaagtacgttgacgagctcgttgccaagcacatcgtcaacaccatgccggagaagaccctgaacgctctggccgaccacggcaacggcgctccgtccatcgagggcacctacgaggagtcccacgccgtcatcaacaagctggctgagctgggtatcaacctcaaggacgtcactgacaagctggaggccgacggtgtcgccgccttcatcaagtcctgggattccgtgctggctgacgtccagtccggcatcgaccgcgtgaacgcctgagattattagctgatgcgcatttcgcgcattaactgattagctcacagaagctccgaccccaaccggtcggggcttcttacgtttgttgctacagtagtacgagcacatgagagaacggccgaaccgtaatgaacaaacttgtcgcacgccagcggttggtgatgacctttaccttcttttcgatgttcttcggagcgggcaacctgatcttcccgccgtttgtcggagctcaggccggttccgcgaccataccggcggccatcggcttcatcgtctccgcggtcggcctgccgattctcggcgtgctggcggtcaccttcgccggtggcttcgacaaactcgccggccgggtctcccccaaattcgccctgttcctcggcttggcgatcatgctcaccatcggcccctgctttgcgattccgcgtacggcgaccacctcgttcgaaatgatggtggcgcctttcgtgccgtcctcctacggctggctggcccaactcatctactcgctcgtgttcttcacactggcgttcctgttcgcccagcatcccgaaaaactctccaaagtgctcggccgattcatgggaccgttgctgctggtgctgattgccgtcctgttcatcgcctgcctaatccacggtatcggtaccccggccaaaccgatgggcgactactccacaaaccagattgcacgtggcttcctcgacggctaccagaccatggatctgctcgccgcgctctatttcggcatcgtgatttccgcgaatatccgcacccagcaggtcgatgacgaatcgcaagtgcagaaggagaccgcgtatgccggactcggcaccggtgtgctgctgatcgtgatctacggcgcactgagctacgtgggcgtggtgtccggcgccatcgccaccatcgatcccgccaaagacacgggcgcgaccgtgctcaccaatctcacctcgtccctgttcggcgcgttcggtaccgcgttcctcggtatcgtcttcgtcatcgcctgcctcaacgtatgcaccggactgatcggtacctgcgccacctacttccacactcggttccagaccgttgcagggagaacgttgagctaccgcacctggcaggtcatcttcaccgtgttcagtttcatcgtgtccaacgccgggctaagcgcgatcatcaaggtttccgtgccggtgttgtccgcactgtatccgatcgccatcgtgctggtgctgctggcgctgacccacaagtcgctcggcgcgcgattcccgcatgtctacttctggaccgtgctgctggtgggcatcgactccttcgccagctgcatctccagcctaatcaccgtcttcggcggctccatcggctggctggacacgacgctggccatgctgcccttgcagcaataccagctcggctgggtggtcccggctatcctcggtgttgccattggtatcgccgatgctccgcgacggtagttcttcccggtctgtgccggagtctggcggtcggtcggtgatggcggttgttgcgacgctcagcggtgccggtgtatcgttcgcaccactatatgagcgcatttggggcggcatgatgctgcatccgaactgtccggcgattggcagaatgccctactatctctcgggccaagcaactgacgattatggagtctgcgtcacctcaccactgtggtttatgacggtgactgcgctgagtgttgtcgcgattctctgtctgaccgttgcgggagtacagggcttttcgcgccatcggctctgttcccgttgccctgttctggtcaggtctcacgttctttacctacagctacaacactggtagacacaccgatttctgcccagcgctatcggcaactgacaatgcaggtcttgtcgcttattgcatcggccgtgaagctttgggactgctgaccgtcgtgttgtgcgtgctgccattgttctccctgctttcggcgattatggccatcacgttggctgcgcacgacgcgacaccaccggcataaaatctccttcatatcacgaaacaacgggcacccgttttgcgaggcattctatccgtcccgtgtttcgcaacgcatgagacggcacatccattgaatcaggagtctagaccatatctcgccgaatcttgcggtaggtggcatagaacaggaagccggccacgatgccggaggtggcgtcggagatgggttcggcgatgaagatgccgttgacgccgatccagtgcggcagcagcagcgcgagcggcacgagcaggatgatcttgcggaagatggccaagaacaccgactgtttggcctggcccatgccgacgagtgcgcattgcgcgcccatctggatgccgaagataccccagccgcagacgaaaatcggcatcatgcgggtcacgatgtcgatgacagtctgttccgaggtgaaccatgaggcgaaaaagccggggaatgtggcgagtaccgacaccagcgccgtggcggagacgatctgcgtgacgaaggccatgcggaccgcctggcggacgcgctccatatgccgggcaccgaagttgaacccgatgatcggctggatgccttgctggaagccgctggtcaggacgctcacgatctgcatcagcgaagtgatgatggtgatcgacgtgacgtaatcgtcgccgccgtagcgttgcagccccacgttgaacaccacgttgatcaggcattcggtgatctgcatgatgaagggtgccagaccgagcgccagcacggggatgatgatccgatcgaaccggatgttcaacggccgcaggcgaatcgcgctgcgcccggaggagaggaacagtacgatccatatggtcgagaccagttgggcgagcacgttcgcggcggccgctcccctgacgccccatccgaacacgaaaatgaacacggggtcaagaaggatggatatgccggtgccgatgagtacggagaccatggccacagtggttttgccctgcgccgaaatgaagttgttgagtccgagcgtgagttgcacgaatacggtgccgatcaggtagatggtgatgaagtcgaccgcatattcgatggtcgcatcgctggcgccgaaggcgtagagaatcgaccgtttcgccaactgcagcagcacggtgagggtcagggctatggcgatgaggaacgcggcgctggtgccgaggatgcgttcggctttcttgaagttgccgcgcccaagttcaatggaggcgcgcggcgcgccgcctgcgccgatcagcgaggcgaaggcggtgacggccagcagaatcgggaagcagatgcccacgccggtcatcgccgcgttgcccacttcggggatgtgcccgatgaacagtcggtcgatgatcgtgtacgaggcgttcgccgcctgcgccacgatggtggggaccgacatggtcagggccagacggggcaccggtttggtgcccagcccggcatcgatcgtgttcgcctgtaccaaggatcagctctgccagtagtagctgaagaagtcggagatctcccccatggtttcgcgcagcatgcccatgcgcggcaggtacaccacgcggaagtggtcggggcgatgccagttgaacgcgccgccgtggctgatgaggatgtgcttgtcatgcagcaggtcgagcgcgaactgctcgtccgagtggatgttgaagcgtttgacgtcgatcttcgggaagatgtagaacgcggccttcggcttgacggcggtgatgccggggatctggttgagcatgtcgtagacgaggtcgcgctggtcgtgcacgcggccgcccggcacgatgtagtcgttgacgctctggtggccgccgagcgcggtctgcaccacggactgggcgggcacgttcgaacacatgcgcatgttggcgagcatgttgaggccctcgatgtagtccttggcaatgcgcttgttgccggacagaatcatccagccgatgcggtagccggcgatcatgtgcgatttcgacaggccggagaaggtcacgcagaacaggtccggggccatcgaggcgatggagatgtgctgcaggccgtccatgacgaggcgatcgtagatttcgtcggagaagatgatgagctggtgttcgcgcgcgatgtcgacgatctgctggagcacttcctttgggtaaagtgcgccggtggggttgttcgggttgatgatgacaatcgccttggtgttgctggtgatcttggagcggatgtcgtcgatgtccggataccattcggactgttcgtcgcacaggtagtgcacggcggtgccgccggctaggttcacgcaggcggtccacagcgggtagtccggggatggcacgagcacttcgtcgccggtgtcgagtagcgcggacatggacaggttgatgagctcgctgacgccgttgccggtgtagatgtcgtcgatggtgacgttcgggatgttcttcagctgcgcgtactgcatgatggccttgcgcgcggagaacaggcccttggacggcgagtagccttcggtgtcggtgagctggtgggccatgtcgtagacgacttcgtccggcgtgcggaagccgaagggtgccgggttgccgatgttcaatttcaggatgtgggtgccgttggcctccatgcgcatcgcctcgtcggcgaccgggccgcgcacgtcgtagagcacgttgtcgagcttgtgcgatttgccgaaggtgcggcggcggcccacgggaatctcgctgtccgtctggggcttggaggcacccgtggcaagcggtgtggcggcgtgttcgccgtccgtgacgctgttggaggcgtccgagttcaattgcgtggtggattcctcgccgcgcagccagttcatgtcgacgtccagttcgctggccaggaattcgagcacgtcctcgcggggcatggtcttgccggccacgtattggctgatgtggctcttgcccatctttacaccacgatgttcggcggcgtgcaccaaatcgacctgcttcagtcccctgctgttcatcgcattgcgcagacgttccgcaaacaccgatacgctcatatccttatgcctccaaccgggagttcaatttatcttttgaacaacggttcaaagcatacccccggttcaacacaagttcaattttggcgtgttctcgagtctcgaccggttcagcccaactgcgcttcaatccattgggcgacgccgtcctcgttgttggacgggcagatctcgtcggcgatggacaacaccttggggttcgcgttggccacggccacgccccggccggattcgctcatcatgttgatatcgatgaggtcgtcgccgaaggcggctgtctgttcaagcggcacgtccagtcgctcgcacagcaggtgcagcgcgtgctccttgttggcctgcgggttcatgagcatccacatcacgccttcgctgatggagatgtcgaagtccggcggaatcagcgcacgcagctcgttccactgttcaggctcggggaagatggtgatcttgtccgccacgccttcgggcacgtcgtggaagttcgtgtattggaaggcctgagttttccaatacacgcgcacatcgaagttggtgtagcgcacgtcgttcatcacgatgccgagcttcaggccgggcatgcgatcgagcaggaacagacagacttcgcaggcacgccgtgaggagaagccaatcttgatcaaatggttctcatcggccggcgtggcacctgaggtgagcaggtcgaagtcggagtgggccgggtcgaaatcgatgagggcgccgttcagatagattacggcgtccaccggcagtttttcggcgaactggagaccggtactcaccggccgcgcggtggcgatggcgaattgcattccggcatcgtgcgcgcggttgatggtgtcgatgctgcgctgggtgatgaaccggtcctcgaatacctcggcgtcgtgcagcaacgtgccgtcgaggtcggcgaccagcagtcggggttgtttcggcgtgatggcgtcgagaatcacagcagcccctcgcagtgttcacgcacgagttcggcggaatggtgcagtttggcccgctcgtcctcgctcagatcgagttcgacgatctcgttggcaccattggcgcgcagttcagtggggacgccgaggaacacgtcatgttcgccgtattcgccgtccaacagggtggagacgggcacgatgcggcgttcgtcccacaggatggtctgtacgatgccggccacggtggaggcgatgccgaagttggtgccgcccttggccgcgacgatctcattgccacgggtgcgggtcttctcttcgatttcggtggtggacacagaggcgaaacggtcttggttgtcggccaggaagcgggcgaatggcttgccgccgagcgagacggtggaccatgcggtgaactgggagtcgccgtgctcgcccatcacgaagccgcccacgttgcgcgggtcgaggccggtctcttcgccgatgatggtcttgagacgcgaggtgtcgagcgcggtgccggtaccgagcacctgggtgcgaggcagaccggaacgtttccaggcataccaagccatcacgtcgaccgggttggagaccatgacgatcacgccgtcaaaaccggaggccatgacgttgtcgaccacttcgcccacaagacccacggtgaagccgagttcggccatgcggttggagttggccggcggcttgcggcccacggtgatgacgacgatgtccgcatccttgcagtcggcgtagtcgccggcgcgcaccttgacgtggcggtcctggaattcgctgccatcatcgaggtcgcgggcctcccccagggccttggcggcggaacagtcgatgagcacaagctcattgcacaggccgtgcgtgacgatgccgaaggcggcggtggcaccgacctggccggtgccgacgataacgactttgttgcggttcatagtgaccatggtgatgtcctttcgtaatactcgatagaacgcatacgacccatgaccgacggtaacggtcatgggtcgcgagcgacaagtctatatggcgtgcaagccaatcagccgaggttgaacttggtcatcatgtcgaggccgatgatcaaggccacccacaccagagcgatgataacggtccaacggttcaggttcttttcggcgacaccggaagtaccggcgttctgggtcagaccgccgccgaacatgtcggacaaaccgccgcccttgcccttgtgcataagaatgagcagggtcagcacgaagctgagcagcacgacgatgacttgcagcgtgatcttaagagcggtcacagggtacctccggattgattggactgttgaccagcatagcgcacacacaggaaaaccgtggtattagttccgtgatttcgtggatttcagtgccagtcgagcgattttggcgagttcctcaacgtccagggccgcccccccgatcaggaagccgtcaacgtcgggctgggaaatgagttccgccgcatttttcgaggtgaccgatccgccgtacaggatacgtacgctatcggataccttcgtgccaaaagtggtcttcaaatcgttgcggatggcgtttgcggcatcctgggcggattgcggagtggccaccatgccggtgccaatggcccagacaggttcgtaggccacgatgagtttggcggcttgttcttcgttgagatcgcgggtgacgtctcgtacctggcccacggcgaaatcgagttcaatgccttgacgtcgttcctcgaagctttcgccgacgcacaaaatcggctgcatgccggcggcgagcacggcacgtacctgatcgacgatattggcgtcatcttcaggatggtatttgcggcgttcggagtggccgacgatgacgtatgagcagccgagatgggcgatcatgtccgcggacacatcgccggtgaaggcaccttgggtggtcacggaaacggattgtgcgccgtaggcgacatggagcttgtcggcttcgaccagcacctgcacgctgcgcaatgacgtgaacgaggggaaaagcgagacttcgcagcgtttaaagtcgaagtgagcgtcacgcaacagccataccagcttctgcacgaagtaagtggcttcaagatggtcgaaattcatcttccagttgccggccaccaacggaatgcgtttggacgccatatgtttcccttctaaaaaaacgtagctcccctcaaggaggggagctagaaaatggattactcaagcaccttcaggccagggagctccttgccttcgaggaactcgagggaagcgccaccaccggtggagatgtgggagaagccgtcctccgggaagccgaggttgcgcacggcggaggcggagtcgccgccaccgacgatggtgaacgcaccggctgcggtggcgtcgaccagaccctgggccacggccttggtgccggcggcgaactcaggaacctcgaacacgcccatcgggccgttccacacgacggtcttggagtcgacgatcttgtcgtggaagagcttctgggactccgggccgatgtccagacccatcttgtcggccgggatggcgccggcggcaacgacttccggagcaaccggggtgtcaccggccgggaagccggcgttcacgacgacgtcggtcggcagcacgagctcaacgccgttcttctcggcggtctcgatgtagcccttgaccttctcaagctggtcctcttcaagcagggaggtgccgacctcgtagcccttggccttgaggaaggtgaacaccatgccaccgccgatgaccagacggttggccttgtcgagcaggttctcaatgacaccgagcttgtcggagaccttggaaccgccgagcaccacggtgaacggacgctccgggttctcggtggccttagacagggccttgacttccttctcgaccagcaggcctgcggcggccggcagatcggcggcaacgtcgtagttggagccctgagcgcggtggaccacgccgaagccatcggaaacgaaggcctcgccgagggcggcgatcttcttggcgtaagcggcgcgttcgtcggcgtccttagaggtctcctccgggttgaaacgaacgttctcaagcagcacaacgtcgccatcgttcatggcggcgaccttggcctgagcgtcctcgccgtaggtgtccttggccagcggcacgttggtgccgagcagctcgccgaggcgggcggcaaccggggccaggctcagctcaggaacgaccttgcccttcgggcggccaaggtgggccatgaggatgaccttggcgccttcttcgcgcagggtcttgatggtcggcagagcagccttgattcgaccgtcatcggtgatggtggtgccgtccagcggaacattgaaatcagcgcgaaccagaacgcgcttgcccttgagatctccaaggtccttgagtgtcttcatgaatatcctttccttgacgaatcgcacgtcaaagtggccaattttgccactttgcatattacaggcattccggaacaaaacaccgcattcgtctactgactgaatgcggtgttttgttacatcgttgtcgcgttttgccgaataggcacggcaaatcggattgtcgggttacttgccttcggctgcgcgagccttctccgtcttctcggcaagctgaagcagtcggcgaattcggccggcaatcgcatccttggtgatttgcggttcggcgatcttgccgagctcctcgaggctcttgtccacgtgatcgatgcgcagctggccggcctgacggaggttgtccggaatgttatcgccgagtacttcgaaagcatgctgcactttttcgctggcttcggcggcggccttggcggaacggcgcatattggcgtcatcgaagttggccagacggttggccttgccgcgggcctcgccgtcggagcgcttgccggtccattcgcgggccgaacgggtggcgcccatgagcttgagcatgcgttcgatggcgtcgggatccttgagtgtcacgcgctcggagctacgcagcgtgcgatgcttggcctggatgcctagacgacgggccacgccacacagggccatggcggcctcttccgtggggcaagcgatttccaggaagctggccttaccgggatcggacaggaagccacgggccatgaaggcgccgcgccatgccgctttgatttgggcgatggatccgttgaccacttcagacggcagtccacggacctgctgcttgcggcggtcgaccagtccggtctgcaaagccaaggccactacgttgcgggtgacgagcaccacataggtctcgacagggccgttcggggtctgacgtgtgaggtgattgacctcggcttcgtgcccgaacgtgttcctcaacgtgttcttcagccattctgcaacgtcaagcgaggtgaatacggcttggataacgtatgtattctgtaccggtcgaagaccgccgccaaaacggatcatggccgcagcttgggccttgatcgcggctggcgaatcgccttcaaaggctgccaactcgcttttgacatcgtccagaagagccaagatctacctcctacagtcccgttcttctcaatgcttcaggcgcttcgtgccgttatctgctgtcacacggtcggaagccatcggctttctgtgatacctaatctggtggacaagcgaacccgtttgatacgtattatgggctctgctttctcgcagtgtggtcaccgaacgcttgcccgatgaccgctcgacgcctgcttacgatgagtgacgcttgtgctgttctctcgcggaaacggttacgttgagcccatgtgcgcgtaagcggcgagccagctcttcgctcatcgccaccgaccggtgctgaccaccggtgcagccgacggcgatggttacgtagtgcttgtcttcctgggcgtatccttccaacgcaatctcgatagctttctcataagcgtcgagaaattccttggctcccttgctggaaagcacgtagtcggcgaccggcttgtcgtgcccggtaagctcgcgcaggttgggcacccagaacgggttgggcagaaaacgcacgtcggccacgaaatcggcgtcgatgggcataccgtatttgaagccgaagctgaagatgtgtactgccacggtggtggggccggagccgagcatcgcctcgtagagtttggtggacagctggtggatgctcagggagctggtgtcgatgacccagtcggctcgttccttgaggtcttccagcaggtgacgttcctcaaggatgccgtcgatcagtcggttgccgtgctgcagcgggtgcgggcggcgcacggattcatagcgcttgatgagcacttcgttgctggcgtcgaggaacagaatacgggttttgacgccgagatcatccagatggccgagcacggcggccagctcgtcgaaatagctggagcgcacgtcgatgacggcggcaagcttgtggacgcctgactccgatccggaaccggaggtggtcatcatgtcgacaagcgggataagcagtttgggaggcaggttgtcgaccacataccatcccatgtcttccacgcagtcagcggcatgagagcggcctgcgccggacataccggtgatgagcagcacttcgaaggcatcaagcggggtcggctggttgtccggagtcgatgtggatgtcgcggaattcgccggcgcattcgtggcggccgcctcgccggtatcgcggttcgttgtctgttgattcattacagcgcctcctcaagagctttgcgcatcgcgatctccagctggtcgtcttcggtggtggtgtcctgcagacgctggtcggcatcgctgggcgggtcgtcatcccagataccggtcatcagcaatacctgtacgagagcttggtacagcagcatttcttcgccgccgatggcgtgaccgccatgagcgcgccaggcttccatgagcttggtggggcgtggatcgtagatcacgtccaacagcagtccggagaatggctcggttccggcatcgacgagggcatccgcgacgttgtcggccgcgtgtccgggaatcgtgttgatgacataggtggcgttgcgggctgcctcgagcagggcctgatcgtcgcctaattcgatttcgttgtacgggttatgcacgttgacgaacttttcggccactggtttaagcccggtgttttttccggggtggcgggcggcgacgacgatatggccgatttcgggcatcatgcagcatgcggccaacgccgaagtggcggtgttgccattgccgatgatcagcgcggtgccgcttctcgacgcggtgtggtgttcgccgagttcgcgattggcatggtcgaaggcgagttggatgccgatgacatcggtgttgtatagcttgatgcccggcttgccgttcggccaagcgggatcatcggcagccacgctccagtcgaataccgcggtattcgccaccttcagttccttggcccacaaattttccggaacaccgtacggttggatggtcttcttcaacggcatggtcaggctcaggccagcccacgtcgagtcaaggcctttgaggaaagcgtcgaggtcgtcttcccccacctcgtgcttgtcgtacagccaatcgtcgagtttcagcgaacggtaggccgcgttgtgaagcacgggtgacaatgagtgtgcgacgggtttgccgagtacagcgcaacgatgattggccatatcccctccttgatgtctgttcccatgctagccgacactttgcttcgaatatgtcaaccacaggccccgcaaccgaaaatttactctgggctgctggaccgggccggctcactgctcgtgcagcgcgttgtacagcgcttcggctttggcgtggccgatgcctttgaccttctcgaagtcctcgacactggcttcgcgcatggctttgaccgagccgaagtggttgagcagccgcttctggtagctttcgccgatgccgggaatctcgtcgagcgcgctgcgcagggcgcctttgcgccgctgctggcggtggtaggtgatggcgaagcggtgggattcgtcgcgtacacgctgcagcagatacatgccttcggactggcgtttgaggatgatcggatagtcgtcgtccggcacccacacctcttccaagcgtttggccagtccgcagacggccacgtcgttcacgccacagtcctcaagcgccttggcggcggccatgacctgcggcttgccgccatcgaccaccaccaggttcggcttgtaggcaaagtgatgccggtttgtgttctgctggacgatgtcgggcggggactcccgcgcatcgttctgcactccgaccggcaccgcgtgccccttgccactgatgtcggaaccgccctcaccattgtcgttaccgttcgcagcgattgtctccgccgccacggcagtggtcatcttgccggcggccgaggccacacgctgttccgcgtcgatgctttcgccggagtcgccggcgatgttgccgtgcttgaagcggcgggtgagcgtctcgtaaagcgcggacagatcatccaccgcgcctttgccgtccttgcctcggatggcgaagcgtcggtattcggatttcttggcgatcgcgtcttcgaacaccaccatggaggccacctggaaggcaccgcccacagtgttcgaaatgtcgtagcattcgatgcgcagcggggcttccgcgagtcccaatgccttggccacatcgttcatggcctgggtgcgtgcgcccatgtcggagatgcggctcatcttgctgcgttgcagtgcttggctggcgttctcgttggcgcggtccataagctgcttcttgtcgcctcgcgaggccacacggatggtcaccgctcccccgcgcagattggtcagccagccttcgagttcctcacggcgggccggttcgacgggcacgatgatttcgcgcggtaccggtgcgatgggcgccagcaggtccgcgcgcccggtggtctcctgacgggtgttgcgttctcgggtggcctgggcgcgtgccacagcgtccgtggccgtgatggtttgcgtggagccgatggcctcgcgattggtggagatggtcgcggccgactgggggtgattgtccccggcggcgtccgaatacacctgcaccagaaggtcggccatcaagtcggcgtcatcgatgtcctcaactcgttcgacgctccagttgcgttcgccgcgaatcgagccggcgcgcacataaaaagcgtgcacggaggcttcgagctcgtcgctggcgaagccgaacacgtccgcgtccacatcctggtcgaagacgacggcgttctgttgcaccacggtttccagcatttggatctggtcgcgcagtcgggcggctttctcgaattcgagttcggcgctggcctctttcatgtcgcgggtcaactgggcgatgtatggccgtccgagtcgtccggtcatcacgccgaccagctgttcgcacagcctccggtgttcgtccgcttcaatgcggttcacgcagggtgcggagcatttgccgatggaagcgaacaggcatggccgtccggtcagttgcgccttatggaacacgttggtggtgcaggtgcgtaccgggaacgtgcgcagcaaccggtcaagactgtgccgcaattcccacactttggcataggggccgaaataccgggtatcccgccgtttgcgcgaccgcgtgacccacacgcgcggaattcgctcccccgtgctgaccgcgagatacggataggtcttgtcgtcgcggaactgcacgttgaaccgtgggtcgaattccttgatccacgtgtattccaacgtcagtgattccagttcggtggcgacgaccgtccactccaggctgcgtgcggtcagcaccatggtctgcgtgcgcggatgcagcagatacagcggctggaaataattggtgagcctgttgcgcaggttctttgccttgcccacataaatgacgcgcccttccccgtcgcgccatttgtacacaccgggtttggcgggaatatccgaggtcttgggtcggaacaggtcgcgagaatcccccagcaaaggtgccccattcgcattcaccttcgccgtcgtttccccggcacccacagctatgctttccgacattaacgccgccgcagtcttccgccactcatccggactatgccgctcaatatcgttcgtcataatcctcctcgctattaagcaaaccaatcatcagggattgggtgggttggggtgtgtgttgctggaccgtaaagacttgacctgagcggcccggagcatgtccagcaacaaacaccccaacccacccgaggtcagctgcaatggaaggctaaagcatgggtttcaggaacttgccggtccatgaggcttcgcattcggcaacctgttcgggcgtgccctgcgtgacgatggtgccgcctccgtcgccgccctccggaccgagatcgatcagccagtcggcctccttgatcacatccagattatgttcgatgacgatgaccgtattgcccttgtccaccagggactgcagcaccttgagcagcttgttcacgtcttcgaagtgcaggccggtggtcggctcgtcgaggatgtacacggttttgccgtcggatcggcgctgcagctcggtggcaagcttgacgcgctgcgattcgccgccggacagggtgggtgcgggctggccgagtcggatgtagccgaggccgacgtccacgagggtcttcaggtatcgggagatgccggtgtacgccttgaagaagtcggcggcctcctcgatgggcatgttgaggatgtcggccacggtcttgccgttgtacgtgacttcgagggtctcgcggttgtatcgtttgccgtggcagacctcgcagtccacgtagacgtcgggcaggaagttcatttcgatcttcagcgtgccgtcaccgtggcaggcctcgcatcggccgcctttgacgttgaaactgaagcggccggggccgtagccgcgcacctgggcttcgggagtcttggcgaacagggtgcggatcttgtcccacacaccggtgtaggtggcggggttggatcgcggcgtgcggccgatcgggttctggtcgacgtggatcaccttgcgcacctggtccacgccttccacgcgcgtgtggcggccgggtacgatgcgtgcaccgttgagcttgtcggcgagcaccgggtagaggatcgtgttgaccagcgaggatttgccggagccggagacgccggtgaccacggtgagcacgccgagcgggaagctcacgtcgatgttcttgaggttgttctcgcgggcacccacgactttgagcacctgggtcttgtggatcttgcggcgcttggcgggcacggcgatctctcgccggtgggcgatgtagtcgccggtgatggagcgcttggcttctatgaggtgcttggcggggccggagtagatgacttcgccgccgtgttcgccggcgccggggccgatgtcgaccacccagtcggcgcggcgtatcgtgtcctcgtcgtgttcgacgacaatcagcgtgttgccgagatcgcgcaggtggtgcagggtttcgatgaggcgttcgttgtcacgctggtgcaggccgatggacggctcgtcgagcacgtacatgacgccgaccagaccggagccgatctgcgtggcgagtcggatgcgctgcgcttctccgccggacagggtggcggccgcgcgcgagagggtcaggtagtcgaggccgacgtcgttcaggaagccgagtcgggccttgatctccttgagcacttcgccggcgatcagctgtgccgagccttcgagtttcaggccgttgatccaggcgagttcgcgtacgacgggcatgtcgcacacgtcgaagatggattttccgtccacagtgacagcgagcacttcgggcttcagacggcgtccgtggcagacctggcagggcacttcgcgcatgtacgactcgtagtattcgcgcatggactgcgaatcggtttcgtcgtggcgtcgcatgagcgtgcggatcacgccttcgaagccggtggagtattcgcgcaggcgtccccagcgattgcggtaggagacgttgaccttgaagtcgtggccgtagaggatgtcgtgcttgacgtcgtccggcaggcccttccaaggggtcttcatggagaagcccatttccttggccagaccttcgaggatgtggccgtagtactgggaggtcatcttggtgccgctccacggttcgatgacgccgtcggccagtgacctgtccgggtcggagatgatgaggtccgggtcgatttccagtttgaagccgagaccggtgcaggcggggcaggcaccgtagggggcgttgaaggagaaggtgcgcggctcgacctcgtcgagttcgagcgtgtgcccgttcgggcagctgcggtgttcggagaacggctggcggcggaccgggctgccttcctcctcgtccacgaagtcgatgatgatgctgccgttggcgagcttgagggcggtttccaccgagtcggtcaggcgttggcggatgccgtccttgaccacgagtcggtcgaccacgacctcgatggtgtgcttcttctgcttggtgagtttgatgtcgtcggacagctgcgtcatctcgccgtcgatgagcgcgcgggcgtagccgtcggagcgcagcagctcgatcatatccacgaactcgcccttgcggcccttgaccacgggcgcgagaatctggaatcgcgtgcgctccgggtagccgagcagtgtgtcgacgatctgctgcggggtctgggaggcgacgggctcgccgcattcagggcagtgagggatgccggtgcgggcgaagagcagtcgcaggtaatcgtagatttcggtgatggtgccgacggtagaacgcgggttgcggttggtggtcttctggtcgatggagacggccgggctcaggccctcgatgaagtcaacgtcgggcttgtccatctgacccaggaactggcgggcgtaggcggatagggattcgacgtagcgtcgctggccttcggcgaacagggtgtcaaacgcgagcgaggatttgcccgaaccggacaggcctgtgaacacgaccatgcgattgcgcggaatcgccaggtcgacgttcttgaggttgtgttcgcgcgcaccctgaatcgtgatcttgagatcgttcgggatgtgcgagatatcagctaccagcgaaccatcgtgttcgatcagcggcgcctttttgatctcccggctcaggaaggagtcgctggtcatcaccttttcgacgatgacctcaccgttcttgcccttgccggttttcgcgcccgttgcgcttgttgcgcgccttgcgccagtctgcattgccgccacagccacaccccaccttccatctcaccgttcccgcgcgcacggtcatgcgcgcgccaaatctgtcccaaggatacccgaacacacgaccaaattcgaacgcttgttcgatggcgtgtcaggccggaaaactgaaccagagtatgcaaaattccggaccatcagtggaccgaaacgcaagagccggcccccaagatactcggggcgtccggctctcacttccatttccccagcggggttggcttaccatgaagtatacacggttttaggacatcaatcactgtcgatgaacactgttcgaacatggccgaggaattcatcgtatcttccagtaccggcctgggcatcaccgtacgctcctagcagctgatcagggagccatagccttgcatcagtctcccctgcacagagttcgacacgaattggcccgataaatctgcggcttctcaatccatcgatgaaacggatatcgttcctgtcctgtgaaatctcgcgccgttcaagcacaagcgtgtccacgttgtattctgtttccagcagaggcagaagacgttccaaacatttacggcgagcgcgttcggcggtattccactggctcattggtaccgcagccacaatgacatgatcaatgtccattgcagccatggcatcaacgactttgccacgcaatgatggccgcatgtctcgccagtgcaatttccttgctcctttgggcttaagcaacgccaatctttgccttgtttcggtttccgtatcatcacatacgcatgcgcccatcaagtacataggcgagggaactccggttttccgcacactctcgtcaccccaagcggttgccatgtttgtcccttctcgcgcaacgcaaaacaacagttcgatagtatcggatagcagtgccggaccttgcagctatgcaatgccgttgcattattaatcggaaggcataatgtgagacgagaaaaagctaagccgttctagctcttggcaacatccccaatcactcagcctaaatcggcaaatcctgattttcaatggactccacggggatgccaagcttgcgtaattcgtcaactgcatcacgcatgggaatgcgttcctgttcgatgcgccgataagcgattgttttgtcagcacacagtcgttcataaagacgtcgctccgccgattgaaggccgggcgtcggcttaggctcccgcatagcaatcttcgcgctgcgttcagtacgatcggtaccaaatctgtggtaccgatcgtatgcatcgcaatccatcaggatggagtcgcattcgatacctgattcacgtaatgtcgaaagtatttccagtccatccgcatccatatcaccccaatacacgatacgcatgtcacgcagtgcaggaaccgcaggtacagcatcgcttacagcgcgaccagaaccccatatgcagatgccctgcgcaatcggcggcatagtctgatacgtgtctttgttctcaacgatgacagcatatttaatgccggataacgcttcgccttcccacggacaccatatgatgcgttcgagctcagcatcgtcgcggaccggatcgagataacggaaccgcagttcggtcggccgttttgacagacccaacgtttcgacaccgagcagtcggcaaatggccttacgacgattggtttttgactcattcagccatttgccgctgaatcctgtcagtggaatctgtcgcggcgtcataccggtcacgtcatgatgcctgaaatatcgaactgcgctgacaagcagatcgaagtcgtcaggctgttcatggcctgtcatgcgagcggccgattcgattgtttccggagcaacgtcacaagcagcaaccagacatgctatgcggcggcgcgcttcgcgacattccgccgccagcgtacgaccaaccacacgcatggctattgattcgtcaggaacgacgactttggagatcagctcgacagaggtgcctatggtgcgatgcttggttatgatttcgcaaccattcttgcttgcccattgccgtatctcattgttgttgtcatgcaccgcaatcgcattggtttccaaaaatgcttggtccggcaatcccaccggcacgggaaatggccatgccggttcgatgtcgtacatatgtgaacgcatatgtttcttcacgcatgtggtgatcgcagcgatgtctttcatgccggccacagttcccatcacctgctttcgaacatcgtcgagtcgaaccgaatcgtcttaataccggcgacgccaggactgctcattcggcaaccccgtcatccttcaatatatccgacgatgattcatcgtccatgtcattctgatgcagcacggcctcgcgcagggaggtgaggccggtgtcagggtccttgtaggtcacgtaggccttggtggagacctcgaggatttcgccggtcttgctttccggggcggagacgatgatctggaatccgaggcgcggcagcaccgtgagggcgcgctgcgtgtaacggccgtcggccttgatgagcgcctcgtcgaggaacagcgtggtgtacgagggctcgctggtcaggccgccgccgagcaggtagatgagcgccgcgccgtatacgaatgaggtgagctcctgcaaggcgccgcccgaacggccgccggtggaggtgatgcgttcatccgggccgtcggcatgatgcacgatggcgtagaaggacgagcggcaacgcgggtcgaggttgcgggcgccgtagcttttcacgccgttcgcgtccttgacctgcgcgagttcggcgcgcagcagcccgaccatcggcgcgcaggccgcgaaagccttgcgcgaggcgtcggaatcgttgacgtcggcggatttccaatcgttcagggtgccgatgacgcggatgaactgcgcccagaaggtgcgctcgggacggcgcacgtccgcgtgcagggacaggctgccgtgcttgggaccgaactgctggcctttgagcatggcgttgatgcggtcaagctggtcgtggatgtcgctggcatccgtgtcgatggcgcgtttgatggtcaggaagctcctgagcagctgttcgaggcagcgccggtattcggcgtcggtggcggcaaccgcggccagctgggtgaggctggcgagttcgtcgagatagtaccggtagtcctccacgctggcggtcagcgaatcatcgtcggccgcgtagagcgcgatgtaggtgctcattttcgattcgacgccggtgcgtgcggcatcggcctggccgttcagcaggttgatgcgggaggccatgtccttgccgatgccggcgatggtgcgttcggggaagctctcccccggcgcctgcgttcctgccgcgcccgcgccgatgatcatgtgcgcgcgcatggcggcgtccgccagtccggcgaatcggttgtcgtaggattcggcgagcgccgccgtgacttcgtccggcagcgggccggacgcggcgtcatcgtcattgtcggcggtggcaccggcggcgtccgtcgtgccggtgtcggcatggtcgcgcagccagatgagcgccgcttcgacggcgctgccggcgcgggccgcggcctggtcggattcgatgcgctggcgttccacacggtcgagttcggcgttcagttcgtcgcgctgtttggcgagttcggcgagcttgggatcgtttttgatggatgcgatggcgtcctgcgtgtccgtgatggtccgttgcgcgccggcgatgtcgatgcgctcccaggacgtgtaggcgagctggttggccagttcgagttcgcggtggaggttatcggactgtgttttggcggccgtgtagtcggtgtcggcttggctgagcgcgttgcgggcggcgtcgacctgcgctgcgagcgcgttgaggtaggtttcgttgacgaatccgatgacctgggcgcggtctttggtgccgtgctggccgcgtgcgccggatttgatctgaccgtcggcctgcacctgacggttggtgcggtcggtgtcgtcgatggcggtgacgcatagggcgtcgaatcgttcgtcctgggtctgcgagcgcagccagtcggcgaagggcgagtcgtcgcggtagcgcagtttgccggacagccagtcgccgtcctgttctccggtgagtatgttcgcgtgcgcgccggtgtcgtcgtagtggcgtgcggtgtccacgaactgccaggtgcgtcggggcatggtgcgcgggtcgatggtgctgactttggcggcgaagccctgttcgtggcgcttgtcgacgaggatggtctgggcgatgggcgcgtaggcgacgttcatggcgagacgccagtcttcctcgtgttcgttcacgtccatgagttcggccacgtacggcagttcggcgggggtgagtccggtggcgcgacagagcatggcgcgggtttcgtccatctgctgggagatgcgggtgcgctgggagcgttgccggtcgaagtcgcgttgcagtcgttcgaggtcgccgcgtgcgccggcccgcgcgttgatggcggcggtgagggcttcctcgcattcgccgtctcgtttgttgtattcgcgtttgaagttcacggcgttgatgcggcgttcgttccaggcctgttcgtcgccgggcagcgtctcgccgatggatgcgaacgtttgttcgattcgtgttcggttggcttgcacgtcttcgagggtgcggcgggcctggtcgagttcgagttcgagtcgggtcaggttgccgccgtccagaccctgcatctggccgcggatcatgtcgagacgggtgcgcaggtcttcggttcggcggcgcagcagcttggcttccgcctcgctgttctgttgttcggcgcggtcggcgggcagttggacggcgacttcgccgcgcatgcgggccaatgcccagtcgcgcagcacggccggtaccgtgccgtcgacggccggcttgaccggttcgaaggcgcgggccttgccgcgtgcggcggcgtattcgccgtaggcctgttggatgccgcgcagcgtgtccatgcggcgggtcttctcgtccatggcgtggaagttctcgtcgtaacgttcgtagtcctcgaccgtggtgcgggccaggtccagggcttcgggcacgccgagcacgccttgtttgaagatgtcgtcgagccgggagggcgcgtcggcggactggatcttgtgcagcagtcgacaggcggcctcgctcaggcccattgcgctccagatgtgtgtgtggaacgcttcggcgctggggaatgtgaggcagtcggggtaggtggctttgagctgggccggcgtgaacggggcgtcacggtattggtccatgcgcctggggtccacgggcttgccccagaccacgtactgtcggcgcacgtcgccgcggccgtcgccgggcatcaggtagaggaatttggcgcaggagagcacctggccggtggtctggttgcgataggtgtccacgatggcgccccacacgggttgcggtgcgccgttctcgtcgcggccgcgcaggtagagcggctcgtcgccggtttcggtgctgcccacgccgaccatgccgcgcaggtaggtgtagtcgctgcgttcggagcggccggagttcgaggccttgttgaacggcgtaccggttgggtacagcagggagatctgcgcgtcgaccagcgtggatttgccggattcgctggcgccggcgagcagggtcaccggcagcttgtggtccgtggaggggcggaattcgtggtagccctcataggagccccagttgatgagtcggcgggattccagcatccaccggtccgcgatcatctgcacgtctgtcgcctgcatcattcggctcccttctcgtcgtcatcgtcatcttccgtgtcgccgtcgccgtgttccgcgacgtcgagccaggtgtcggccagttcgcggtcgagcaccacgggcacgagcggcgtgatctggtacatggcttcgtcgtccaggcgcaccaaatacccgtaggtgatcatcgcggagacgatggcgccgatctgctttgccacgccttcctcgtcgttgcgggcggccagatagccggcgccggtggcgagcgcggcgcggatctcctcaaagctgacgagccagtcggcggggtcggcgtgcacgttctcgtattcgaggacgcggatgcgcaggaaggcgagcagcgcggcctcctcgcgtttgaggctgacacgggttttgagcgagcgcagggtcacgtcgtcgccggccacgggcgtggcgtacatgatgcggtagcgttcgttgatcaccaagtcgagcaggtcgttgttcagggagcgtacgacggcgtcgcggttgtcgagcacggtgtcgtaggtgggcccgctgatatagcggtcgcgtttaagggcgatggcggccatgcgtgcctcggccggcatgtcgccggtgtcgccttcgaacagggcgtacgggttggcgttgtccatatgctcctcgtgttcctcgtgttcctcggccacggtcatccttcctccacaatgatgctcagctcgtccatgtcggccagcaccggtctagtgatccagttccggggctcgccgtcgatcgatacgcaatgccaggtcgcggtatcgccgcgctgcgccggagccggctcggtggcgatgtcgctgtcgaccccgacgccgacgccgtcagtggacggctcgtcggcgatggcgttgccgcttacggctcccagcccgcccaggaagccgacgatctcgctttcgcggcgttcgctttcgggcagccggttgaagctggcggcgatgtccacgagggttgcgccgggcctgtcatcggacctgtcaacggtcaccgggttgcgccggatgaggctgaccatgcgcaggagtcgggggccgccgctgttgaccatgtcccgcagatcggccaccggagtcgactgcggggcttcggcggcgaggtcgctcaggccgggtgcggtggcgcgggtcatggatttggccgggcgcatcggcaatggcgcgaacagcgcgtccgaggtggccgtgtcgtacgggcgcgaggcgtctcccatatgggttttcgcatccgcgttgaggcgcgcgtacagtcggttcaagcgggtgagcatcgtacggtagcgagtgtcggtttgctggcgcacgagccggctgatcgcctcgtcggagacgcgcatctggcggcgcacggcttcgatgccgtcgtagatgcgggccagttcgtcgcggatctggccgagcagcacgccggattcgccggccagatacggggttttggcgatagcgcgcagggcttcgtcgatttgctggcggccctcgtcggtgatgatcacctggaaggcgtcctcgaagcggcggccgctgtctgattcgcggaacgagcggcggtattcatcgtggtagcgggtcaggttctcgtccacgctgatgtcgccggcctgcatgcgccgacgcaaggcgtcgccgttgtcccgctcgtcgagcacgagttcgcgcaggtcgatgggcacgccgcgcagcgtgttgtggatcacggcgatcacgtcctccacctgggcttcgctcagcgtggcatgctgcttgccctgttggatgcgtttgatctcgtgcttgcgttccttgatttcacggttgaggagtttgatgcgctcgccggggtcggcggtcagctgcatgcgcgcgtgctcgatttccatgatgatgctgttggcctgcgcgccggacagggcgcgtgattcgtcttcgagcctgctcagcgcctcgatggcgcggtgggcgcgggccgtcaaacggtagaggaatcggtgtgaggccgcatcatgcgagttggcgagccaggcgtagtcgccttcgccttcacgggtcaggtcggcgaggatctgatgggcggcctcggcgaaggtctggtcctcgcgcggcgcatattcgccggcgtcggccagagcgttcagactttgcgcgaaccgctcctccacggtctcgcgcggcagctcgccggtgagcgggtcgaacgtggaacgcagcagcgacacgtacagcatcgcgttctggcgcaacagcaaccgcaggacgcccgtctcatacaccggtcgcagccgttccagctcccgcatcacatcggccacagcatgcctccctctgtcgtgaccgcaccatactagccgatagccgcgaaccacaccccgcccgcgccacgtccttcgccccccacagggaggggcgccaagccatgctaaaaatcacagacagactattgcctttgcgggaaatcatcgttagattggcgagaggaatattgtcaatgcatacgaaacggaaaacatcgtgaccgcaccgaacacgcccgccgaaacctctgaccagctcaacaagcccgccaaatccggcaaactggaggtctccgacctcatcaccatcggcgtgtttgcggccctgtacttcgtgatggtgtgcatcgccacactggtgagcaccctgttcaccggcggcttcggctccatcttcctgcccgccatcacggccctcatctccggctgcgtgtacatgctgctggccgcacgcctcggcaaattcggcggcatcaccgtcatgggcgtgatcatcggactgttcctgttcatctccgggcatttcgtgctttcgttcatcgccagcatcgtgttcccggtggcggccgacctcatcgcgcgcgccggcaagtataagagcaaggcgctactgctcgtcagctacgtggtgttctcctacggcctgaccggcccgatcctgcccctgtggttcatgaaggacgcctacgtggcgagcctgcaggcgcgcggcaaggacgcagcctacatcgacggcgtattcgtcaacatcaacaccggcacgttcttcatctcgatgatcgcgattctggtgtgcgcggttctcggcggctggttcggccagcgcatgatgaagaagcacttcatcaaggccggtatcgcctgatgaatcctgcccgccggacgctcgatccgcgcgcgaaactctaccttctgctggtggcgaacctcatgctgttcttccacgtagggctcgccacgcaaatcgtcatggtcgtgctgttcctgctgcccctgctggcggccgcccgatggcgaaccgcgttgaacttcggcgtgacctatgcagtactcaccgcgctgggaatgctcgaccccgatgccctgggactgccgtggctgcatgtggtctccgcgctggccgtgggcgtcacgatgatgctgccctgtttcatcaccggcgcgtatacgttcaccaccacgtccgcgagcgcgttcatctgcgcgatgcggcgtatgcgcgtgcctgaggccgtggtgattccctgtgtggtggtcatccgcttcttcccgaccatcgccgaggattaccggcagattcgcaatgcgatggcgttgcgcggcatcgcctccggcggctgggggctggttcgtcacccggcccaatcgttggaatacattctgattccgctgctgatgaacgccaccaatgtggcacaggacctgtcggtggcggcactgaccaaggggctcgggcgtgagggcgagcacacctcgcgcacgctgatccgtatgaccgtggtcgactggctggtcatgattgtggtcactttgccgctcgcgctcgatatcgcgggggtgatctgatgggtggcaaccaatcgcagccgaatgcaactgccattattgggaccggcaagggtggcccactcgacacgtctgcgggaaccatcgcctcccgtggcatctcctttacctatgaccatgccgcagagccggcattgcgcgacatcacgttgaccgtgcccgcaggcgagtgcatcgtgctgtgcggggcgagcggctgcggcaaaaccagctatacgcgcgttgccaacgggctcatcccctcattcttccatggtgcgttcgccggcaaccagaccacgtgcgggctggatgtggagaccgtgccgatcgaccggctcaccccgctggtcggcagcgtgttccaaaacccgaaaacccagtatttcaacgcgaacgtcaccgacgagctcgccttcccggccgaaaacatagggctgccggccgaggacatcaatcgtcgtatcacggccgtggctgagcgctttggcattgggcatctgctgcatcgcagcatcttccacctgtcaggcggccaaaagcagcgcatcgccgtggcggcggccaccatgctggggcccaggctcgtggtattggatgagccgaccagcaatctcgacgcgaacgccatcgcggacatgcgcgccatgatcgagcagatgaaggacgaagggctcaccatcgtaatcgccgaacaccgactcgcatggctcaacggcgtggccgaccggtacgtggtattcgacggcgggcatatcgtgcaggattacgaggccgatgaattcctgtccctctcccccggctgcgtggccgccatgggattgcgggcgttggacctgcaaccgtatcggcaccggattgcgacgctggcttcaagcccggccgcggatgagtgcacttcggcattgctcggcacccataacctcaccatcggatacaaaggcaaggacggcttcacccgcgccatcccggacctgcggttccgtgccggcgaaatcaccgggctcatgggcaacaacggctgcggcaagaccacgctcgtgcgcacgttgaccggactcatcaagcctgtttcgggccgcatcgagctcaacggcgtgcccgcgaaaccgcgcgacctgacccgcgccggattcctggtcatgcaagatgtcaactaccaactgttctccgacagcgtgcgcgaggaactgctcatcggactcgacgagacggatgccggcatcaccgctcaagccaatcaggtcatggccgatcttgaccttgcagcgttcgtcgaacggcatccgatgagcctgtccggcgggcagaagcagcgggttgccatcggctcggcattgatgtgcggcaaggacctcatcatccttgacgagcccaccagcggactcgaccgctaccacatggagcaggtcggcgaactgctgcggcaactggcgagccaaggcaaggcgattctcgtggtcacccacgatgaggagctcgccgccggctggtgcgaccgcattgtcaatcttggcgccgacgattccgggaacaacggctcgcatgccagtaacccagatgccagcagccccaaccctaatgcctctaccaatttcgccaccgcatccacccatgaaaggaacgcgcaatgaccgccagcaacaccacggattccacggccttcgacatcaccgactggctcggtgaatgggaaagcttcgagcattacattgattcggatgacgccgccatccagcagacctgggaagccgccgagcaggcggtgctcgccaacccgaagatggccccgatggccgcgcgcggcatcaggacgttctggtcgatggcttgctccaccaccagcccggagaacatcatccatatcggctactggcgtgtgaacgagccggccgccgaatccggctccacggacgatgccgcgctcgccatcgaatggttcgccgaggacgacaccagcctcgacacctacgaatacaccatcgaccatgtcatcgagcacggtctcgaaggctcccccaccttcgtgttccacaccaccgatccggccgccgaagacagcccgttccgctggctacttgccatcaatccgctgccttcgcgcaaggcgttcgccgagggcgggctgctcaggccacctgcatttccagtacgccaacgatctgcacacgctcgtcgccacggatgaggccaccggcgtcgagaccttgcgcaatccgcgttggtacgccaccatgtgcgccaacgagggaaccgtcgaggaccgttgcgccatcatccgcgcgttgcaccacttgcagtagacctggcaacatacggcagtgacggctccccactagtgaaactagcatcgcttcagtagccgtgcgagtgcagatactcgtcatcgaagccgaaaaaatggccgatctcgtgcaacacggttttgcggatccgttggcgcagctcggcctgcgttgagcatacgcgttcatgcggccccttgaacagggtgatgacgtccggcatcacgccgctgtagcccgtagttcgcttcgtgacgggtatgccctcatacagtccgagcagctcaccgcacggattgctcattgtagccagttcgcgctcattgggttcgtccgcaacgacgatgccgacattctccagcacccgcgcaaaccgttcaggcaaatcatccaacacctgttcaatggcccgttcaaactcatcgtcactgatgtgcattcgctctccacacgcgaaatgccttggcaccaagtatgtaccaaggcgctgaaatctcagactagcaggctcagctgttgcggttgatctcgatgtcggtgacggtgaggttggcctcgttgatcaggttgaagaggatgacttcggccagcgggccgggctgcatgaaggtgtgctgcttggcctcggagacgtagtcgcgactgtcacggtagaaagcggtatcaatgccgcccggatagacggcgaccaccttgacactggtgcccttgtatgcggcctgcaggctcttggtgtagcctttctcaccccacttggtggcgcagtacacgctttcgttcgcgttgccgcgtgtggcggcggtgctcataatctgggcgattttcacgttctgctcgccgcaggccttgagggtttccaccgtccacagaatcatgcctttgagtcccttgagacatttgtcgacgtcggcggcctcgtaggcggtgggcaccttgaacgaaggctggccggcgttgttgatgagcaaatcgatgtggccgagcgtggcgatatccgccacggattccttcacgaacgcttcgtcggtgatgtcgccgacgtaggcgcggtaggagtcatcgggccactgcgcggtcagttcggcctgacgttcggcattgaagtcgacaccggccaccagccagccgttggcgatgagctggctggcgagctcgtagcccaagcccagcgcgctgccggtgacgatggcgattttcttacctgttgtggttggcatggcagacctctcctactactattcttcggctacgagtttactactattcttcagctacgagttcgagatacgaatcattccagaggtcttcgtcgccgtcgggcatgaggagcacgcgctcggggttgagcgcctcgacggcgccctcatcgtgggtgacgagcacgatggcgccctcatacttggcaatggccttcagaatctcctcacgggaagcggggtcgaggttgttggtgggctcgtcgagcagcagcacgttggctcgcgaggtgaccagcgtggccagagccagacgggtcttctcaccgccggaaagcacgtgagccggtttcatcgcgtcgtcaccggagaacaggaacgagccgagaatcgaacgggcctgcgtgttatcgagctcgggcgccacatgctgcaggttctccaacacggtggcgttcagatccaaggtgtcgtgctcctgcgcgaagtagccgatcttgcagccgtgaccgtattccacggaaccggtgtccggctcctcgatgtgggccagcaggcgcagcgtggtggtcttgccggcaccgttgtagccgaggatcaccacacgcgagcccttgtcgatggccaggttcacgccggcgaacacgatgttggaaccgtaggccttggaaatatccttggccatgatcggcgtgcggccgcagggcgcgggctcggggaaacggatgtccgccaccttctcggccttctgcgcctcggaggtgttttccagcagcttttcggcacggcgcatcatgttctgcgccgccacggccttggtggccttggcgtgcagtcgaatgccttgcttcatgagacggtcggccttcttctcggccacttcgcgttcgcggcggcggcgctcctcgtccaccacgcgctggtgcaggtaggccttccagccaagcgaatacatgtcgatctggccgagctgcgcgtccagatgccagaccttgttcaccacttcgtccagcagttcggtggagtgggagatgaccaggaagccgccctcgtacttcttcaagtagccgcgcagccattcgatggaatcggcatccaagtggttggtcggctcgtcgaggatcagggtgtcggcattggagaacaggatgcgcgccagctcgatgcggcggcgctggccaccggagagcgtgccgagctgctgctccatgacctcctgcggcaggccgagcgaggcggccatggagatcgcctcggactgggccgcgtagccgccagccttgtcgaagtcctgcatggccttgtcgtaccgggtcatggccttgctcatcacgtccggatccgggtcggtcatatccttttcggccttgcggatgcggttgatgatggtggcgatgtcgcgcgcgctcatcatgcggtcgagcgcggtctgtgtgggatcggaggcatgcgtgtcctgcggcaggtagccgagcttgccggagacgcgcaccttgccggcggtgggcagcatgtcgccggtgatcacgcgggtcagcgtggtcttgccggcgccgttgcggcccaccagaccgatcttgtctcccttggccacatggaagttggtggggtgaagcagcgtgcgcgcgccgatctgaatttcaagtccctgcacctcaatagccatgaataacctacttgcctgttacgaatactgtctcttaccaaagtccgactgtccatcatagcgaacaccatgccgaccgggctcagccgacgctcatgcgtccatacgcagccgcgcaactgatcggcaaggtgaagaatgcgacgcccggtatggtgatcgcgaccatggcgcacggtatcgaagctgccatcgaagccgctgtgagcaccgaaaccgacgccaccgacatcatgggcgaaacccactaacgtacagacagcgatgcccccgccgacaacttctgtcagcggggggcatcgctatgcgttgaacgttacagttcgcgcaactgggcggcgatctggatggattcgacgctggcctcggccttgttgcgcgtctcctgccattcggtggcgggcacggagtcgagcacaatgccggcaccggcctgcacgctcgcctcatggtcgcgcaggaacgcggtgcggatggcgatggccatgtccatgttgccggagaaatcgaagtagccgacggtgccgccgtagatgccgcggtcggccggttccaactcgtcgatgatttcgactgcgcgcggcttaggcgcgccagacagcgtgccggccgggaacgcggacttgaacacatcgaatgcggtcagcgaggggtcgaccttgccggtgaccgtcgagcagatgtgcatgatgtggctgaaacgcttgatgtccatgagctgcacgacttccacggactgcggcacgcacaccttactcaggtcgttgcgagacaggtcgacgagcatgatgtgctcgctgcattccttcggatcggcaagcagctccttggcgaatttctcgtcttcctcaggggtggcgccgcgagggcgggatccagcaatcgggaaggtcatcgcgtggccgttgtccaccttgatgagggtttccgggctggagccgatcacgttgaagtcgcggccctgagcgtcggtcaacgccatgaaatacatgtacgggctcgggttcagcgtgcgcaacacacggtacacgtcgaacgggtcagcaggcgaatcgatgtcgaggcgctgggagatgaccacctggaacacgtcgccgtcgacgatgtactgcttggctcgttcgacggcctgctcgtagtggctcttctcggtgcggaagcgcagctcgggttgggcgaccgtttcgtccaggatgttgacgcgggactcgtccggagccggggtggcggcatcgcgctgcatctggtcgagtcgagcgacggcctcgttgtaggcagcgtcggcgcgagtggatttatcatccacattcaccgcattggcgatgagccataccgaaccggatacgtggtcgaccacggcgatatcggtggccagggcaagcacggtctcaggctggccggtctcgtccggagcttcggcgcgcagggtcggttcccagtggcggatggcatcccagccgaccgtgccgaccagaccgctggtcaggttcggcaggccttccacatgcggggccttcagagtcttcaacgtggcgtgagcgacttcgactacgtcaccggtgacgggcacgccgaccgggaccttgcccagccagtcggcctgaccgttgttggagcgcagctgggccatcgagttgacgccgataaaactgtaacggctccacgtgccgccgtattccgccgattcgaggatgaaggtgccggatcggccgccggcgagacgctcgtagaagccgaccggggtgagcgagtcggcgagcagacggcgcacaatcggaatcacacggtatccggcgtcggccagttcgtggaactgttcgcgactgggccaggtggcgccccacttcaggtgtttgacgctgcattcgctcatattcgctcctttgcttacaactcgatgtcttgtttcatagtacgcggtcgctcggcttcccccagtcaggaaagcccgttctactgctcggccgggcgatggccttcgaccacgggcagggggccgccttcgaggaagcagctgcgcttgccggtgtggcaggcggcaccgacttggtcgacttcgacgagcagtgcgtcgccgtcgcaatccagggacacgcccttgacgtattgcacatggccggaggtatcacccttgcgccagtattcctgacgggaccgggaccagaaggtcacgcggccggtggtcagcgtacggcgtaatgcctcgtcgttcatgtagccgaccatcagcacctcgcgtgtgtcgtactgctggatgacggcggcgaccagccccttggcatcacgcttcaggcgtgcggcaatacggggatcgagttcagtggaattgtcgtatgtagtgtctgtcatacctatcttctttttgtggaccaccctcagtcagcttcgctgacagctcccggattatgtgcgacgtgcgcatagcgcattgccacgaacaattcactggattgttcgcccagcgggagcaaggtgtattcgtttagcgaacggtgtagccgtgcttcttgagttccgccttgacatcggcgatagtcaggatgccgtaatggaacacggatgcagccagcaccgcgtcggcacctgcttcgatggcgggcgggaagtcctcgaccttgccggcaccgccggaggcgatgatcggaatcttgacttccttgcgcacggcgcgaatcatctcgaggtcaaagccttccttggtgccgtcggcgtccatcgagttaagcagaatctcgccggcgccaagctgctcggcgcgcttgacccaccagatggcatcaataccggtggatttgcggccacccatcgtggtgacctcaaaaccggactgcgtatgctgctcacccttttcgcggcgggcatccacggagagcaccagcacctggttgccgaaacgatcggccacacggctgataagcgacgggtcgttgatggccgccgtgttgacaccgaccttgtctgcaccgcagcgcagcagtgagtcgacgtcctcgggcgtgcgtacgccgccgcccacagtcattgggatgaacacctgttcggcggtgcgggagaccacgtcaatcatcgtgttgcggtgggagctggatgcggtcacatccaggaaggtgatctcgtcggctccctgacggtagtattcggccgccagctccaccgggtcacccgcgtccttgaggttctcgaaatgcacacccttcaccacgcgaccggcgtcaacgtccaggcacgggatgactcgtaccgccaacgacatgcttcactcccctgttcggctttgcattacagtccttcagactacctaccgcccgttacatgcgccgcacctgtttctggaatatgagaatcatcatattgagcaccgacatggcagccgctcggcgtgagagaatggctcgtggaagttgtccgccgaatcaaggagattggcatggctgtcgaaaacagcaaggtactgatcatcgtcaacaactggggtatcgaggagaccgagctgacgcgcccgctgcgcgatctcaaggccgccggcgccaaggtgacgcttgccgccactaccttggacccgtgtgagacggtgcagcacgaccgctacgaaggtgaaacgctgaccccggacgcgcgcctgtccgacgtgcaggctgccgactacgacctgctggtggtgcccggcggcacctgcaatgtggatcgtatccgcgtcaatgaggatgcgatcacgctggcgcaggagttcgcgcacgaaggtaagccgatcgccgcgatctgccatggcgcgtggctgctggtcaacgcgggtctggtggctggcaagaccgccgcgccctgccgctatatcgccgctgatatcgagaacgcgggcggccattacgtcgacgagcagctgcacgtggacgacgccaacggcttcaagctcatcacgtcccgcaagcccgacgatctggactacttcgtgggcgcaatcaaggatgcgctgaagtagctaccgctccttggcagcgagctggccgcaggcgccgtcaatatcctgaccgcgggtgtcacgcagtgtggcggtgatgcccgcgcggtgcaggatctccaggaaccgctgttcgtcttccggcttggaggcggtccacttcgagccctcgatggggttgagcggaatcgggttgacgtgggcccagttgtcgccgtaatggttaagcctcttggccagcaactgcgcatgctcggcctggtcgttgatgccgcgcatcaacgcgtattcgatactgacgcggcgcttggaggccagccaataatcgtgcgcggcatccaacacctgcttggtattgaaacgcttgttcatcggcaccagctcatcacgcagttcgtcgctgggggcatgcagggaaacggccagacgcacgggaatgccttcggcagtgagcttcttgatgccggggaccacgcccaccgtggatacggtgatgttgcgcgcggaaatgccgaagccttcgggaggcatggcggaaatctgtcgtacggcggacagcacggagttgtagttgcccatcggctcgcccatgcccatgaacacgatgttgctcaggcggccctctcccccggccacttcgccgtcgcgcatcatcttggcggccacacgcacctgttcgattatttcaccggtggacatgttacgggtcaggccaagcttgccggtggcgcagaacgggcagtccatgccgcagccgacctgcgaggagatgcacagcgtggtgcgggtcgggtatcgcataagcaccgattcgatgagggagccgtcgaacagcttccacaaggtcttgatggtggtgccttcgtccgccacttggcgggtcacctcggtgatgagctgcgggaaaaacgcggcggcggcctcgctgcgcttggctgccggaaaatcagtgaattcggcggcattcacatcgaaatggccaaagtaatggttggcgagctgcttgactcggaacttcggcaatccgagttctgccgctttctcgacgcgctgctcgggcgtcatatccacaaagtgcagcggcggcttaccacggcgggcatggtccttggatagcacgtcacggaaggcacctgatgtgccgccgggagtaatgccggtttccggagtgtcaggatgctgtgtggtcatgatgggttcgcttcgctctcaatatcagaaaatagtcaaacatgcaatagtaatatcagaatccaccatacggcgtgccgcatacgaatcagatggcccatgtcttagcccatagcgaacgcatattgaacgatgatttccccatatatggtatgtggcaccgtgcgatatacacacgatgccacattgttcatgcacgagacatgcgaatcacagtccggtgatccacagcaaggcgcaggtgaacggtgcactcatcaaaatggaatccacacgatccatcacaccgccgtgccccttgagcagatggcccatgtctttgataccgatatcgcgcttgagcatggaagcacacaaatcaccgaacgtgcccacggcaccgatgagaatacccgccacgatcggcacccaccaacgagtggcccatttcgaggcatcatacgtgcatgcgaatacggcaaatgcgccagccatggcgaagagcatcgagccgacaaggccctcaacggacttcttcggcgagatgcgcgggctgagcttgtgtttgccgagccaggcaccggcaaacaaaccgcccgtatcggatagggcgggtaggaacaccagcatgatggcgtgtgcaatcggatgcccattaaaagtcagtgagatgatgacgcagctggccaacaacggaatatacaacacggtaagcacggacacagccacatggctgagccgggaatgatgctgttccccgccctcatgattaaacgaggattcgaggcgcgcgctggcatccgtgttggacagtttgccggcaaccgccagagataggcggttgccgacgctgatttttgcgctggccgcgatggcgaccagaataatcgacacgatgatactcagcgacatcgtgatgagatggtacggggaatagtaggtggcaatgagggtgaaggacgagcacagccacagcataaacaccgggaggtgcaggcctacggtggcgaagtccaccctgagctcccacagcgccagaatcatgaacacgactaccagcagcacgaagaggtcgacgctgagcagcaggcacgcgacaataaggatgaccagtgccgcgcctgtggcgatggcctgcggcatgttgcggccggtcttcttgttgatctggtcgagcgtctcctcggcctcttcatggggttgttcgttgcgttccataattctccggacctggtctgaatcagacctccatgatctccttctgcttggtctccagcagagtatcgatctcgtcggtaacggacttggtgaccttgtcaagatccttcagcaggcgatcgccttcgtcctcacccatctcgccgtccttgacggccttgtcgatggtttccttggtcttacggcgaatgttgcgcacggcgaccttgccatcctcggccttgcccttggcgagcttgacgtattccttacgacgatcctcggtgagttccggcatggtcagacggatgacgttgccatcacggttcgggctgatgccgagatcggagttgcgcagggccttttcgacggcaccggcctgggaagcgtcaaacggggtgacggacagggtgcgcggttcgggaacgccgatggaggcgacggccttaatcggggtgggggcaccatagtagtccacggtgatgccgttgagcagggccgggtttgcgcgaccggtgcggatgccggagaagttttccttggtgttttccacggtcttggccatctgttccttggcctggtcgataagagacatattcactccttgtgtgttggtgttcgtcagtgttgttcgtctatgaacgcttgattcgattgtgggcgtttgcggcttactcggccacgcgcgattcggcggtggagaccagcgtgccgatttcatcgccgacgagggcgcgggtcacgttgcccggctcttcgaggccgaagacgcggatgcgcttcttgttgtcgcgggccatggacagtgcggaggcgtccatgacggccagattgtccacgagggcgcgattgtagctcagggtttcaaaacgcttggcgttctcgtccttgcgcgggtcggcggtgtagacgccgtcgacgccgttcttacccataagtacctcgtcgcagtggatttcgagggaacgctggatggaaaccgtgtcggtggagaagtacggcatgccggcaccggcgccgaaaatcaccacgcgacccttttcaaggtgacggatggccttgagcggaatatacggctcggcgacctgtcccatggtgatggcggtctgcacgcgggtggcctgcccctcctgctccagaaagtcctgtagagcgaggcagttcatcaccgtgccgagcatacccatgtagtcgccacgggaacgatcgataccggcctgctgcagttcggcaccgcggaagaagttgccgccgccgaccacgatggccacctgcacaccctgttgtacggccggaacgatctcctcggcaatgcgacgaatcacctgggtatcgatgccgaccttgccaccaccgaatgcttcgccggacagcttgagcagaactctgcgcggattgtcgctatcagtcatattgtgcctttctcaaaaccgaaagtgcgaaattatccgtagacaagcgtatcggtttacgacgacaccccctagcaacgacacccttggaatagcgaaacgccatccgattattgaataaccggatggcgtttcgttgaaattacgctaagcgcgtggagtaagccttaggctcactcctcttcgcccttgccgacctcgacacgagcgaatgcggtggcgttgccaccgacttccttgaacaggtcgccgacggtcttggacgggtccttgacgaacggctgctcaagcagcacgacttccttgaagaaagcgttgagacggccttcgacgatcttcggaacgatcttctccggcttgccctcggccagggacttctcggtggccacgcgacgctcggactcgaccacatcggccggaacgtcctcgcgggtcagccacttggcgcccatggcggagatctgcagagcagcttcgtgagccacggcggcgccggccttgtcggtggcgatcatggcgacgatgctcggcggcatctcggcggacttcttgtgagcgtagacttcgacgtgctcgccggagatcttggcgaactggccgaccttgacgtgctcaccgaacagggcggcggcctcttcgacagccagcttgacggtggtgtcgccagccttggcctcgagcagctcgtcagcggagttggcgtcggcgtccacggcgtagccgagaacttcctcggtgaactcgacgaacttcggggtcttggccacgaagtcggtctcggagttcagctcgacggcgtagccggtctcgccattggcggtctcgacgaccttggaggcgatggtgccttcctgagccttgcggccttcacgcttgccggctgcggcgatacccttggcgcggatgatttccttggcgcgggcgacgtcgccttcggcttcggtcagagccttcttgacgtcgagcatgccggcgccggtgtcttcacgaacctgcttgatcagtgcggcggtaattgctgccattgattattctccttgagaaattttgcttacccgtgaacgatgggaagcgcttattcaggcacttcccatcgtagagcatcactcggccttgggggcctcggcggtttcgccctcggcggcagccggagcggcggcttcagcggaagcctcggcaggagcctcgttggtcaggagttccttctcccaagcggccatcggctgctcggcggcttcgccctcggccttgttggcgccggagcgctccagcagaccttcggcgacggcgtcagccatcaggctggtcagcagttcgatgccgcggatggcgtcatcgttggccgggatcgggtactcaacggtgtccgggtcggcgttggtgtcgacgatggcgacaaccgggatacccagcttgtgagcttcctcaacagccagggcttccttggtgatgtcgacgacgaacatcgcggacggggtgcggttcatgttgcggataccgcccagctgcttgttgagcttgtccttctcgcgctcgagcaggaggagctccttcttggtcaggccggagccgtgcacgtcggtgaagtccatttcctcaagttccttgaggcggttgacgcgcttggagacggtctggaagttggtcagcatgccgccgagccaacgctcggagacgtagggcatgttcacgcgggtggcctggttggcgatagcttcctgagcctgcttcttggtgccgacgaagagcacggtgccgttgtgggccacggtggtcttgatgaagtcatacgccttgtcgatcatgtcgagcgacttgaacaggttgatgatgtggatgccgttgcgctgggtgaggatgaactgcttcatcttcgggttccaacgacgggtctggtggccgaagtgcaggccagccttcagcatatcgctcatagtgatctgagccatggtattactacctttcattgtcggttcttgcctggccatgcgcacctgcgtgcagctgctcccccggtttcacgagttgtgcagccgaccgacacaagccgtcgcgagcatgacgcgaatttgttgtgtgccggttgacaatattgggtggctctggacaccagcgactgcgtccgttgccgggtggcacacgagtttcgagaatagcacggagccggtactaaaaaaaaacaggctcccctctctgaggggagctgtcgccgtaggcgactgaggggagtcacgggcggtaccggcagaaccaccctcagtctcactacgttcgacggctccagccagcgggagccgagtatggactacttcgcctgacgattgcgcatgtagcgcagggcttcgcggcgttcttccttttccaggcgatccaaatacacgtggccatcgaggtggtcgcattcgtgctgaagcatacggcccatcagcccggagccctcgagcacgacctcgttgccgtccaagtcgatgccacgcacgcgagcgtagtcggcacgacgggtcttgtaccacaagccgggcacggacagacaaccttcatcgccatactgctcgccggacttctcctcgagtacggggttcagaacgtagccgaccttgccgtcgatgttgtaggagaaggccctcaggctcacgccgatctggttggcggacaggcccgctcggcccggatcgtccacggtttccaacaggtcgtcaaccaggcggcgcacggccggggtgatttccttgatctcatcgcagggggtgcgcaggactgggtcgggcacgaccctgatctcacggatggccacttctcgttactcctcattcttctcgtcagccggctggtccggcttgctgccggtgtcagcggcattgtcagcggaatcgccggtctcgccctcttcgggttcggccttcgacttcttgatcttctccgacacgctagcaatcgaatcagacacgctggttttcatctgttccgaggcctgtttgacctgttcggacgcctgcttgaccgattcggaggatttcttgacggtctccagcgtgctgtcgatgatcttggcagtggcgggcagcggcttgttggatggcttgggcgcgtacagatcctcctcgatgacggtggcgtagcgctgcaataccttgggacgcaccactttcatgctcggggtgagtgtgccgtgctcctgactgaattcctcatccagcaccgcgaatttgcgcacggactcagcgcgggagacattggcgttggcctggtcgatgtactgctggataaaggcgcgcaccgcgtcgttgtcgctggcctcggcgagtgtcatgtcggcattgaggccctgaccttccagccaggaatgcagcatttcggggtcgagctcgataagtgcggacacgaacggcttgccgtcgccgactactactgcatgagccacgatcgggcaggtgtcgatgacatcctccatcggggcggggctgatgttcttgccgccggcggtgatgatgatgtccttcttgcgtccggtaatgaaggtgaagccgcggtcgccgatacgacccagatcgccggttttgatccagccgtcggcagtcatcgtctgtgcggtgagttcgggctgcttgtagtagccaaggaacacgttcgggccggtcagctcaatttcatcgtcttcgccaagacgcacgcccatgccaggcccaggcttgccgaccgaaccgatctcgttgtcgtcctcccaattgacgagcatcggagcggcggtttcggtcatgccataaccctggatgaaggtgatgtcattcatgccgttgaaaaagtgggccaaatccacgttgagcggcgcaccaccgcaggccagccatttgaggttcggtccgagagcggaacgaatggatttgcccaccgtggccatgtagaacgaatggcgcatgcgctcgatgaacgaatggccgcgaccggcctgctcatccttgctccacttgacgaagtgcttgaccgactgggcgaagatatgcccctggatgccggcaccagccttctgcgaggccgcgttatacaccttctcgaacacacgtggcacgcccagcaggtaggtgggcttgaagctgcggatatcggcgagcagtcgcttggcgtcgggaatgtatccgaccacgccgcagccaccgatgcacacgtactggatgtagcgggcgaagcagtgcgccagcggcaggaacagcagcagacggttgtcgtcgtacagcatgccacgcagaatctcgtagccgttaagcacgatgtgcgtgtaattgcggttggagagcatcgcgcccttgggcttgccggtggaaccggaggtgtagaccacggtgagcagatcatcggctttgatacgagcgatagccgcatccaacgtctcatcggatacgccatgcccgaagtcaacgacagcgtcaaggccatcggccttgaaattgaacacgtatttcatgcccggatgattgacacggatctgctcaagcgtctgtgcgcgctggaagtcgccggcaaaggcgatggcgggatcgacttcctcgacgatgcccgcggtctgacgggcggaatcggtctcatagacgggcacaaccacagcgccgattgccgcgcaagcgaaatcagccacaccccactcatagcaggtaggcgagtaaatcagcaccatggtgccggctttgacgccaagtcccaacaggcccttggccacctcgcgtacgcgggacagcatttcagtagctgtggcgctgcgccattggtgggtgttgtcatcctgccattccgcgatgatgtcatccggcgtgcgagctgctcgtttggacagcagcgagtagacggtgtcgtcatcggtggtgacatatctgggttcttctacatgttcacgcatggtcactactataggcgaaccagcctatgacacggcagaaccgtcttccgctaccagcgtaggaatcggtgtgcgggcggggccgtctggtcagcccaaatcggcatagatgcacatccatcgagaaccgatgtacttcagtttgaggttgactcgcagattttcctggccgatggtcatgaataccgccatttccagcgtgtccttgccggtgatcatgccgtcgatcaatgtggggacagtgggcagatagcagaatttcgctttgagctccggatgagtgaccatgtggatgccgagcaggtattgcatggtttgcagccggtccaggcatggttttgtcatggctctgttgagatgtgcgacgctgagtttgccacgtatcgcgtccgccgatgtgcaggcgatgcggcatgcagccatggccatggaatgacattccttcgcattcagcccgcctatgaatgtgggttggatgtgataccgcaccgggcgatccgacagctccacaacgatgaatccgtcataactcggcaacggcccgtactgatatgtgccgtggaaaaatcccgaatactccatgatgacccccttcaagcccccttgcaactcaccatcatcggcgagcgtctgtgctacaacatcacgaaaggcgcgccaagtcaaactacttgagcgcgccttcgggcaagttaagcctcctgcatggagggcaaacccccattttcagggggcaatcgggattatcgtgcggaatacgggttgaccaccatgccgcaacgctggaagttcttcacgtcgacgtagccggtggaggccatcgcgcgcttgagggcgccgatgaagttggtcttgccgtccgcctggtggctcggtccgaacagcacctgttcgagcgggccgaccgtgccgaccgtggtgcggtagccacgcggcagcgtctggtggcgggcttcggaaccccagtgggtgcccttgccgggggcctcggtggcgcgggccagcggcgcgccgagcatgaccgcgtcggcgccgagggccagggccttgacgaagctgccggagtcgcccatgccgccgtcggcgatgacctgcacgtagcggccgccggattcgtccatgtagtcgcggcgggcctcggccacgtcggcgatggcggtggccatcggggcctgcacgccgatggtctggcgggtggcggagaccgcgccgccgccgaagccgacgagcacgccggccgcgccggtgcgcatcaggtgcagggcagcggtgtagttggatgcgccgccgacgatgacaggcacgtcaaggtcgtagatgaacttcttgaggttcagcggttcctggccggaggagacgtgctcggcggagaccacagtgccgcggatcacgaacaggtccacgcccgcgtccaccacggtggagtagaactgctgggtgcgctgcggggagagcgcgccggccacggtgacaccggcggcgcgaatctcgtgcagacgttgcgtgatgagctccggcttgaccggctcggcatagatctgctggatacgctcggtggcctgatcggccggcagtccggcgatttcgtccaacagcggggtcggatcctcgtaacgggtccacagaccttccagatcgagcacgccgagcgcacccatcttgcccatggcgatggcggtggccgggctggtcaccgaatccatgggggcgccgatcaccggcacatcgaactcataggcgtcgatctgccaagaggtggagacgtcctcggggtcgcgggtgcgacgggaggggacgattgccacatcgtcgagtgcgtagccgagacggccttttttgcccaaaccgatttcaatttcctgagacatggtttccagcctattgcccgggtgggacgccaacaaggccgttcccacggaccggacgactgcttcaagtcgttacaaacatgcgctatgactaaatcatcttcacaccatctatcaggaggaagcatggccaaaatcaaggtcgaaggcactgtcgtcgaactcgacggcgacgagatgacccgcgtgatctggaaggacatcaaggatcgtctgatcctgccgtacctcgacgtgaacctcgactactacgatctgggcatcgagcaccgcgacgagaccgatgaccaggtgaccatcgacgccgcccacgccatccagaagcaccatgtcggtgtcaagtgcgccaccatcacccccgatgaggcccgagtcaaggaattcggtctcaagaagatgtggaagtcccccaacggcaccatccgcaacatcctgggcggcacgatcttccgcgagccgattgtgatgagcaacgtgcctcgtctggtgcccggctggaccaagccgatcgtcgtagcccgtcacgcattcggcgaccagtacaaggccaccgatttcaaggttccgggagccggccagctgaccgtcaccttcactccggacgatggctccgagccgattcagcacgtggtctacaactacggcgaagacggcggcgtggcccaggtgcagtacaacgtcaacgattcgatccgcggtttcgctcgcgcctgcttcaactacggcctgatgcgtcattacccggtgtacttgtccaccaagaacacgattttgaaggcctacgacggccagttcaaggacatctttgccgaggtgttcgagaccgaatacaaggacaggtacgccgaggccggcctgacttacgagcaccgcctgatcgacgacatggtggccagctccctgaagtggcacggcggttacatctgggcctgcaagaactacgatggcgatgtgcagtccgactccgtggcccagggcttcggttcgctgggcctcatgacctccgtgctcatgaccccggacggccagaccgtcgaggccgaagcggcgcacggcaccgtgacccgtcactaccgccgctggcagaagggcgagaagacctccaccaacccaatcgcatccatcttcgcgtggaccggcggccttaagcaccgcgccgatctggacggcacgcccgaagtccgtcacttcgccaagacgctggagaaggtcatcgtcgacaccgttgaaggcggtcagatgaccaaggatctggccatgctcatcggcccggacgaaccgtggctcgacaccgacggcttcatgaatgcgctggacgagaacctggccaaggctctggccgagtaaatcatcgaacacatcgtgcggacctacatgggtcatgtcatgtcgcaaactgtcatgattgtcgtgcttcatctggaatgttcctcagcacgataatcatgacagttgttcgatgcacgcacgtaatacctctaattgttcccggatatgtggcgatttgtccactggtccgggactttttcgtatacggcctactagaatcgtgattcagcttgttttcacgcccgcttgaggaggtttcgccgcttatggtgttcgcacgccgctcaaccaccctgctcgccgccattatcgcatcctgcgcgatggtgctgtcactgaccgcgtgcacctcagacaataagaccgttgtagatggtcaaaccacggtgacgtccaattctgccggcggcgtggccgtgttcacaccttcggacggcattacgctgaaccagcagacgccactgaacaaatgggcgaagctggtgcctgacctagccaaggctctggccgacgccggtttcaagaaaggcgatatcgatcatacgacgtccgactcgttggccaagcaaagccgcgccatccaagactttgtggtcgatcatctttcgaataacaccacggacgattccggcattgccatcgcgcccgacaacatgacattgctcgtggctccagtagtcgaggccgacgcttccactcgccaatacggcgattacgtgagccagaacctgagcaccaacgatgccacggatggggaagctacttctgacggtgaatcttccgaagacgactcgtccaaagacgattcgtccaacactgagagcgacagcactgcatcggacgagcaggcgcaggccgtggaccggctggtctcatcgctcaagctggccaaggaatccggcatgcatgtggtattgctcggcaacagtatcgagggatataagccggacgccttcgtcaagttctcggacgcccagaccatcggcaagctacaggcggaaaagatggtgtccaaactcaagttggataaggccagtaaagacaaccccaaatacattgaggtgctgctgccatacaccgccgtggacgaaaaaggcaacgccaacgattccacgttcgcccaagaggcgttccgtggtatctggcaggtactgggctcctactatcagaagggcgttgtggaaagcccttcaggcaccttggacggcaaatccacggaaaacgattggcaagccgtggcctacgatgccgctaaggaaggctccactgcgaaagtgcttgacaagcgtctggcaaaaaccgacggacagtccacactcacccgtattgacggcatcatcacgatgaacgactacatcgcctccgaggtcgtcaaggaattggacgatctgggatacaccggctctgccgccgatatcaatccgcagatcaccatctcgggcattgtcggcaatatcaccggcaagaaggatctcagccgcgacgccgtgccggacccgatcaaatcccctgaaaacgacaacgcaaacgactcatccagttccgatgacgatgcggacgaggacacctccgcttccgacaaggaccgtgactcgcagtggcctctagtaaccggatacggcgcgtatgtctcgaacatcccatccatcgtcaatggcaagcaatggatgaccggcatggaagacagacagaccatcgccacggatatcgctcaggcctgcgccaagctcaacaaggacgaagcgctgaattccatgccttcaatcaggaactccgaggtaggcggcgtgaagaagatcccgaccatcagcgaaccgttgctggctgtcagcgccagcaatctcaagtccgcgctgatcgaccccggatatatttccttggccgatgccggtctgtgattcatactcgtcacgccgctagccgcctgcgatgtctcttccgtacggccctgttccggccgacaatcaccgttaaatcatgacggtttcagtacgatttttcgactccccgcatattgctgtggatcaagataatcggccgttcctcgcttgaggccccaatgcaggcaacggtcttcgcaatggtccgagctgccttcaacgatgcctacgggctgtctgcgggagatcgtatcccccactgagagctcggtaacggccggttcgaatgtcgacgtgacacctccacgatgccgtacactcaccacatctttgccagctactttgccagcaaaactcacggtccctgcctgtggtgacagaattacggtaccttgctccgcaacaagatccactccacgatgacctggtgcccacgggttgatcggccgctcgaactgttgttcgacctgtggatcgtcgaccggccagtcgaatcgggattcgcactgattgccattgcgccacgccaaatcagacatatcggtgaaatcctccaccgtgtatgccgcatctccggtcaccgcagtatccgcatacgcaacatgctgaggcgtggatgccagccctactcccaaggcaagcagcaggccgataacggcggccaacgcgattatggcatccatacgccgttgccgttcctgagcccgctgacgcgcctgctgacgccgccggctggcacgtcgggcttcgtcgcgacgccaatcaaacaacagtggtgcattcatgagattcctccccatagtgtgagtgtgatgtgattccggcttctttgccggtgatacccaccttgaggggtccgaaacaggatgtccagccaaaacgacctatgtggttctagcttccgaagttatccacaatgaaatttcgcgtgacagtatcgccgcatcgtcatgttgttcgaccttcagccgcggccgatccatgtcacaaccgctgccatgcagtgacagcggaacatcagaactcttgtgattgttcccactgggttcgcatactcagacggttgttccgtttcaccgattccagtatttgccaagcagacaccagctcctcccgggggctgagcatttcatcagtattcgccgttccatagccagctcctctaccgttagtcgctagtgtatatccgtgttcggtttttggctgtatgagatagtattcgatgagtccgattctgcggaattcagcgcgacatgccctacacgcatgtaatttgctttttcgtggcaggcatgtaagatatgtgacttgtgcgcgagagaaatctcaaacacagctgacattcctgcgtagctcagttggcagagcatccgactgttaatcggacggtcactggttcaagcccagtcgcaggagctcacctgaacgggtaactccggccgggatgaaaattgaatattcctgcgtagctcagttggcagagcatccgactgttaatcggacggtcactggttcaagcccagtcgcaggagctcacctgaacgggtaactccggacgggatgaaaattgaatattcctgcgtagctcagttggcagagcatccgactgttaatcggacggtcactggttcaagcccagtcgcaggagcttccaaggccctcgcttcgacgggggtttttttgtatcccgcctcagcgcgaatgaggacggagtcgtccatgagtgcgtccggggttacgccaaggaaatcagcggtgccaatcaggtctgtgactgaccaaccagttcgccccaccattttctgagacattgagcctcgtgtgattcccagtgcgtttcccaggtccgtctggctttttccggatagaccaagataaacgcgaacgttcgatgcgatggcggcttcgatgcgctttccgtgctcttggctgaacggaaaagggcgcggccaggcaatacaagatcgtctcccggctgttgcgccgcaacgacgtggacctgctggtcaacgcatgcgacccggaccgcgagggcgaggccatcttccgccgcatcatccaccatgccggcgtcaacaagcccacacgccgcctgtgggtggcctcccttgaggaagaggccatccgccaggcattggccgccatgaaacccgaaggcgactaccgtggactcgctgactcggccatgatccgcgcgaaggccgactggctgatcgacatgaacgcctcccgcgcctacagcctcgtctacaacaccaggttcaccgtcggacgcgtgcagacgcccacattggcgatgatcgtggaacgcgaccggcagatcgaatcgcacaagcccacgccattctggaaggtcgtcgccccgatggggagctggaccctgaccggaacccatctcgaaaaccacgggaccgccgaagcattgctcgaaatcgtgaaccagccggacttcgccttcggaatctatgccgtgaaacgccaccgccagcacgacgcgccgccacgcctctacgacctgaccaacttacagaaggacatgtcgaaactgcacggcctgaccgcagcccacacactgacggcattgcaaagcctctacgaacagcgtctgacgacctaccctcgcaccgactcgcgattcatcacgcacgacgacctggacgccctacgcaaactcaccaacggggaccggctggcctccgggttccttgatcccgccgtccgtcccgctcagccccgactggagctgacggtgaacgacgcgaaggtcacgggccacaccgcgatcctgcccacgctccaggcaagcggggaaacactcggccaactcggtgatgacaaacgcctggtgctgacgcgcgtggttcgccgcatgtgggaggcggtggccgacgaccatgtgcatgacgtgaccctcgtcgtcgccaacatcgaccccgattacgatgaaagccatccgaacctcctacggatcagcgaagcggattcccgtttcaccagctgctccgaccagaccatctccctcggatggaagggcatcgaacccacgaagacccaagagcatgacggcggggaagacgaggaggacgccccggcgggcaacctcattcccgtcaacctcgccaccggagcgaacgccatgccgatgccacgcagcggagcccgactcgtggaggggaagataaaacctccgaagccctacaccgaggcgacgctgctcgccgcgatggaacacgccagccgcctcctggacgacgcgggtctcaaggccgcgctggacgacgacgaatcccattccggcggcatcggcatgccggccaccagggcagacgtgatcgagaaactgatccgatccgcatacgtggagcgcaagggcaagcaactacgctcaaccgaacaggggcggaatctgatcaacgtagtggcgctccgcctgaaggacgtggctctcaccgccgagatggaacaggtcctctccgacgtggaacacgggaacgccgacccaacgcagaccgaatccagattccgggcattcgccgccggtatccccgccgacgcgcagtccacggcagagcccgagctcgtgcaagcgaggcgaagccgcgtgacggaatcgttcggcccgtgcccgcgctgcggccagcccgtcgtcaagaccggcaaggtctggcaatgctcgaccaacaaacgagagaaacaaccggacggcacatggaaggatgcgggcggctgtggctggaaactattctccaccatcgcgggcaagaccctcaccgacgcgaacgcgcgccgtttcctggccgacggacggatccgccttaagggattcatatcgaaagctggccggaaattcgacgccatgctcatcctcgacaaggaaggcggcgctcggttcaagttcaatgacaaataacagagggacagccatgtctggtcaagcagagtatgaccggggtcgtctatgtgactgatgaaatcaacatcatcgggtgagtttcgtcgtatggttgctgcttcatggagtcaaccggcgcgggcaagcatagtgtgccactggtcggaatggtgatcggcgtggctgtctctatagtgcctaagcattgggatttcaggtcatgcggctgcctttggaataggtgatttgccgaccttgaaggttataattcccctcatgggtaagaggagcaaaatcgcagctattgatctgttctgcggaacgggaggcctgtccctaggcttgaagcagggcgggatacgagtcgtcgcgggaatcgacaacgcttcagcctgctcatacccgtatagccataacatcaaggcgaagttcatcgagcgttccgtctgcgatgtgaccggcgaggatctgaagcgcctgtgggggcaagcggatgttcgtctcttggccggctgtgcgccctgtcagcctttttcctcgcagcgacgtggcgcggacacatcccatgagaaaagctggccgctgctaaatgagtttgcgcggctcgtgcaggagaccatgccggatttcgtgacgatggagaacgtcccgcgcgtccagtattcgccgatcttcgatgaattcgtagcacgcctgaaacaggccggctacgatgtcacgtatcgtgtcctgttcggccccgactacgggcttccgcagcgccgtcggaggctggtgctgctggccgcattaaacgatcatattgagatgcctgagccgacggtgggagcggaccggtacagaaccgtgtatgacgccatccacgacctgccgtccttggaagcagggcagaaagacgatgacgactccctgcatttcgctcggaatctttccccgaccaatctgaaacgcgctcatgcctccaagccgggtggaacatgggaagactggccggaggagttgagagcgccctgccagacccgtgattcaggcaaatccttcaaatcgttctatgggcgaatggaatggaacaagccctctcccacgatcacgacgcaatcctataatcccggagccgggagattcacccacccggcgcaggaccgtgcgctcacgcttcgggaggcgtcccgccttcaaggctttccggattcattcgtgttcaccggaccttcggagaagatcacgttgagcaccgttgggcgtctgatcggtaatgcggtgcctccggtgtttggcaaggccatagctcggcagttcatcaagacattggatgataggaaatagtgataatgagtgacgaatacactttgacggtcgatatggcgaccgtggactcactgggacgaaacctgtattccaatgcggcggccgtgttgtccgaattcgtggccaacgcttgggacgcggacgcgaacaacgtgagcattgactacaagccggatgaaggctctggcagcatcaccatcactgatgacgggtgcgggatggacaccgatacgctcaattctcgtttcctgaccgtcggctatcaaaaaagaaaacgggaaggcgatgaatcgttccgtttccacagaaaatacatgggacgtaagggcatcggcaagctgtcagccttctcccttgccgatatcatgcaggttgaatccaaaagagaaggcgcggaggccaggggattcacgattgacgttgcccgattggatgaagcgatcaaaagctcggatccaaacgaacgccaataccacccggctcctatcagtcgggacggattgacgttgaacgactgtgagcatggcacgaagatagtcctgacgagtcttcgacgtaaacggatcggcctgaccttggaagcgttgcggcggcgtatcgctcgtcgcttcgacgtgcttgatctcgctgataaaagcgaggaagagggggcgtttcgtatcgtcatcaatggaaaacccgtcacgtatgaggatcgcggagatctgcagcggcttgagcacatctggtatctgggcaatttctccccctcgaaagagcagcagaacagcataaaagccgaacatcaccgtgtcgaggatgtgtcgttcgacggacatcctggctggaagttgtcaggatggattggaacggtccgtagaccgtctgacagagccttcagcgacgacacggaaagcatgaagaacattatcgtcatggcgcgtaaacgtcccatccaggagggactgctggatcatctggacttcaatagaaattttgccagctatgtcacaggtcaggtgcaggcggattttctcgatgactcccagcaggatgacatcgcaacatctgataggcagcgattggtcgagtcagacgagcgagtcaaggctttcaacgagaagatgaaagacatattcaatcgggcctctgatgaatggtcccgtgcgaggagtgacgccaacaccaagaagttgatggctgatatcccagaggttgccgcttgggtcgactctttgacagaggggctgaggaagccggcacgagatttgattgatcgggtttcgcgtatcaacggcattccagaagccgaccgccgttcactgtatcagtcatcaatcatggccttcacccgactggttcaacgggacgacatcgagaaactgtaccatgtaggcgagctttcgacagaacagctgcttgctatattgacgtcttacaaagactacgaaaacatggaatacgcgcaggtcgtgcgtacgcgcctcgaagtgatagacaagttggaatccatgttgaaagccaatgagcttgaaaacgccacgcgtgacttcgtttcggacaatccttggcttctcgatccagcatgggagcgcgcaacgcgcaacgctgagaaggaaaaagcgttccggacaataggcgaagaagaatacaaactggacttttcgtcggattcggagtcgaacagccgcgtggatatcaaatatctgacggctcctgaccgtgagaccattgtggaattcaaacgctatggtcgtgatatcaagatagaggagatacgagagcaggtatggcgttatgcggaggcgatgactcggattctggaaaaggacgatgcccggaccgaccgagccgagggaagaaagaatgcgtccggcattgacgagagagtcaacgttctcatcatcgtcagacgggtgcttgacaaccgtggcaagccgatgtctccgggagcggcgaacgcgcaagtcgaaatgttccgggcaaaattcctgtatttcagtgacatgctcgctcagagtcgtgaacgctatcaggaatttgtcaagggcgtttcccaaaaagactatgccggagaagcgatccaagccattgaatcctccggtagcgctggcaacgccgagaatatctagcgatgccggctcattgggcatagctgcgcttttcccataagaaggaagagctcgtggcatatgccgagagtagagcgatggctaatctttcccacgcgcagtgagcataggacagaactcgtattagtcttgtagatatgagcaagtccatcgcgcagatccgtaacgaggctgctgccgctctttccccggagcggaagcagcagtgggagcagtttctgacgcccgcccctgttgccgagcaggcggccggactgttcactcctgccgttgagcccgtgcgtatccttgatctcggttcgggcacggggatcctagctgcaatggtcgccgcgcatgcgccagccggcagtggcgtcacagccatcgaacaggacaccgatcttgccaaggcgtccgaggtttcgatccgacaggtctgtgatgatgtcgaggtcatcgccaaatcggtgttcgatgtgttgctcgatgacagattcgatcgcgtgattctcaacccgccgtataagaagatcagtcccgtaaccattcccactgccagcggcggcgtgaagatcaccaacctgtacaccgcttttttggtgatcgctatccaggcattggccgaaagaggggaatgcgtggccatcattcctcgttcatggatgaacggcgagtatttcaaggacttccgcaaatggttgctcgacgaatgcagccttgacgttctggccgtttacggctcgcggcaggaccacttcaaggacatggacatcctccaggagatcatgctgctcaaagtgtccaagcgaaagcaaatcggttcaatcgccgtttatgacgggatctccccggagattccgttgggccggcagccgcacgagcttattccgttggaggcgctgaccatgggtagggaccgcatcctgcgcgtcgaacgtcaggatcctcggctctcccgattcaagaccttgtccgagcaaggtatgtgggtgtccaccggcaagctcgtgtggttccgcaaccgcgacctgctgtcggccaccgagaagccgggaagccaccctttgtattggtccgacaaccagcggggcatgacgaccgtgcatccggtcaagtgcgacagagaacagtgggtcacgggcaaggcggattcacgcaacgttgtgctgccctcgggcagctactgcctggtcaacaggttctccgccaaggaacaacggcaccgcatctacgcctcgtatctgcgcagcgatacggagtacgtggcggacaacaagctgaactacgtccaccagggcacctcccgccggacggtgccgttgaacgacaaggtcgcgcgaggcctgaccctttggctgacgtcaagcatcgttgatgaatggtaccgccaggtgtcgggcagcacacaggtcaacgccaccgacctacgccagctgccgtgcccatcaccggggcagctggcagaactatccgacctgctgcccgtgaacgacgcggtggaccagcaaagcattgaccataccttggagggaatgttctcatggacaaaagccagctgatcgaggaagccatcgaagcattgcgtgacttcgaggtcggcagggaacaacttaacgagcgaagcgccatgacattgctcgcgctcctacaactcaagcccggcgacgactgggcccgggccactaatcccatgctgggaacccgtgccatcatggactggatccgcgaccagtacggtgttgaatacgcagcgaacacgcgagagaccatccgacgcttcacactgcaccagttcgtcatcgcgcaactggtcgaggagaacgccgaccgaccggaccgacccatcaactccccgaaatggaactaccgcgtgaccgacgaagccttggaagtgcttcgtcattatcgcgaaccgagatttgaatccgagatcgaacggttcctctccgaccacctgtcctaccgttccttggtcgaggagcgacgccacatgcccaagaccccggtgcatcttccctcgggacaggaacttgaactgtctccgagcggccagtcggtgctgatcaagtcgatggtcgaggaaatgctgccacgattcgctcccggatgccaagtggcattcattgatgacaccgaccacaagcacggcgtcattgacgcagatctcctcgacgacctcggcatcagtctcaaggcaagggagaaggccccggatgtcatcgcatgggacgagcgcaggagatggctgttcctcatggaagccgccagcacgcacggaccggtggacgtgacccgcaagaacgagctgcatgatctgttcgcggaccagtggaacgatgcagtgctcgtctcctgcttcccagaccgacgcaccatgcaacgctacctcgcccaactcgcatgggagaccgaggcttggtgcgccgacaccccggatcatatgatgcacttcaacggatccaggttcatgggcccatacggacgctgatcaggaggggagcaaggcgtggcaatgatcatgtgtccggattgcggaaccagtatctccgacaaggccttaacatgcccgtattgcggttatgcggggaacgatccggccacgccgatagcggaccaatccatcggatacgaagtggtcccgcgcatcaagatgagcatagaacgctgggatcccaagtctcgttctctgacggaggaaacgtcggagatgccaatccaggcaagaagggccgtggcaagatggctggggtctttgaaggactgggagtctctgcaagtcgtcgctcccgccctagtgggcttcgtcaaggaattcctcggcgatgacaaagtgcggatggtcgccgatctgccagcggagatcatgaggatggtcaaggagggcagactgcgcttccgtccggactccgagggacgcatcatgccatttgtctacgatgacaagggcatatacaagcaggttcgtctcaatatggagaccgtgccgccggacgtgaccaatgccatgcgtcaattggagacgcaggcggcgctttccatggtccttgccgaggttcgaagcttgcgtgatcagttggagggcatcaggatcgggctgcagaatgatcggcttgctttggccgagggcgcgtgggacaagctcatgcaggccagggaggtcgaggattcgcggctgagggatgctttgatcatgcaggctctttcctccgccaccgatgcaaagcgcacattgatgcgtaacttcacccagaacgccaattacctgattgagcagtcggacatcgatctgaatcggaacccgctggcgcttgtgagacgtctgggagaatctctcaatggcaacgaacatatacatcaggcggctgccgatgcgttcgatgacctcgtgcagatcacgaatgtagtgcgtgtggagggcgagggatattcgatgcttggccaggaacgtgccgcccgtgcctgcctggatcagttcagcgaattcatcaaagcgaacggactcgatgaggatacccttctcgtcatcgacggcggacttccatccgagaggaagatgccggaacttgtggaccagttcgcagagctttccaagagaatctcgctccttggcggcatgtctttggagcaaggcattccgtcgggattgctcgaaccctataggcctcgaccggatggggcctctgcgatcaccgataaggaaacggaagatgaacccattcaagaagaagactgacgtggaatcccgagccgcttcgtcatccgagcaagctctttgctccgtgtgcaggcacgcgataccggagtcccgcagggaattgggactgtgcctggattgctccacgaaaaaggatcgaaacaaggcggtcctggccgttggccttgccggcggtgcccttgccgtcgccaagaaatatggtcctaaggtcgtcagcaaggtggggccgttggttgtcaacgcggtgaagaagatattttgacaccaaatgaactgtcggttttcggtatgccggtatttacctcatatccggcatgccgaaaactgcggtgagggtcatcaggatgtctagcccccgaacgtgaggccctgcatggttttggccggcatgaacgcggtcacggcctccctctgtcggcattccgacacgtcggcccttgtcgtggcttccacggcgtcgcgcatgaggtcggtgttgatcccgatgtagcgcatggtcgtgctgacgctggaatggccgagcagttgggacaccagcagcatgtcgcagccggtgcggtagtaggcgaaggtggcgaacctacgccgcaggctgtggctggggaacgatgtggcctccttgatgcgggtaccgacgtaatcccgcaggcgtggccgtcgaagcgtccggggaagatccagtcgccgccgcgccggcgtatcgctcgggcgagttcacccggcacaggtaacacccgctccttgatgtgtatttcgtcaagtcggtgtttcgtgtttagtcatgtatttttttcgggtttagaactgttagaattacaggaccaacaagggtgttgcacttctaaatagacatcggggatggactcctgtaactcgaaatagttgataatgaaggaaaggtaaacatattcgagcaaacccattccatatcacgccttggacttggcggtttcgatccacttgttgaacagggcttcagccttgccggagtcgacagcatcctcggccagcttgtaggcctcggcgaagcgctcggccagtgtgccgttgccgaccagattgccgtcagccacgatggcggaggcagcgttgagcagcgcggtggtgcgggacgtaatgtccttgccggccaggaagtccttaaatgcgttggcgttgacgtccggcacgccgcccttgagctggtcgacggtaatcttggcgagacccagatccacggtcgggtcgaactcggtttcggtgaccttgccgtcgcgaatctcccagacggaaaccgggccggtgggggcgagctcatccatgtcctcatgcgaagtgtagaccaagccggactgaccacggctggcgtagacggcagccatgatcgggctcaccttgcggttggcgcagccgatggccacgtgtgccgggttggcggggttggtcaacggtcccaggatgttgaagacgcacggaatgccgagcgcggcacgaatcgggcccacgaagcgcatggccgggtggaaggtgcgggcgaacgcgaaggtgatgcccacctcgtcgcccacttcgccgacggcctccggcttcaaatccagcggcaggccgaggtcttcgagcacatcggcggcaccgcacttcgaggatgcagcgcggttgccgtgcttgacgatcttcacgccggctgcagcggcggccacggagcccatggtggacaggttcacggtggcgaagccgtcaccaccggtgcccacgatgtcggtggtcccaccggaaacgttcagcggcacggcgtgggagaccatggccttggcggcaccacgcacctcgtcggcggtcagtcccagctgctgctgcatagcgagcgcggcacccacagcggccggattggcgttaccttgcatcaggtcgtccacgaaccactccgattcctcagcagtaaggtggtctcccccgaccagcttggtgagaatcgacttccatgtgatctcggccatgatgccctccttggcgtttcctacgccgtgtgatgtatgttcgccgctcattgtaatggttcgtcatttcaaggccctgaatcttccatattgcaaaatatggcgctattgctgttttcgtggatgtcggttcgtcgtcgagccgttggtttcgtaagcgtgaggggcgttcccgcgtattctgttttccgaccaaagaaatgaatcacgaagaacgcctgggcaaaagcccattcaccggattgccgaacgtcaaaggcacggttgcagaggatgcgcggatcacggattcgccgccgcgttccgaacccgtgctcgagatccgggtgcgtccacgtgcgggtatgctccgatgctcccgatgcggaaggaggtgccgcgggcatgaccagggcggcggcgtgcggcgtcgtggtcgcttccgtgccgtgggccgagccgggcagccggtccacacgcgatttcgaatcggaacgcgcgtggccgatgagcgtcgcgaaccagaagaccgtaagcggttttccgcacgtcgcgtggcgcgccgccggaagacgccgcccatagggtcgctgaacggttgaaagcgtcgatgccgtctccgttcggcggcctcacgtcgatcggcgtggacgagaccggctaccgcaaaggccacacgtgcatcaccgtggtcgtcgaccacgaacggcatcgggcgatatgggcgcacgacgggtacggcagggacgtgttcggcctgttcttccaaacgttgacgcccgaacagcgcgcctccatcagggtcgtcgccggggacggggcccggtggatcgactcatgcgtgcatgagtggtgcccgaacgccgaacgcgcgcccgacgggttccacatcgtcagttggacgagcggcgcgcccgacaacccacgaaaacagcagaagcctcttttttgtgctatcccgtaaaactgcgggacggcagctcattttcgccgtttgagccgtgccgtcccacatcaccctttgcggaccgtgacaccataacaccgagaatggcggaatttcaacgattccgtaattcgtactgcgggacgccacgctagtcaatcgattgacactcgtgccgtcccgcgcgtacggcaccgcacgaatacatgctgatgaaccgcatagaaaatggctccccgtgtggggagccatgagctagttactaactagcgatgcgtcacttctcgttctggccgtggcacatcttgtacttgcggccggaaccgcacgggcacggggcgttcttgccagtgccagggaaggtgcggccgtcggcccacggcgtcttgagctcttcgctcttcggacgcttggaaaccgggaccttgccttcggcgtggctgatcggagccggtccggcaacaggcagcgtggactcgccggccccggaggcggctgcggattcggcgatcgcctgcttggcgtccgtatcctcgtcctcttcctcgacttcgccctcggcggcctcgaccacggattcgccgttctcgtcggggccggaggccacggcgatggtgtcggcgctttcggcggtctcctcgacctcgtcaacggcctcgtcggtggtggcgacctgcttgatgtcgatgtggaacagcagctggacggtctcctccttaatggcctcgatcatggagttgtacatctggtagccttcgcgctggtattcgaccagcgggtcgcgctggcccatgccacgcaggccgatgccgtccttgaggtaatccatctcgtaaaggtgctcgcgccacttgcggtcgagcacggcgagcaccacgcggcgttcgagatcacgcaagccggtctcgccgatggtctcctccatttcgccgtactgctgcctggcgtcctcgacgatcaggtcgcgcacggcctcgacggccttcgcacccttgaggccgccgacgatcttcctgacctcgtcttcgtcgaccttggtggggatcacggtgttgagcgccttgaacaggccctcccaatcccagtccttcggtttctcggatcccttgttggcacccttgatgtaggactcgacggtgtcggaaatgaaacgcaggatgtccttgtggatgtcttcgcccttgagcacggcctgacgctcggagtagatgacggtacgctgcttgttcatcacgtcgtcgtacttcagcacgttcttacgaatctcgtagttgcgggattcgacggccttctgtgcggtgcgcacgcccttggtcacggacttggcctcgatcggctggccttcctccatgcccttggccatgacctgggccaccagctgggtgttgaacagacgcatcagatcgtcttccagcgacaggtagaagcgggactcgcctggatcgccctgacggccggaacgaccgcgcagctggttgtcgattcgacgggactcgtggcgctcggtgccgagcacgtacaggccgcccagctccttgacctcctcatgctcgtccttgacctgggccttgatctcgttcagggtgcccggccaacgcttctcatactcttccggggtgtcctccggagagtagccctcggacttcagcttggcgtcggcaaggaactcgacgttaccgccgagcatgatgtcggtaccacggccggccatgttggtggccacggtgacggctcccttgcggccggcgacggcgaccacggcggcttccttctcatgctgcttggcgttcaggacctggtgagggatcttggccacgtcgagcagggtggagaccacttcggagctttccacggaagcggtaccgagcagcaccggctggcccttggcgtgacgcttggccacgtccttgacgatggcggccagcttctccttcttggtgcggtagatgaggtcgtcctggtccttgcggatcatcggcttgttggtcttgatcggcagcacgcccagcttgtaggtgttcatgaactcggcggcctcggtttcggccgtaccggtcatgcccgcgagcttgtcgtacatacggaagtagttctgcagggtgatggtggcgaaggtctggttctcggccttgacctccacgccttccttggcctcgatggcctggtgcagaccctcgttgtagcggcggcccggcaggatacggccggtgtgctcgtcgacgatgagcacctcgccctgggtgacgacgtagtccttgtcacgcaggaacagttccttggccttgatggcgttgttgaggtagccgatcagggcggtgttggccggctcatacaggttgtcgatgccgaggaagtcctcgaccttggtgatgcccgggtccaggatgccgacgaccttcttcttctcgtcgacgtcgtagtcctcgtcgcgggtgagcttcagcaccagcttggcgaactgacggtaccagcgggtcacgtcgccttcggccgggccggagatgataagcggggtacgggcctcatcgatgaggatggaatcgacctcatcgacgatggcgtagtggtgaccgcgctgcacgaggtcggccttctcccatgccatgttgtcacgcaggtagtcgaagccgaactcgttgttggtgccgtaggtgatgtcagcgttgtactgcttgcggcgctccggcggcttctgctcggtgatgatgcagccgacgttcatgccgaggaaacggtagatacggcccatcagctcgctctggtagctggcgaggtagtcgttgacggtgaccacgtgcacgcccttgccttcgagagcgttcagataggtgggcagggtggcgaccagggtcttgccttcaccggtcttcatttcggcgatgttgccccagtgcagggcagcaccgcccatgagctgcacgtcgaagtgacgctggccaagggtgcgcttggagacctcgcgcacggtggcgaacgcctcgggcatgatctcgtccaggctcttgccgttttcgatttcctgcttgaacttcggggtttgggccttcagatcctcgtcagagagggcggagatctcgtcctcaagagcgttcacggccttggccacgttctccagcttcttgagctggtggccttcacccattcgcagggctttgtcaataatatcgaccactgggttctcccttgactgataagtggtggtgtccgcgtatcaggatagcgcctcacaccgtcagcagtcgaatttttcgacctttttacgaaaaaatggaccgcctccatattggaagcggtccatgcggtatcagctgatcgtgtcagcaggccttaccttcaggctttcttgacattctccggagtgtcgatttcgaacacgccgtagctccaaccgtgacggtggtagacgacggacgggcgtccggtctccttgttcacgaacaggaagaagtcgtgtccgatcagttccatctcgtacagcgcctcgtcgatgctcataggctcggcgatgtgcagcttgcgacggatgacaatcggcgtatccccaacctggacctccacggattcgccagggccaagatcggaggcgaccgcagcctgcgggctgttgttcggctcttcctccgacacctccggctcgggctccggggcgataacacccagatccaccgggaccgggttcgcgtaaccacgacggtgatccttgcgacggtcacgagtacgacgcagacgcagcgtcaacttatccagcgccatgtccagcgcgctgaattcatcggtgctggaagcctccgcacgcaccacggtacgtccggcgataacggtgatttccacgcgcttggcggtatcggcctgacgcgggttgccctcatgggtcagcacgatctgcgcgcgctgagcatccggggcgatagcggtcacacgattcatcttggtctcgaccacatcacggaacctttgcttgacctgcgtgtggcgtccggtaacgacgatttccatgttgacctcctctaactcaagcggtgtaacccgctatatgtgttccgaacggcatcatcaccgaccgggtatgtttcattgtagacgaacaatgggtgaacggccggaaactcgcccagagaatatatgtttattcccgggcttttctctgcaatgaaacgatgtatatactggggctttggcagcagtctcctataagaagatttgataccggtttatcaggctggctcgtttgttcgtcatggtaaatactgcaatggataggcagcgttttcttgctctttctcgcacataccaagctcttacagatttgattcgtctccatacgacacgccacaacacgcccgacacgccccatccgatattcggcgcgtcgttcacgaatcgcccaactatgcccaaccatggagaaaacaggataaccgggcaacggcatggcctcaccgcagggcgggatgccgccttttccgcaccttatgtataattgcaagcttgagacctcttgatggccgcggccgtgatcttcattgggatcggctgaggaacttccgggctccatagagcacgatggcggataacgtccgcccagggtgacctgagagatagcgcaacagagaacagaccgcccgtcctcgacgggtaagggtgaaacggcggtgtaagagaccaccgggcctctggtaacagtaggtcgcatggcaagcctcatcgggagcaaggccaagcagatggcggtaagggctgctcgcccgtgtcatcgggtaggctgctagagcctggcggtaacgtcaggtcgagatggatggccatccgtgccgtgcgttcgcgcacggcacgacagaacccggggtataagaggtctcatttttttcttggctacaccaacaattcggcggcgactcgacggagggtttcggggctgtggcctttgcggccgccggcggaccaaagccgacgctgacggacccgacgatcgaggccatgggttttgcgggctatttggcggcccaattcccatgcggcatcttcaaagatgccattttgctcagcttcgtcacacacctgttcagccagcttgcggtccacacctttgcgagcaagttccatgaccgtaccacgacggcccatcatgcgaccggcacaatagcgtacggccgattcggcataagcgctgtcgtcaatcagttgcacgcgaatcagccgttcgatgacctcgtccacgatcgcctcgccgtaccctttggcaagcaatcgttcgcgtaacgcaccggatgcacgcggggccgcgtccagcaaacgcaatgcagcctcgcggcaagcgtccaaatcattgggatcttcgacaacggcagcgtctctcccccgtcgagaaaaacgtcccgacggtttcgactgaacatgctgctcggcaatgggcatgtcttgcgacgcaacaggattgcgccgcaagaacgctccggcactaatcatgttcaggccttagctgtgccggccttggcacgggtcgttttggcagcaggcgccgctgcggccttgctgtccttggccacgtcagccgcagcagcctcgctgacggcggccgctgctgcggcttcgccatcttccgcgaactgatcggcggaaccgatcagaccgaactcggccttgaccttgttctcaatctcctcggtgatggccgggttgtccttaaggaactgacggaccttctctcgtccctgaccgagctgatcaccctcataggtgaaccacgaaccggacttcttgaccacgccaacctgctgggccatgtcgatcaccgagccctcacgggaaatgccttcaccgtagagcatgtcgaattcggcggacttgaaaggcggggccatcttgttcttgaccaccttgacgcgcgtgcggttgcccaccgcttcgtcgccgttcttcaaggtctggatgcggcggatgtcgagacgcacggaggcgtagaacttcagagctttaccaccggtggtggtttcagggttgccgaagaacacgccgatcttctcacgcagctggttgatgaagatggcggtggtgccggcctgagccaacgcgccggtcatcttgcgcagcgcctgactcatgagtcgggcctgcaaaccaacatggctgtctcccatttcgccttcgatttcggccttcggcaccaaagcggcgaccgagtcgatgacgatgacgtcaagcgcaccggagcgaatcagcatgtcagcgatttcgagggcctgctcgccgttatccggctgggagacgatgagtgagtcggtgtccacgccgagcttgcgggcgtaggccgggtcgagcgcgtgttcggcatcgatgtaggccgccacgccgcccttcttctgggcattggccaccacatgcaatgcgagcgtggtcttaccggatgattcggggccgtagatctccacgatgcggcccttgggtaggccgccgatgccgagcgccatatcgagagccaacgaaccggtgggaatcacctcgacgttctgctcgggctggtcgcccagtcgcattgcggaacctttgccaaaactcttctcgacctgcgccagcgcggtgtccagcgccgccttgcgcttgggatcgagctcgtgcttgtcctcggctgccgggtccttggccggcttggtctcaagtgccatgatcttctccttgtcgaagtcgtgtgcgaatcggatgcctccaccgtatgacggacatgccatgtgaggcaatccaaaccaaccattgtggttccagcttgcccgagcttggccacctggcctccttaaaccctactgcggtaaggattatggcagatggcaagcaccctgtgcacacgtatgcggcttcttgtcactgtggataactataaccacacacacgaacatttgttcgaatttggcgtgcaacacgccgaaatcgccaatttcacgattcagcgactccgtaatcccgcagtgtcagacggcgggcatgggcggcgcgttatgatcgtggccccaacgcttggagtccggaacctccatttggtcgcagagcacattccagaccacgcgtggctcctcccccgcgtccagcgcctcgaccacggtcatattcgccagtttgggcatccgttgatcacgcgacagcgaacgaccgtaggtccgaccgaacacctcttcaagtaattcccagaattcccgttcacgcatacacgccagtgtgccaccaaccgcaggacagcaaaaacccgcatcgccacaagcgatacgggttcacagctagacatagattacgggacgcggcttcacaccgccaaccgatcagccctcgaccgagtcgagataatcagccaccatgcgcagcatgcgcgaagtggagactccgagcgcatcggcgatggagctcagcagttcggagctggcttccttctgtccacgttcgacttcggaaaggtagcctagcgaaacgcctgccttctcggagacttcacgcaacgtgcggcgatcgcgcgtgcgcagctcgcgcagcacatgaccgatagcaccacgcagcgaaaactcgcgaggctcctcctcagccaccacgggctcggcggcggcagtcggcttgtacgacggcgaatcctcatcccacatacgttcacgaacggcttgacgctgatccttggccttcttggcggcctgtgccttgagcacctgctgctgggcgaacatcaccgcacggcgctgggccggagtcagttcacgcatacgggcgacacccggctgcacagccatcggcttcttggcggccacatccatctgttcgttcactcgggtcatcgtttccatcgccatcgccccttcccaggtcggttcagtgtttccactatgtacaacacgacaacccaacggttttattccttaaaacttgctgtgaatagactcaagttttgcagaacgtggaatacggtgaggcgacgaatctcttcgcgcatgccatcaagatggagttcgacggctttgagcacttcggcatggtccggggtgaggcttgcggggatgcgcaggcccacatacaccagtccggccggcttgtcaccgtccggaccggggccggccacgccggtggtggaaaggccgatgattcggtcgccgtattccggctggctgtataggcgagcggtaccgacggccatctgccgggcgacttcggggtgtacggcaccttctcgatccaatagggccttgtccacgtgcaggatcgaggccttggcattgatgtcgtaagtgacagcggagcccaacaacacgttggaagcgccgggaatacgcacgaacgcatcggcaagcaggccaccggtcagggattcagcgcaggcgattttcgtattgttcgcctcgcaaatcttgaggatgccggccgcgagactgtcgcacaattcccgcattggaatatccgtcacttccgcttcggggcgacgaacgtgttgtacaggtacacggcacccgagtagaggcacaggaccaatgccacgtagatgatggcgtaggtcaggaagtagtaagcggtcatccagaacggcgtggcttgtccgttacccagagaccagaacggcagcagcagcatggacagacccacgcactggaatacggtcttgagcttgccgggccatgcggcggcgatgactttgccgcccggacgctccatgacgaagaaacgcataacggtgataccaatttcgcgaatcaggaacaggatggttacccaccagccgagctcgccgaacgcggagcatacaatcattgcgccgcaagtgagcagcttgtccgcgatcggatccatgagcttgcccatttcggtgacctgattgtatttgcgggccatccaaccgtcgattttatcggtggacgcggcgatgatgaacagcaccgcggcgacccagcgcatggtcaggttgttctcaccccaggcaccggcgagaatgtcgagtgtcaggaaaaacaccacgagtacgatgcgcgagtaggtgaccaggttcggcggcgcgttccatccgtcgaacagcgatgatttgggcgatgactgcttgtccattgtgttctcatccatagtgttcacgttacccccacacttctaccttgagtgagtattggctggatattgactgccattattcgggaatcaggttgcgtgctgatggccgcgtggccgcgcttctctccctccgccccttcggggcacctccctcatcagaggaaggtcgatggcgaattattcgccgagttcgggctgttgcggggcggtggcttcgagcgagctggtttcgcctcggatgaaggcgagcacctgcggcaggtcctgcggctggacgagcacttcgcgggccttcgagccttcggacggcccgaccacgccacgcgattcgagcaggtccatgagtcggccggccttggcgaagccgaccctgagcttgcgctgcagcatcgaggtggagccgaattggctggtgaccacgagttcggcggcctgcagcagcacgtccatgtcgtcgccgatctcctcgtcgggctccatgctgtctttcttttcggcttccttggccatctgttcgatgtcttcgcggtatttcggcttgcgctgggtgcgcacgaactccacggccttgcgaatctcggattcggacacccacgagccctgcacacgaatcggcttggcggaacccatcggcaggaacaacgcatcgccctgaccaatcagggtctcggcaccgaccgtgtcaagaatgactcgcgaatcggtggcggatgaggtggcgaacgccagtcgggatggaatgttggccttgatcagaccggtgaccacgtccacggacggacgctgggtggcgagcaccagatgcacaccggcggctcgtgccagctgggtgatgcgctggatggagctttccacatcgttcttggccaccatcataaggtcggccatctcgtcgaccaccacgaggatgtacggatagggggccaccttgcgctgggagccggcgggcgcatgtaccttgccggcgcgcacggcctcgttgaagtccttgacgtggcggaatccgaagaattcgaggtcggagtagcgtgcatccatctctttgaccacccattcgagggcctgtgcggctttcttcggatcggtgatgatcggggtcagcaggtgcgggatgcctgcgtaggcggacagttccacgcgcttgggatccaccatgatcagacgcacctgttcgggcgtggcacgcatgatgatcgaagtgagcatcgagttgataaaactcgacttaccggaaccggtggcacctgccaccagcaggtgcggcatcttggtcaggtcggcggtcacgaagtggccttcgacgtccttgccgatgccggagagcatcgggttcgggtcgcccacggccttgtcggagcgcagtacgtcgcccaagtgcacgatttcgcgatcctcgttcgggatttcgatgccgatggcggacttgccgggaatcggtgaaaggatacgcacatccgaactggccaccgcgtaggcgatgttgcgctgcaggttggtgactttctccaccttgacgccggggccaagctcgacctcatattgggtgaccgaggggccacgcaggaagccgacgactttggcatccacgttgaactgttcgaaggtggaagtcagcgcccggatcacgcgatcgttggccggggtgcgcatcgcatggggctggcctttggtcagcaggttcaggtcgggcaactgatacggcctattggcgtcgtcgtctgtatcgttgccggcggtggcattcggctggccgcccgtattgggcacgccctggccgactccgctgccgtccgcatcggcacccgcgtaggctccggtcgcggctgccgcagccgcggcaccggcggctccggccgctcccatcgcaccggctgcccctgcgagcgcgacagtaccggcctgggcggcactgggtgcccacgggtcgtctaccgctcccccaccgggcatggcgacggtctggccactggtgatgacgcgggttcgggaagcgtcgccatcatctgcatcggcagcaggcacagggctggataggtgcggacggccgtcgtacgaagacgatgcaatggttcgcgcaccgataatctcgccggtcatcggatcgaccaccggggtttcggcggtggcaccatgctggctggcggcacggtcgaatggatcgtcggcagcatacttgtcaagagttttgtcgtcttcggtcttggatttgcggccgaacagtcgtgcgaacaggctgggccgtgcatcgccggcctgatcgtcgtcgttgccgtcatcgtcgccgtcatgcgagggaacaccgtcggcaaaggcgagagtggtatctcccacacggacctcgttggggaactggctggcgctcccatccgtctcctggcccatcggcacatacggtttgcgctggattttagcggcgattttgcgcgcatcctccggcaaatcggtgacgtgggtgccggtaatcatcagcaaggagaacaggccgacgaccacgaaaatgatgatggcgaacacgttggaaaggccccaggcgagcggtgagccgaggaagaagccgaacaggccgccggcggattgcagaatcgtgatgtcgaatccggtgtggtcggcggcgatcgccacgtcgatgatcgaacaaatcgaccacatgagcagcacccaaccggtgaccacacgcgggttattggaccctttaccggaattgcgcatgagtcggaaggccacggcggcgagcaacaccggcagcacgacgctcatcagaccaagcacaccggccgcgatggcgtgaagcagctggccgaatggaccgctgacgcggaaccattcggacgcgcagaacagtacggcgagcacgagcagcaggaagcacaaaccatcacgacggtaggctggatcgtattcgccgacgccggtgacggcgcgtacgccggagccgaacgcgcgcggaatcgcgagcaggatcttcttccacaacggctcaggttcgaggtcaagctcgggctggaccttggtttcgccatcatgggtagacccgttgtctttggatttacggggtttggtgctgttggaggatgctgttcgtgccatatcgggtctgattctactagtacgggggtgcatggttggtgacgacaccgtgacgatatggtcgattgacgaatcccgacagccgattcgccgcgttcgtctgagtcgattccccgctggggcgcgaatatgccttatcatgggttgcatgacacccgcagagcgtgcgagcgcagtcgcatttgcactcaagaactgcgcactggaagcgatgacgccgggcgaggcaacgatgcgcgccgcggctgcctacgaacgcggcttgaagcccgtgacccatctcatcgacgtggcggacgaacagaccgccatgcgtctgcgcgccgccgccgaccctgccggaaaggatcgtctggctgccggcagtctggatgatcatgccacggatcgggcggatgcggtgttcgcacgtaccgtgttgttggcggaacgtcgatggaatccgtctggcgacttggatgagctgaccgccattcataaggggctgttcgaaggcgtgtttgaggatgcgggcaagttgcgtacctcaaacaccacacgcgaggtgacgaacgaccgggctcgagccgcgaatcctgaggcgttcttcccggctgggctcattgagaccggcgcgcacaacatcgcgatggagttggcggacaagcgcaacctgcatgcgttggatcgcgacgtgttcgttcacgcgttcgcttctatttatgatgagctcggttatctgcatccgttccgtggcggcaatgcgatggtgctgcgtatattcggttcacgcttggcgcatgacgccggctgggatctcgactggggctcagtgacgcgcgaagagtatcgctccgccaagcactcggcatatcggggcgacacgtctgcactggagacgatgttcgacgcgatactacgcccggcgaatccgacgcgtgtgttcttgatcgccggctggaatcaggggcctgcacactgattgcgggtgattgcatcggcctttggctgattcctacgccgtgatatcgcccagatgatgctgggtgtattcgtcggctcgggcgtcgatcgggtcgtagtcgccggcgtcggcgtgcgcgataatggccatcgcgttgtcgaccagtttcgggttcagggcctgcagccagtggatgcgcgggtcacggccgaaccatcccatctgtttgcgggcgagtcgcttggttttctgtgcgatgtccgcgaaggcgtcgttcacatcccagatgccgtccagcaggtcgatgatctgctgatagccgagcgcacgtacggcggtggcacccagatgcgggcgcaaccgttcgacttcttcgatgaacccatcgtcatacatctgcttggtgcgcaaatcgatgcgatggtccaaatccgggcggtccaggtcgagtccgatctgcacggacggaatcacgtaccggtagcgtggcagactggccgaatacggtttgccggtaagctcgatgacctccagcgcacggatggtgcggcgtggattgcgtgggtccatgcgcgcggcggcctcggggtctttggcccgcaactcgtcgaacaaagcaccggcaccctcggttttctcgcgttcctcaagacgtgtgcgcacgtcgggatcggtgccggggaaggtgatgtcatcgatggccgctctggcgtacaagccggagccgccgacgagaatcggccggatgccacgtgattgcaggtcggcgatggtctcgcgcgcaagctgctggaatcgggccacgctcatcgtgtcttcggggtcgatgatgtcgatgagatggtgcggcacggccgcctgttcctcggcggtgggtttggcggtgccgatatccatgccacggtacatctggtaggcgtccgcgttcacgatttcggcccgctcccccgcttcggccagacgccgggcgatggcgatgcccaaccccgtcttgccggacgcggtgggaccgacgatggagacgactcgttgcgtcatatacgccccctcagtgccgcacggaataggtctggccggcggccacgtcggggtcggcaagcagattatggcggccggcgtgtgtgacggtggccgtgacgaaatcgccgatttcaggtaccggttcgccttcaggcacgccgatgtgcaccagcacgccggttttctcgcggccggtgacacggtgggtgtcggtgtccttcttgccgagtttgccggtgatcatcacttcgacgtcgcggccctcgaatgtggcgaggttctcttcggtgatctgctcctgcaacgccaccagacggtcgaaccggtcctgcaccacgtcgcgcggaatctgttccattgcggcggccggcgtgccggggcgtggcgagtagatgaacgtgaacgccgaggagaagcgcgcctggcgcaccacgtccatggtctgctggaagtcctcttcggtttcgccggggaagccgacgatgatgtcggtggagatctgcgcgtcgggcatggcggcgcggatgcggcccagtatgtcgaggaacttggcggagcggtaggagcggcgcatcgcgcgcaggatgcggtcggagccggactgcagcgggaagtgcagctggtgcatgatgttcggcgtttcggccatcgcggcgatgacgtcgtcggtgaaggcggccgggtgcggcgaggtgaagcgcacgcgttcgagaccgtcgatggtgccgcaggcgcgcaacagcttgctgaaagcgtatcgatcgccaataccataaccgaacgaattcacgttctggccgagaagcgtaacctccttggcaccatcggccacacattggcgaatctcatcaagaatgtcaccggggcggcggtccttttccttgcctcgcgtggtgggcacaatacagaacgtgcaggtgttattgcagcccacggaaatcgccacccacgagctgatgcgggaggcgcgggcggcgggaagctggctcgggaactgccgcaattgttcagtgacctggacctgcgccttgccggtcgcacgattctgatccaacagcttgggcagatcttcgatgttcttggtaccgaacaccgcggaaacccatggcgcagtatccgcgatcttcttgcggtcaagctgggccatgcagccgccaacggcgatctgcaggttcggccgaaccagtttgacgcgattgaatcggccaatggtgccatacatgcgttcggctgcgttctcgcgtaccgcacaggtattgagcaccagcaaatcgaggtcattgtcattgatctggtcctcggttgcaggcacgtagccattggcctccagcacgccggcgatgcgctcggaatcgtgcacgttcatctggcagccgagcgtatggatatggaacacgcccttgccgcgtttccccagcaaaccatcggttccatcggctgcaatcgaggcgcgctccgcctcggtcatcatgtcttcattcataacgaccgattctatcgacggggttcgtcatgctccggtcacgtatgccattggttgtcacgatgtcaaattatgggttcttggaaagattccccgcgaacgtccagattggctggaatccgccgagtatattggtggacgtgatacttgaccgacatagccgactcaaaacctccgatctgcaagcccgtctcaaagcgttggatcttccgggaggcaccttcactcccgaacaggtcgttgaattcgttgacctcatgcaggtgtatgaaggcgcgatgtacgagatcagcaccaaactggagattctcgacgacgagttccaggtgcggttcagccatgacccgatacatcatatggaacgccgtctgaagtcggtgagctcgatcatcggcaaactggagcgcaagggtctgccgatcggcgtcaattcgattaaggacaatctgttcgatgtggccggcatccgcgtgatctgtaattaccgcgacgacgtgtattccgtgtccaactatctgtcgtcgcagtccgatattcaggtgctgcgcgtcaaggattacatcaagaacccgaaacagaacgggtatcgttcattgcacgtaatctacgcggtgcccgtgttcctctcctcgggcgcgcattacacgccggtggaggtgcagttccgcaccatcgccatggattattgggcgtcgctggagcatgcgctgcgctacaagaccgatttgccggacaacaagctcgccgagcattcccagacgctgctcgactgcgcgcgctcattgcagaacatcgaggtacagatgcagaacatccaccgcgacatcaacggcgcgccgcaagtgggcgaagcgcctaagacctcggactgaggtgctatggaatcggcctgcggccgattcattcaccgttgcggccacttcggcagcctggccggcgcttgggccagtagggtgccgaggaagatgagggcgcagccgaggtagccgcgcggggtcatcacttcaccgagaagcaacgcaccgcctaccgccgagaagaacgattcgaggctcatcagcaggctggctcgcgtcggtggcacccattgctggccgaccacctgcaaggtgtacgcgatgcccaccgagccgatgccggcgtacagaatcggaatccaggaatgagcagcgccggcccagtcgaccgagccttcgatcagcgaacccgcccagctcagcacggcggtggtgcagaactggccgaatgaaagcttgatggcgtccacggtgccgcccaaagtatcgatcaccagaatatgcacggcgaacagcacggccgtgaacacgagcaggatatccgccaggccgatcgaaccgaaaccatcggtgatgcacagcagatagaagccggcgatggacagcgccacggccacgaacaccagcatgccgatgcgccggcgcaggaacacgaaggccagcaacggcaccatcacgatgtacatggcggtcagaaatcccgcacggccggccgatttgccgtacagaatgccatactgctgcagggtgctggcggtgaacagcacgatgccgcagatcacggaaatgaccaccgggttggcgagcaatcgcgccacggccgaatcgggcttgttcgcattcagcttggcaccggtgatggtaacgacgtcggatgcaccgttcgatgcggcatctgtggagacggccacggatgcctcggtcccaacgacatcggccccggctgtatcgcccttatccgcgctcccccggccacgcatccacagcagaatcggcaccaaagacagtgctcccagcgtgaagcgcgcggcgttgaagaacatcggcgacatcgaatccatgccctggacctgcgccacgaacgcaaaaccccagatcagcgcggtcaacaacaggctcagcatgcctacgagttcttgtcttttcacggggagccagcctaacgtgcgaatgtgacagacatgaaaaagcccggccacaatgtggtcgggctgtgacgtttgacgggcaggctacatgccgctcgccaatcggctgtcgaggctagtccctgttgccgagcagctgcaggatgtacaggaacatgttcacgaagtcgaggtacaggttcagggcgcacaggatggagatcttcttgaccatttccgggccctgggcctcgtattcggtcagcagcgcgcgcgtggactgcgcgtcgtagatggtcatgccggcgaacaggatcaggccgatggcgcagacgatcttggtcatgccgtcgacctgcacgaaggcgagcacgatctgcgagatgatgagcacaatcaggccgatcatcaggatcgggccggccttgagcatgttgaacttggtagtcatgccgaacatggtcagcgcaaagaagaacgcggcggtgacaccgagtgccacgccgatcgagccgaggtcgtagaccatgaagatcgagctcaaggtgaagcccatcaatgcggcgtacacatagaacatgacgcgcgcggtggccgacttcatcttggtgacgcgcatgccgagcaccacggccagggcaatctgcaccacgcacaggccgatgaggcccaccatgccggtggccatgaggaagctgtagtaggctccagtgatctggccgagcacggcgaccacggcggtgacgaggatgccgatggtcatctcgccgtacaccttggtcactgagactcggcgggcttcctcatagttgtaggtcatcgtcgtgttgatggtggccgcacccgcaccggcaccagtaccctgcggcacgtattggtaggtgggagcgccctgcggctgggcatagtagttctggccgtaaccggactgtgcgtattgctggccatatccagactgttgggcggcgttgtaatcaggcgtgttgtattgcgggttgtattgcccgttgttctggggctgctgaccgaatgtcataatcgctcctttagcgtttgttccagtaccaatcttagaggaacaaagctgaacattccatgaatatgatcgatcggctcgttctgctcatctcaaagcgtaacgggcgtttccaccatgcgcgtggcatgcacttgagattcgattgacattcgatcgcagcttggaccgccgcgcgattcactgcaacgtgaaggtatgcgtcaccttggtgtcttgatccgttgataggaacgcagtgacatccaccgtaatcggcgaatcgtcttgcagcacatagcccagcgtcaccgttgccgcggtcccgggctgtgcttgggccaaatacgaattcgcgtcatagccttcaggctgatcgaagtatactgccgtctccagttcggtgccgttctggaacacgttcgggtgagccaaagtggcgaacgagttgttcttggacgtgttgttcgtccattcataagtcaccagagcggtgggcttgccgttatagtcgttgacgcttttcacggcggagactattttcacgtgggcaccttcgatatcaccttccaaatcctgctcgccctgcgctttctgctcggatgccttgctcttggaggcatcagacgatttgcccgcggactttgatgatgaggattgtgacgtgtcgatgcccttggactccttaatggaatcgtcaatggccttgctggcagcggactgcatggccagcgtgatcacaatggccaacaccgacagcaccgccgccacaatggacagcaccttgccgcgtttcttgccccggaaggtgcccactatggcgataatcgccagtatgacgccgatgaagccaaggattgcggcgatattgttgacgatgggaataaaactcagcaccaaacccaacgcgccaaacaccacggccgcgatgccgcagatggtggtatgcagatgttgcggttgcggcggctgaggctgaggctgttgtggctggtactgctgtggggatgagggaaccggctgcggggcgatgttgtggttggacatgatgtgctccttctcgtatcttccccgaaatagggatgtgagcacgacgctaccggccgcgaaacagcgacgttagtggacgaacggtcattgttcgttgcctgttcgggcaatacggaggtgataacggtgcccgcatgtccagtggcgggggccggatgcaggtcatacagtggaaagcatgacgaacccacaacgcgccgccgggccataccccggtttccgacccggctcacggcctgacgctcgccctatgcccggcacggggtccccggttcctacaccggatacggacgaggtgcccgtgactacgcgcgtatggtgttcggtcgttatggtgccattggccagtttcatgtgcatggcgcaaacctcgttcttcgcccagaattttgcgcaggattccgcaggatacacgctgatggtcctctgcaccttgctggcattcccggcagggttcctgctcttggcccgcagcgaatacccggaggcgacgttctggatcgcctgcgcgctggtggtcgtgttcccgtatgactcgctcatcgcactgatggcgatgacctcattgctcgcccgtcgttcaaaccggaacacgaccatccgcgccacggttggcggcaccatcgtgacgctcatctcccagctccgcgacgccctgcaacagcccaaagcctcgatttggcatctgattttcgctcaaccgcataccggcggcgattcaggctccccgatggtgatgctggtggaggagccgaccgtcatcatcaccgccacggtggcctcactggtgttcgtgaccatcgctacgctcatcggcctgcatatccgttcgcgcgcccgcctgcgcacggcgaatgcggtggccagcgcggccaccacgcatgccgcgaccctgcagaccgacctgaccaaccagcagctcgccgacgccatcgcagccgaagcgcacgacaccctcgcgcattccctgtccctgatggccctgaacgccagcgcgctcaaggcggaggcggccaagctcggcgactcccccgaagcgcaatcgttggcggataaggccgaggacatccgtcggtagtcggccggggcattggacgaggcccactcgatcatcgacatgctgcgcaacccgcaccaggcatgggagcagctcgccccgtccgacgacacgtcgctgacccgcgaatcgctggatgcgctgattgcggacacgcgcaactcgggcacgtcgctcaacacctggatcgatatccagcagctgagcgtgatggatgagtcaatcggcaaggtggcctaccgcgcgatccaggagggattgacgaacgcgcggcggcacgcgcccggagcgccggtgtcgttggaggtctccgccacgccgcaggcgggcgtacatatccatatcagcaatccgatcgccacggatgcgaccgagacgcagcgggcccatggggccggactgcctggtttggcagcgcgcgtgcactcggtcaacgggcaatgccggtatgggatggacgatcggcacctgttccatgtcgacgtgcaactgccttggcgcagctaagatggctagcgtgagtgagaagaacgggaatagtgtgtctggtggaaagcccgaacgcggcggtctgaccggaagcggcaccggcttagagcccaagccgatccgggtcagcgtcatcgatgacgatccgatgatctgccaggcgatgagcctgatcctcaacgattattcccacgggcgcatcgaagtcgtctccacgtccaccgatggcgagacctgcgtgaggcgggctgccgaggaaaagccggatgtggtgctgatggacatcgccatgcccggcgtggacggcatcgaggcgacccgtctgctgcgctcgctctcccccgcgccgcacgtgctgatcctgacctcgttgagtccgtccggcaccgtggaacgcgcggtggaggcgggcgccgaggggttcgtgtcgaaaaccgatgcggcggacgatatcatccgccgcatcatcggggtatgcgagggcgcgccgcagttcaacacggccagtcagaaacagctgatcgacgatctgagcgtcacgcggccgcgttcgcgccgcgatgaggcgcgcgccctgctcgacgcgctgcccgaccgcgagcgcgaggccgtgatgctggcggccgagggctatacgaacgccgaaatcgcctcccgcatgttcatttcggagcgtacggcgaaggcgcatctttcttccgcggcgaacaagctcgacatgggccgcgtgcagatggcgcggctggtggagcgggccgatctgccggcgcggctgtaagtcgtccggttgttgagccgtatcagtcataatgggaatatgagtgaagcgattattcgaacattacgtagggatgactatccggcgctgatcgacctggtgcgccgcacctggtatgccgaattcgatgagcggaccggtctgctggcggccgaagcggactgggagaactgtctggcgcgcaccaccaacgcgttcgtcgccgaactggacggccagccggtcgccctgatcgtggggcgcgtcgatgcgctggaccatcggagcccgctcaactcgcatcggatcaactcgtggaacgcgctggcgcgtctcgtgttcgcgaagggcggaatcaaggccgccggcgagattctgggcattctcggcatcgacaaacggctgcgcgcccaggccgcgagcgccgggcatgactatgcggcggaagtggtgctgttcgtacttgacccggcggcgcgcggccacgggctgggccggcgcatgttcgagacgctgatggacgcgttccgcctggccggcgtgcgcgactacttcctgttcacggacaccacatgcgatgtcgggttctatgtgcatcgcggcctgacgcaggtgtgcgagcagtcactgcccgcatccgtgccgggagaaaacccgtcttcgttctacttgtatgaggggtcggtgcccgagccggcgtgatgtgcccgccgtcgggcaaacactggtaggcttgagcacaagttggtatgccggcataccgtccacaggccggcgacgaaggggctgacatggcaatcagtgcgaaggaactaccactcgggaaagtgttcaccccggatttccggttcacgatcccctcattccagcgggcctacatctggaagaccgagaacatcctgcaactggtaagcgacttggatgacgcctgcaagtcgcccggtactccgtacttcctcggctcgctaattctggtgcgcgagggcgataaccgttacgacgtaatcgacgggcagcagcggctggtatccctgtcgatcatcatcgccgtgttgcgcgatctggagcgagacccggacctcatgcgccaactcgacgcgctgctggtggagcccggcgacaagctgcgcggcatcgtcaccgagcctcgcctcacgttgcgcgagcgcgacgcggcgttcttccgcgaacacgtgcaggaggacaacctcgaatccgtgttcgacatgaacgacgacgatctggcgaccgctgcgcaacgcaatatcgtcgccaacatccgcaagacgtacgacgagatctccaattggtcggatgccggacgccagcaattcgcgcagtatctggtcaacgaggtgacgctcgtcatcgtgaccaccgacgatctcgacggcgcgcatcgcatcttcgacgtgatgaacatgcgcggcctgccgctcaccccgtcagacgtgttcaaggcgcgcgccacggccagcctgtcgaccgccgaacttgacgtgtacgccgcccgctgggatgacatcattgacccgcttggcgacgatccgcatgactgtgaggaattcttcgcctatctgcatctcgtgctcacgcacaagccggccaccgacaagctcatcgaggatttcctggccgacgtgctgcaaccgtacatcgacaaaggcacggtgcccacgttcatcaaccaggtgctggcaccctacgcgatggcgtggcggattatcgcgcgccccagcgataccgtactgcccgccgaggtgcgtagccggcttgagggattggacgattaccgcagccacgagtggaagcccgtggccatgtgggcgttggtcaattcgtatcgcgggctgggcgacgccgatttgtcgccgttcgtggttcgtgcctcgcgtatcgccagaaccacggccacgttggaatcgttgggcgcccatgacgagcgtcggctgctggaaattctgaccgcattggaacaggtgaccggcatccgcacgctgaatcgcgctggaacgttggagcggcgcggttatgcgaacgccgccatccgtgatcttgacaagggctatttggtccagcgcgtgaacgggttgcatgtctcggacggcgaccgtgaaggcgcattggtccgtttgcatggcgagatgcagggtgacggcgatttggtccgtctgctgctgattcgcgccaacgagcagaaggccggcatgcagttggatcgaccacgccggttcagtgcgctgccgattatgccgttggatatcgaacggtcgaaatcgtttgcggactggccgcaggatcagcatgatttctggatgtaccgactcggcaatatggcgctggtgcagggccctgaggatcagttggacaggttgagtgaatatccggcacgtcgcgaccgcatgctgttgcgcgcggattcacgtcgtttcccgctgaccaatcagttgaaggatttcgctgactgcacacctgccctgctggaggcgcggcaggaagagtcggtccgactcatcgtggaatactggggcatccggtatgacaaggacgcccgtgatctgaccaagcagaatgtcgatgagttgtcgaagacttctccacggccgtctcatagttcgcggcgcgtcacgatccggcaggtgattgacgctggtctgctggtgccgggcgagcgtctggtgtgggatcggccgcgcaagggcgagcgctggtttgccacggtcaccgaaaacggtcgtctccgtctggatgacggctccgaatatccgactccgaccgccgcggcccgtgccgccgccggaggacgtcgcggcggcggtctggacgtgtggaagcgcacgcgcaacggtcagaagctcagcgacatctggaagcagttccgtctacaggcgcagtaggctacggtggccggcacatcattggtggctcccctccgtgagggaagccaaccgctcattttttccagtgccgccacgatttcagccggtgttttgcaatattcgggaaaatgactgattagttcggcatccgatgtgaccacacagttggcaccggattgttgcgcggcaacgatgatcagatcatcttcaaaatcccgatgccgtttttgcagggaaaaagccttatcacatgtcgactcatcgacagcgacgatgtcacacatctccttcacctgctcgatacaacgccatggcacccgtgacgacagaaagccgcgagtgaaattctccacttccgattcattcggtttgaattccctacgaatcgccgatgatgataggtatgcgatatccttcagcgacaatgacgcgcacaacaacgtaatgttgttcttcgcgccaagttccataaccgcttccgccatcttggcgtgatcatcgcgatggagcaaatagtccaacagtacgttggtatcgagcaaaatacgctgcatggaaacgtcggtcatcaatcggccctcttcatgttgtaatacgcatcaagttgctcgtcgtacattttgtcgcggaactgcttgtaggtaaggccttccatgaggtcggtgtcttctgagatcagtccggccttgaccagttccttgtgtacgtatccggcaccttctcgaatcagtttcagcttgcgctgcttttcctcctcgcgggcttgctcttcggcggtcgtttccaatgccggcacttccttgcggtcggcgatgtacaaccacagcgaccggattacgtcactcaccgatacgcctttgcccttgaggacttcttcgacctcgttcttcagtttcgcatcaatgcgaacgttcatttggaccatggtcatggcaacctccatttcgaagatgctatacagtatagcattttggcatgcgtggaaaaggccggtatccgttggcggataccggccttgctctcctcagtcagcttcgctgacagctcccctcaagagaggggagccaagaaggtggttacttcatgaggttgcgcagcacgtactggaggatgccgccgttacggtagtagtcggcctcaccgggcgtgtcgatgcggaccaccgcgtcgaactcggtcttggagccgtcctcgtgggtggcggtgacgtggaccgtcttgggggtcacgccctcgttaagcttctcgacgccggcgatatcgtaggtctcggtgccgttgaggcccagggactcataggattcgcctgccgggaactgcagcggcagcacgcccatgccgatcaggttggagcggtggatgcgctcgaagctttcggtgatcacggccttgacgccgagcatcaccgtgcccttggcggcccagtcgcgcgaggagccggtgccgtattccttgccggcgagcaccacgagcggcaccttgttgtcgatgtagtcgcgggaggcttcgaagatcgtggtcggcttcttggcgaggaagtcgtaggtgaagccgccaggcgtcacctcctcgcccacggaggcgagcagctggttgcgcagacggatgttgccgaacgtgccgcgcaccatgatctcgtggttgcctcggcgagaaccgtaagagttgaagttcttcggctccacgccgcgctcggtcagatacttgccggccgggctggaggccttgaacgcgcctgccggggagatgtggtcggtggtgaccgagtcgcccaggagggccagcacacgggcgccgtggatatcggcgaccgggtccggcgtggccttcatgccgtcgaagaaggtttgcttgcgcacataggtggacttgtcgttccacgcgaacagctcgccttccggcacgtcgaggcccttccagcggtggtcgccgtcgaacacggaggcgtagtccttgaggaacatctcgcggctcacgctgccgtcgaccacggcggcgacctcggcattggtgggccagatgtccttcaagtacacgtcgttgccgtccgcgtcggtgccgagcggctgggtctcgaagtcgaagtccatcgtgccggcgagcgcgtaggcgatgaccagcggcggggaggccaggtagttcatcttgacgtccgggctgatgcggccttcgaagttgcggttgccggaaagcacggcggtgacggtcaggtcgttggcgttgatcgcctcggaaatctcgggcagcagcgggccggagttgccgatgcaggtggcgcagccgaagccgacgagctggtagccgagtgcatcgaggtcgtcctgcagccccgcggccttgaggtagtcggccacgacctgcgagccgggagccagcgaggtcttgacccagggcttgggcttaaggcccttggcatgtgcgttgcgggcgatcaggccggcggcgatcatcacggacgggttggaggtgttggtgcatgaggtgatcgaggcgatggccacgtcgccgttttcgatgtcgaaatcgccacggaagtcggtggacacggccaccggatccttgacggtcttctcggtctcgtaggcgggggcggtcttctcgaacatgctcttggcttcggacagcagaatgcggtcctgcgggcgcttcgggccagcgatggacggcaccacggtaccgaggtcgagttcctcgtattcggagtactgcggttccacgtaatccgggtcggaagcgtcgccccacagcttgttggccttggcgtaggcttcgaccaacgcgacctgctcttcggagcggccggtcaggcgcaggtagtcgagcgtgacattgtcaatcgggaagatgccgcaggtggagccgaactcggggcccatgttgccgatggtggcgcggttggccagcggcacggaggcgatgccttcgccgtagaattccacgaacttgccgaccacgccgtgcttgcggagcatgtcggtgatggtcaggaccacatcggtggcggtaacgccctccgggatggagccggtgagcttgaagccgaccacgcgcggcacgagcatggagatcggctggccgagcatggcggcctcggcctcgatgccgccgacgccccagccgagcacgcccagaccgttttcggtggtggtgtgcgagtcggtgcccacgcaggagtcgaggtaggcgagcgtgttgccgttggcctcggccttgctcatgaccaccttggccaagtattcgatgttgacctggtggataatgccggttcccggcggcaccacgcggaagttcttgaatgcctgctgaccccagcgcaggaactggtagcgttcaccgttgcgctggtattcgatgtccatgttctgctggaccgcgtcggcgatgccgtacttgtcgatctgcacagagtggtcgatgaccatatcggactggacctgcgggttgatgacctccgggtcgccgccaaggtccttgaccgcgtcacgcatggtggcgaggtccacgatgcagggcacgccggtgaagtcctgcatgatcacgcgggacggcgtgaactggatctcgtggctgggttcggcgttcggatcccagtcgagcagggtcttgacgtgttcgtcggtgatgttggcaccgtcgatgttgcgtaccagattctcgaccagtaccttcagcgagtacggcagatgatcgatgccgtcaagattggcgatgttgtagtaatcgaagtccttgccggctgccttgagggtagccagctggtcgtcgcgtaaggacatgcttcctccgaaatcatgaatcggcttatgatgccgttgattatccgatacaaatggtacgggtacgttactttggctctggcgtgtcggcttgaagtgtgagacaattcgccgctattagatattgaaaccgtgctggcgcagtagattgccgaatattctgccgaccagcggagccagccatagacagatcacgaaaatcatggccgcgccgcccaacgcaatcagcgtggccaccaacgcagtgccggtaggcagaatcagcgcgaagaagttcgccacgaacgggatgaacgcgccgatgatgccggccgccgcgaaccccgcgaccagcgcacctcgccagctgttgagcggcctcgccacacgggccagcacaaacacgcccatcaaaaacagaataatggcgctggtggcgcgcaaagccgacagatcggcgtcattgttcaccacatcccagcccatgacgttcggcagggtccatgaagccagcaacaccgacagcgcggtggcgatgccgcccggcagcgcgaacgtgaccacgcgcttgaggaatcccggaatatagcggcgcgtgttcggcgcgagcgccagaatgaacgcgggcatgccgatggtgagagcgccgatatacgtgatatggcgcggcaggtatgggtatgggatttgcgtcagcactacgccgagcgagatcagcgcggagtacacggttttgacgaggaacaggctggccacgcgctccatattggccatgacctgacggccccgcgccacgacgtccggcaggtgcgagaacttcgaatccaccagcaccacctgggccacggccttggtggcgggcgccgcattgcccatggcgatgccgaggtccgcctccttgatggcgagcgcgtcgttgacgccgtcgccggtcatggcaaccacgtggttctgcgtgtgcaacgcctgcacgatggccttcttctggtcaggcagcacgcggccgagcacatcgacgttttcgagcacgcgggccagttcgttcacgtcctcgggcagttcgcgcgcgtccatcgccaccggctcatggtcgcctgtcagtttcactctgcgggcgatggcacccacggtcactggattgtcaccggaaatcacacgacagcgcacaccctgctcacggaaccaagcgagcgtccgctcggcgtcctcgcgaatcttctcagagcacaacaccaacgccatcggctcagccttggggtcgagctgcgggtcgtcagatacattggctccctcaactgctcccctcagtcgcttttggcgacagctcccctcggagagggaagccagctcgctcttctcggctcccctctccgaggggagctgtccgcgaagcggactgaggggcgctgtagaccgcgcaaccagcaacacacggttgccgtcattggcatactcgttaacctgctgcaacaccgacgaatagtcaccctcaagcgcagaaataataacctccggcgctcccatgtaccaggtctcgccggatttacgcaccgcactccatttgcgcgccgaagagaacgggatacgagactcaaccgcacctgccccatatccttgggccttgagcccggcgagtacggcttggccggtgccgttgggctgctcttcgttgcagcagtcgtagagagcctgcgtggctgcctgttccgcagccgcattggcggaatcgagcatcacgagccggttgaaggcgataccgccatcggtgatcgtgccggttttatcgaggttcagcgcgtccacgcgagccagtgtctccacggattcaagctcctgcaccagcgtattgtgacgggcgagacgcatggcggccaccgcgaagttcagcgaagtcagcagcaccaagccttcgggaatcatgcctactacgccggcgaccgcggaaaccacggcttgccgccattcgccggtggagagtgccgtgccccaaccgccgaccgtatgaatctgcgaaagaatcagcagaatgcacagcggtaccacgaggaaggtcatgaatttcagaatcgtgttgatgcccttgttcaggtcggacacggttttcttgtataccttggcctgcgcggtgagcgtggcggcgtaggaatggctgccgaccgcattgaccttgaccaatgccatgccggagaccgcggtggcaccggaatacacctgctcccccaccttgtggcgcacggtacgagattcgccggtgagcatggattcgtcgagttccagtccccaggtctggatgatctgcccgtcggccggcacctgttcgccggcgcggatccacagcaggtcgtcgagcacgatctcgttgtggggcacctccacgtccctgccgtcacgatgcacgaggaagtcggaggccacgaggatggatagcctgtccagcgtgcgcttggccctgagttcggtgacgatgccgatgcccgtgttgatgatgatgacgaaaccgaacaccgcgtccctccaggaaccggtgatcagcaccagtaccatcgcggcgaagatgatgccgttgaacagcgtgaacacgttggctcgcacgatatcttgaaccgaacgcgagctggaggttttcaccgcattcgattggccactttcgatacgctgcaccacttctttgggggtaagaccggtcgctccgatctcaggcatttccacggctgttgttgcactcatattccctagcctaccgcgtcttgtttcgcaatccactaaggctcagggatgattcagggtgctttctcagcttcaaggggctgattcggctcaggagacggtgactttgatctcgcgttcgtggggttcgtcgcgcgtgatggtgagcacggcgtcagtaatagtcattggcttggtatcggcagtgtcgccagaatcggcactgttggtgttgaggtgaaggatgacggcgtacagcagttcatcttcgggcgcatgctttggatcaatgagagcgactggaataccggcttcacgcgcattggtcaacgtctggttccagctctcccggttggcgtcggtaacgtcgatgccgctgataaccacgattttgaccgcgcgagctacgaaatcggcaacaccctgctgtgcggtggccgcattcttgtcgacgccagtatgagcatccatactatcggcaccgttttcgctggtagtgccggcgtcagaagattcggtttcaccggatacaccatcagttgcgtttgccgagcttgcggatgtttcgagcgaggcatagtagacattgagtttgtcatcagacagcgcattgatgacgaactcgtctgcggcggtgtcagtcgaccccacaaagccgactgtgacatccgtgggatgtgtggaatcgtgggcgacttccggcatgctgtcttgggtatcgccgaccgccctaccggccggcgtgcaggcggccagggacaacacagccgccatgcaggccagcaatccgagaattcgtcgtgtcatatgctcacctgtcagcgggtaaacagggccaccgtctcaacatggtgggtcatcgggtagatatcgaaggcacggatgtctttgagctcgtagccttcgccgatgagtgtcgcggtgtcgcgtgcgaggctggtgggatcacaggcgatgtagaccacgctggatgcgccggccgcggcaatctggcggcagaccttggcacgagcaccggcacgcggcggatcaagcactacgacattcggcttggccagatgcgccggcacatggtccagcgtgcgcgagacgtcacccgcgcgggcgtccacgtcgttcaggttcatggcgcgcagattgcgctgggcgttcttgacggccacacgcgcgccttcaacgctgagcatgcgggtgcgttcaccggtcattgtggccagcggcagggtgaacaggccggaaccggaatacagatcccagattacggcgtccgccgctgactgcagctgcccgttgaccaggttgatcacgtgcgtaccgagggcgatcggcgcttggcgatgcacttgccagaaaccgttggcgtcaacctgatagtcgaaggtcgtgccgttgatggtcacctgttcggtgagcagctgggagccggcgcgcagttcgccgtccacaagtacggcgtaattgtcgtctgctgccgcggtatcgacgatctcgccgcgcggttcgggcacggaaagacgaatctgggagccgggttcaaagccgccctcccacacgtgttcgcgcttggcgacgtccagcagcgtgcgcgtggcaagcggcatggtgtcgatggccacgcggttgtgtgtgccgcgccggcgcatggatggcatgccgttgtcgtcagcaatcatttcgatgcgggtacgccaattgaggccgccggctgccttgtcgccgggcatgcgctcgatgggaacggccacgtcgatatggccgagtcggctcatctgttcggagacggtgatggccttccacttgagctggccgggcaaagagacgtgcacgagatccgcgccgcccactcccccgcccatcgccaagggaccggcaagtggccatgccggggtgactcggtcttcagacggctcgagaacctcgacgacttcgccggtccagaaccggtcgtcccggtcgtggggctcgtcaagctcgactcgcacgagttcgtcgggcaaggcgaagcggacgaacaccacacgaccgtcgatatgggccacgcagcggccttggtcggcgtatcgttcgatacgaacttcagcttgcatcatcgtcctttccggttgcgctcggttcgagttcggcatcaacagcgacttcagtctgtatcttcttagccgcgaccttatgccggtgcatcggcgtggcaataatgaggtaactcacccaaatcgccaatgcccagaacggaatgcccatgagcaggcgggtcacgccaagtgcagctacatggttggtcagatacagcggcacctgcaccaccagccgcagcaggaacagaccgacccacaggccggtgacaatcatataggcgcgtttcagggccttgtcgtccatccagtcatggaaccatgccttgaaatgctcggtgggcaggctacggatgaattcgacgaccaaacccagtccgggcacgcgcgcaatcagcgacacggcaagcaacgcggcatagccagcattggtaatgaatccgaagatgtagtaattgcgggcctcatgagtctgccatgcccaaatcaggcagatgcctaccgccaccagaccagagaccgcgcccattaccgactggcgctgaatcagtcgcacaataacctgcaataccgccagcacggccgaaaccgcaatggtgagattcagattgctcgtggccacgaacagtacgacgaacaccacgccgggcagcatggattcgatgacgccacgcgggccaccgatggcgtcgatgacggagaaatcctcgccttcattgccggcgtcggctagagcggacaggccggtgcgtttgttgtctgccaagtctcttcctataaatcagcgaacttcggagaacatcgggccgcgagacagcgtggtcttcacttcggtctgctggtcctggctcagcggacccttcggcttgttgttcggaatgtccttgaagtgttccttgccgttctcctcgccggcttcggccgcggccttggcggccttacgctcagcgggggcgaccggcggatgcatcgggatcagatcgcgcggcgccaaaggctcctcgccacgctcgacgacgatgtcggcgaagaacttgttcagcgcctcggtctccgggctgtccggatcgatagcagccttgccggagaagatgccacgcagcatccagcgcgggccgtccacaccaacgatgcgcgtgttcacggtcttgccgcccttgacattgaccggcagcttcagttcggtgccgaacacaccgtccacttcagaagcggccttgttggcttcaagcaggtcaccgcgaacgtcatcccacagtcccagggtcttgggtgcggcaaaggcttcgatctccaggctggaggagccgaaggtgatggtggaaccaagcacttgctgggtggcgcggttggccttgatgcgcagctggatgccctggaggaagggcaggtagtaggcgccgagatccagataatcgtcataatcgggcacgtcctcatcgttgacatcccacgggcctcgctcttcgccgcggccctggtattcgctggccggctcggcgagcacggtctccgcgctctcggcctttgcggcagcgttcgcttctgcggcggccaccttgtcttcatcgacaggctcaatggccggctcggcttccttcttgctcttcttcttgccgaatccgaacagtcccataattcctcgtttcatgtaacggttgcaaccttgctaacactagcactcaggcttagagaaagctgagcatcgcggccgccgatgtccggttcgattcgtagggaggccaaaatagtatggccgcatgaccatcaccattaccacgtctaacgtcaacggcattcgtgcggccaagcgcaagggcatcgaggattgggccggcaagcatgcgccggatgtctggtgcatacaggaggttcgcgcgcctcaagacgatgtcgattctattttcgatgaatttggtttcgaatacgccaccgccggcaagatcgaggcaccggccaacctccatgccatgaacgaggtctgccgggtgaaaggccgcgcgggagtcggactgctcaccgacttggaagtgcttgacaagcgatatgggctgccaggtctgagcgaggatgtggattcagggcgttggatcgaaaccgatgtcaaaacgcctgagggctacgcgatcaccgtggcatccgtatatgtgcatgctggcaacaccgattatccgaccaaaatggaacagaagtaccgttttctggacacgatgctgaagcgcatgggcgcgttgcgggacgaggctgcgcatggcggcaaacaggccgtgctctgcggcgatttcaacatcgcgcacacgccgcttgatatcaagaacgccaaggccaatgagaagcacgccggatttctgcccgaagaacgtgcctacgtggacaaatggctggacgaatacgagttcgtggatgtgatgcgttcgttggccggcgacattcaggggccatacacctggtggagccagcgagggcgcgctttcgacaacaatgtcggctggagaatcgactaccagttcgccacgcccgagttggcggagaccgcacgcggattcgtcatcgacaaggctcccacgtatgacaaacgctggtccgatcacgccccactcacgatcacatacgaggtatgacgtattccgtgggacaacatccgaaaatcgacgattttcgcgggccgtcccacaccccacagcatgagtaattatcgaccacactaagaatggcgtaattccgggcttcgtgagaaatctgctgtgggacaacactcatgtctatcgattgatgttgatgttgtcccacaatttgtgggacaacatcgggaaaacaccaatttttgcctttcgtcccacgcgaaccatcatgcaaacctgcgcatacgaatattgggttctttccacggatggaaagaacccaatacaatgcgctcaaacgcagattatcagtccagaccgagttggagcttgccgccggggatggcgtcgagcaggtctcgggtgtactgcttctgcgggtggtcgaagacctcgtcggtggtggcatgctccacgagcttgccgtgctgcatcaccacaacctcgtcggcgatctgacgaaccacggccagatcgtgggtgatgaacaggtagctcaggcccttttcggcctgcagatcgttgagcaggcgcaacacctggtcctgcaccagcacgtccaaagcggacacggcctcatcgcacacgatgacgtccgggtccagagccatggctcgtgcgatggcgatacgctgacgctggccgccggaaagctcgttcgggtaacggcccatcacggaagccggcatctcgaccatgtccagcagttccttgacacggttggcacgccacttcttgtcgccgatcttgtggatgcgcagcggctcctcaatggaacggaagatggagtacatcgggtcgagcgaaccgtaggggttctggaacaccggctgcacgtggcggcggaaaccgagcagatccttggacttgaacgtggaggtgtcgcgaccttcatagaacaccttgccggaagtgggcttcaggaggtgaagcaccatgttcgccacggtggacttgccggaaccggattcgcccacaatggccagtgtggtgccacgcttgacggagaaggacacgtcatcgacggccttgaacatctccttcttgcggggcagcttgaattccttggtcaggtggtcgacggtgatgatgtgctcgctcttttcgagcgtgctttcgccggcgatgtggtgatcgagcagagcgtccgcatcctcaccacgctccttggcggagatgatgcgctgggaggccagcgacggggcagcggccaccagtcgcttggtgtacgggtgctgcgggtgctggagcacttcaagggatgggccggattcgacgacctgacccttgtacatcacgacaatgtgctgggcgcgctcagcggcaaggcccagatcgtgggtgatgaacagcacggcggtgcccaacgagtcggtgagcatgtgcaggtggtcgaggatgcgcttctgcacggtcacgtcgagggcggaggtcggctcgtcggcgatcagcagatcggggcggcaggccaagccgatggcgatgagcgcgcgctggcgcataccaccggagaactcgtgcgggaactgacgggcacgggtagcggcgtcgggcagaccggcctcggacagcagacccgcgatacggtcatccattgtggagccggtgacgtacttcttagccagataccaggcctggtcgtcggccacgccggccttgatgaggtcgtcggccacgcgccaacgggtttcggagcccggaacccattcgttggtgaagcgggcgacggccttgtcgaaggcctcgccggacacgccggcttcagtcaaagccttcttggcctcggtcatgagctcgggcagttccttggctccgaggaaggtctcgtcgtcgttgcccttgacttcgacctcgtcgccggccagagccttggcaagggcggagcgcttttcgtgagccacgtccatgttgttggccttcagtgcttccttgacctgggtgccgatacgccacaccgggttgaggttgctcatcgggtcctgaggcacgagacccatcttggtgccgcgcagcttgtcgaactcgctctgcttggcgccggcgatttcctcgccgtcgagcttgatggagccgttgaccacgtgaccggtgccgggcagcagacccagcacggccatggcggaggtggacttgccggaaccggactcgcccacgatggccacccactggccagggtagacggtgaagttggcatcgcgcaccgcgtgcaccggcttgccggtgtcagtggtgaagtcgatggccagatccttgacctcgagcagcggaccatgctctttctgcatagccagcatcttggcgttggtgttgtcagtcataatgtttctccactcccctcgctcaggccgtacggctcttcggatcgagggcgtccttgacggcgtcgcccatcatgatgaacgcaagcacggtgatggccagtgcggcggacgggtagaacagcaccagcggatcagtctgcaggttggtctgtgcgctggagatatcgccaccccagctcaccgtggtggtcggcaggccgacgccaaggaagcttagggttgcttcggccacgatgtaggaggccagcgaagtggtggcgatgacgatgatcggggccagggagttcggcaagatgtgacggaacaggtttctggcaggcgtggagccgagggccgtggaagcggtgttgaattcgaggttcttcgattccagcacggcgcttcgggcgatacggcatacgccgacccagccgaagagcgtcagcaccagcacgatcttccagatggacttggaggtcttgaacatctgaagcaccacgatggcgccaagcagcataggcagcgcgaagaagatgtcggtgatacggctcagcaccgcgtcgacccaaccgccgaagaagccggcgacggcaccgatcagggtaccgacaatcacgaccagcagcgtggagagcacgccgacggacagtgaggtacgggtgccgtagaccacgcgggtgtacacgtcgcagccctgcaggtcgtagccgaaggggtgtccggcggaggcggggctcaaggagttgcccagatcgcaggcgttcggatcctgcttggtgaacagaccgggggcgatggccaccacgatgatgaacaggatcagcaagccggagatgatgaacaacgggttgcggcgcagggttcgccatgcgtcggcccacatgctggtggccggtgcggattcgtcgacggaatcgacgtcctgcaacggggtctcgtcgagaggagctacgtaacggtcctgaccgggcagggtttccatgaagtattcggttcctggctcgccggtctcgttgagctcgttttcagtggtttcgtttgccatgtgactcactcctccctatcacgcgtaacggatacgcggatcgagggccgcgtacaacatgtcgacaacgaggttgcacactacgaaaatcagcatgagcaacgtgacgatggacaccaccaggtttgcctcgcccttcagaatggactggtaggtgaggaagccgatgccgtggatgttgaagatctgctcggtgatcatggcaccacccatcagggcgccgatgtcctggccgaggtaagtgacgactggaatcagggagttacgtaacacgtggcgcagcatgacctgaccgttcgacatgcccttggcgcgtgcggtgcgcacgtaatcctcggcgatgttggaggagatttcggagcgggtcagtcggatgatataggccatcgacaccgaaccgagcaccatggccggcatgagcagatcaaggaagccggggtcggcgcctgccgtcaccggcaatatcgcccactgaataccaaagacatattgcatgacgaagccggtgacgaaggtcggcacggaaataagcagcagagagacgatcaggatgacggtgtcgtaccacttgcccttcttgaggcccgagataatgccgaagacgacaccgaaaatcgcctcgaacacgaacgccatcaagccgagcctgatggtgaccgggaaggcgcgggtgatttcgtcgagaacgggctggccggcgaaggtatcgccgaagttcagggtcagtgcattcttcaggtagataaagtactgaacgatgaacggctggtcgagatggtattctgcgcggatctgggctgcgacggcctcattgacgggcttgtctccgaacatggccttgacagggtcgcccggcagggcgaatacaagggcatataccagaagagtcgtaccgagaaccacgggaatcatctgcagaatgcgtcgcagaagatacttacccatacggttgctccttatttcctagaccggccagaaagggtatagtacgcccccgccggtcgataaatactccgacagtttaccgcatgcccggactgtgatatgtaaatttgcgttaacgcaaggtttgagattgggcaatgttggtggatatgtccatggttgcggtcggatagtggatactttaacttggttcccgatggcgtgagcaagcacccctcacacaacaaaaagggcggggatcttgcgatcctcgccctttatttccgaactacctaacggtatccgttcagtgagtcagactcacttcttggacatctcggtgtaggtcgggaggttctgccaatcgaaggcgtagccggacttcacgttgagggaagccacaccggaggcgttggagtagtacagcgggatggccggaaggtcgttgaggaggatttcctcagcctgctggtacagcttgttggcgtcatcagtgctggaagcggcagcagcctgcttgcacaggtcatcgaaggccgggttcttgtagtcaccatcgttggagccgttgccatcagcagcagcggtggagtacagctgccacaggtagttctcggcgaacgggtagtcaggctgccagccggtacggaaggcgcccttcatctgacggttggtgaccgcgtcacggaattcctggaaggtcgggatcgggttggtggccgcgtcgatgcccaagttgttcttgagctggttcacgatagcatcgtagagcggcttggcaccaccatcggcgttgtaggagaaggtgagctggccgtcgtacttggagatggcgtcagccttggcccacagttccttggccttggaggcgttgaacttcaggttgtcggcacccttgagggagtcggagtagcccggggtcttcggggaggtgaactcggtggcggcggtggcgttgccgttgagcaccttgtcgatgagctggtcacggttgatggccatggagatggcctgacgacgcagctggccttcctcgtcgttcttgaagtggtcaagggaggacgggatggtgaaggtctggatgacggagccggcctcggagtaagcctggaccttcttgtcggtcttgaaggtcttggtgaaggcagccgggacggattccatcacgtcgaggttgccggcctgaatgtcacggtaagcggcggagtcgtcggtgtagaccttgaaggtcacgccgtcgttcttgggctgctcgttacccttatagtcagggttcttgacgagggcgatttccttgttgtgatcccagtggtccagcttgtacgggccattggagacaggcttctcgccgaaggccttcggatccttgtagaaggattccggcagcggggcgaaggccgagtagccgaccttaatcgggaacacggagtcggactggttcaggtcgacggtgaaggtggtgtcgtccacgaccttgaggccggagagctgctcgtcacccttgaggccatccttctgcagatcgtcatagccggcgatggcggagaagaaggaggagcacttctgggcgttcttggcgttggccacgtaggaccaggccttggtgaaggactcagcggtcaccggagtgccgtcggtgaacttccagccagacttgatcttgatggtgtactgggtggcgtcatcgttcggggtgatggactcggccacttcgttggaagccttgccgtccttgtcgaaggagaccagacgggagaacagcaggtcgaccggcttgccgccgccggtttcgttggtgttgcccgggatcagcgggttctgcggttcggagttgtacgcagtgatgatgttggagccagcggtgtcaccggaggcagcgttgctgttggagccgccgcaggcgctcagcagcatggccacggagcaagccatggcagcgaaagcaagagctttcttcttcatatgatttctcctattcattaggttgcaggacgtctcagccccgcctcatgcgaacggggtcggatttcctcatcgtcgggacacttacgcttcccgccgcttcggacacccaaccccgttgctgttacctgtcatttttgcgcacttgggagacaagcagtgtattttttgttacacccatgtaaaattccggggttcttgccggctaggttcagtctttgctgagtttgttaaccaatgtccacatagtggtcatgcccgcggaaaggcctgtccgtaacggttcttgagctgctcgatggagacgtgcgtatagcgttgtgtagttttcaaggaggaatgcccgagcatctcctgcacctccctcaaatcggcaccgccgtccagtatgtgcgtggcggcggaatgacgcaacgcatgggggctgatgtccggcacgccggcctctcgggccgctctgtgcacgatgtcacgggctatgcgttggtcgatacggccgcctcgtgcgccgaggaacagggcgttggcagcacgggacttgactgcatccgttgccgtacgggccagtaccggccgcccctgttccagccaagtctccagcgcacgctgggcgggtagtccgaacggcaccacgcgttgcttgttgcctttgccggtgactttgatggtgcgattggagaagtcgatgtcggcgatatccatcgacaccagttcggcgacacggatgccggtggcatacagcagttcgagaatcgcggcgttgcgctgcgattcggcggtgactcgggcgttgtcgcgcttgtctgcacgggcgggtgcctcactgcggtttacggtatcggccgacttatcagctgtcttgccagctgccttgccgctgccggacgcggctgccgctcccccatcgcccttgtactggtttgttgcaacggcctgttcggcgacatccaataactgctcagcttgagattcggtgagcaccgcgggcagcgtgctgggaatcgagggagtcatcagtgtggcggccgggtcggtgtcggtcaccccatgctcataggcccacgcgaagaacccgcgcacggccacggttttgcgggccatgctgctgcgggcgtgatcgcgcgattccaccgccatccagctacgcagatcatccagcgtgatctcgttcagatcggtcacgccgcgcagctcgaacaggtgcagacatgccgtgagatccgcgcgatacgctttgagcgtattcgctgacaggccgcggttggacttcagataggagacgaaggagtcgatatcgccgtcgaactgcgtagatgacactctcgttctcctccgaattctttatggccttgggttacggccggggtggcgtgttgcgccgctccggcacgggtttcaatgtggcaatctgttcctgatggatggtcacgttctgggccgggcgcgaaccattggcggcggcgtcacgcaccatctccaacgtgtatccgtcccaggaaaccacgtgacccacatagtcgcggaacttcatacggtggtcgaccgggtcaatgccatcggtgatgcgcaccaccacgcgggcaccggccggaatctgccttggtaacgtcatacgtcatcatcccccttaaccattcgccgcatcaacttcgatgcgtttcccgaaaaacggtacagactaccttactcctttgggcctttcgaacagcggagccacacggtcttctcacgaaaacaagcgggaacttcatccccctcgcgcggccttcttcgtgacaggcggcgaggggaacctgcgcacgggcctacatggcggtacgcagttacatggcggggcgcagttggatgatggcctgacgtggatggacgaagccggtgatggcttctcctcggcgtgcggagaacagcaaggtctgctgccagccggcttcggggacggcgagctcgcgttccgggaatccggcggcagttgtgccggcttgcggcgcagcggtggccgtaccgtcttgtgcagcggtgatgccggcatgtgtcacggcggccttgtaccggcggaaggggtcgccttcggcgaagaatcccatcacatcctgctcgccggcggcaccagcgtgcagttggtcggccatatcggtcagacgtgccgccatgcggcgcagcagcgcttcgacgttcagcgagtcttcctcgaccatcgcgcgcgtgcggtccgggtcggtcagggacacgcgggtcatgtccctccagcagccggcggccagcgcggcggcgatgttgcggtccgggttggcgaccagttcgttgatcagcgcggtggacaccacatgcggcatgtgggagatcatcgccgcggccttgtcatgcgtttcgtcgtccacgacgatgacgcggttgccgacgtccttggtgatcatcgcggcgacgtcgaggaagcggcggtagtccgtggactcgtccacggtgatggcccatagggcaccgtcgtacagatgcgggtcggcggcctgccagccggacagttcgttgccggccatcggatgggcgccgacgtagcacttccccagcccggcagccttgacctgatcgcggaccatgcccttgaccgagcccacgtcggtgagcgtggtgttcggatggtcgcccatgagcgggcccaggacggcgaggattgcgggcatcgccttgagcggattgcacagcacgaccacatccggctcggcatccatgagttcggagagcgtgctcttgcagaaaatgccatcggcttcggcctgggcgtaggggtgcgggcgatggttccacgcgacgacgcgcacgccgcgctcggtcaggcggcgtgcgagcgagccgccgatcaatccgagtccgacgattccgactgtatctaccacagcagttccttccttgcttcctcggtgtactgccagccttccggcgcgcgattggtgatgtggacgccgccctcgggcagcatccaggcgtcgaccggcgggttcgggcgttcgcggcgtgggtagacggccagggtttttgcccagtcgccgtgtccggcgatctcttccagcgcggtgcggaatctcggctcccagggggcggcgtcaagggtggcgatgaagctgtaggttccgtcgtggcctttgatcgggcgcgagatgaagctggtcatgttcagtcccgcatcgcgcaggacgtccagcaggtcggcgagtacgccggggccggtgaccagcgggatgaaggtgatgatggtttcgaagtcgccggcgtcattgctgtgggcgcgggcgttgagctcctggaccacctcacgcggggcgatgacaaggaattcggtgtgcgcgccatcgaaatcctgcacatgttcggcgagggtgtcgagatcgtagagttcgccgcagaggctggggccgagcgccacgcggccgggcttcaggtcgcggcaggcggcggcgttggaggatgcgggttcgggctgcaaatggtgttcggcgatgaaccgggtgcattgggccagaccgtgcgggtgggcgctgacggggttgccggtgcagtcgtagatgctgtggccgcgcacggtgaaggcgttgaaggccacgtccacactgatccgggcgaagccggccgcgttgggggcgtcgatcagcgcgtcgagattcgggaccacatagccttcgacgttgttttcccatgcgatgacgccccagccttggcgcgactgtacggcctgcatgatcgcaggcacgtcgggcagagcgatgaggtcgaagtcgccgagtgtggcgaactggtcggcggccgtcattgccgcctgatgggtgaaggtgccctccgggcccaagtaaaacagtttcatgcgtgccataaagttctatggtagcggccgtaatcccctacgcccgccgatacgcgacgcattcccgggaatgtatcgccatatatagttacgcgcgcgattcagaatgagtgggaatgacgaaccagcgggcgggaagaatgagcaggacgacttggaccagtatcaggccgtacagccagatgtagccggcatgttgggagaagaacggcatgtcgccttggaatccggcgacgatgagcgctttgccggatgtggtggtcagcgccatgccccatgcggtcagtgaggaggcgatgaggtgcagggccagtccgaccgcgcccatgcgcgaacgggcgcaccatgtcgataggccgatcagcagaaacgccagcaccagaccatacggaatattcagttccgcacccatacggtgggcgaacgtgcccacaaaggcggaagccacgcccgccgcaatcgtgatcaacgatttgaccagcgcgttctggcgatacgaccacggacgcaattcagtagtgctcttcacagtcatgcgtttcagtataggtggggatatgacttggtgaggaataaacttagctcccctcagagaggggagctagagagaatggtcggctacagccgcaccaaatcacttaccctgctgggcggcgttctggcggcgctgcttggcgcgccacttgtaccagtcctcacggccgaggatgatcttgcgcacgcggatggactccggggtgacttccacgcactcgtcctcgttggcgaagtccagggactcctcaaggctcatcttgatcggcggggtcagggtttcgagcacgtcagcggtggaggaacgcatgttggtcatgtgcttggccagcgtgatgttcacgtccagctcgtcgggcttgttgttcacacccacgacctggccttcatacaccggggactgcggttcgacgaagaagttgccacgggcctgcagacgctgcatggcgtacggggtggcgatacccttgcgatcggaaaccatggaaccgttctggcgaatggtgatggcgccagcccacggcgcgtagccggcagagatggaggaggagatgccggtgccacgagtggcggaaagcagcgcggtgcggaagccgatcagaccacgggacggcacggtgaactgcagacggacccagccggagccgtggttggtcatgccatccatacggcccttacggtcggccatgagctgggtgacggtacccatgtactcttccggcacgtcgatggtggtgttttccatcggctcgttgatcacgccgtcgatcttcttggtgaccacctgcggacggccgacggtcagctcgtagccttcgcggcgcatctgctcggcaagcacggccagcgccagctcgccacggccctggacttcccaagcgtcgggacggtcggtgggcagcaccttgatggacacgttaccgatgagctcgcggtccagacggtccttgatcatgcgggcggtgagcttgtggtccttgccctcggtgccggccagcggggagtcgttggtgccgaaggtcatggagatggccggatcgtccacatggatgagcggcagcggcttcgggtcgttggggtcgacgatggtctcgccgatcatgatgtcgttaacgccggcaacggccacgatgtcgccggggcctgcggattcgaccgggatacgctcgaggccctgggtgcgcagcagttcggagacgcggaagttctcgagggagccgtccacacgggacaggccgtaggtcttgcccttctcaagggtgccgttgtagatacggaccagaccgagtcggccgaggaagtcggaggagtcgatgttggccacgtgagcctgcagcggggcgccctcctcgtattcgggggccgggatggtggagatgatggtttcgaacagcggctcgaggttgtcgttgtccggcaggccaccgtcggcgggctggttcacggaggcgtagccggccttggcggcgcagtagatgaccggcatttcaagcagctggtcaaggtccaggtcgatgccctcgtgctgcacgtcgtcggccaggccgagcagcaggtcggaggtttcgccgacgacctcttcgatacgggcgtcggggcggtcgaccttgttcacgcacaggatgaccggcagcttggcttcgagggccttgcgcagcacgaagcgggtctgcggcagcgggccttcggaggcgtccacgagcagcacgacgccgtcaaccatggagatgccgcgctcgacctcgccgccgaaatcggcgtggccgggggtgtcgatgatgttgagggtgatgccctccgggtggccgtacttggcggccagcggaccggtgtattccacggccgtgttcttggcgaggatggtgatgcccttctcgcgttccagatcgttggaatccattacacgatccggcacttcctcacgctcggaaaacacgtgcgactgctgaagcatggcattgaccagggtggtcttgccgtgatcgacgtgagccacaatcgccacattacggatatctccacgaaccgccatcgaaacctctcttaatactgattcttttgcgtaatcgttcggtacttgcgttctcgagtacttaagtacttactctgaggtgtttattcatacctacacacaaaccgtcacgatggtactcgcacaccttgactatgtcggaacatagaaaagcacctcacaacggcagaactcccgcgtctcgacgaacccctcgcgggatttctgccgtttttacggccttcaaacggcagaacccccgcgtccctttcgccgggacgcgggggttctgccggtaatcaggcaaatatctgttctcccgtcatcgacttccgtcagtcttcgagatcgaggcctttgcgttcgggcaggcagagggcggcgacgcaggcgatgatgaaggcggcggcgaagatgatgaaggccacggccttgttgccgccggacagggtcaggaaccacggcatgaggagcggcgcgatgatggcggcgatgcggcccaccgctgcggcggcaccggcggccgcgccacgcaggcgggtcgggtagatttccggggtcacggcgtacagcacgccccacgcaccgaggttggaggcggacagcagcatgccgaacacgagcacgagggccacagatccggcctgcgagaacgcgaaggcggccacggcggagacggccaggaagatgctcagcgtcttgcggcggccccagacctccaccagccaggcggctaggaagtaaccgggcagctgggcgatggagatggcgagcgtgtagccgaatgacttggtcagggagccgaactggtcggcgagcagcgacggcatccatgtgaacgcgccgtagtaggagaagttcacgaagaaccacgtggcccagatggcgatggtgcgggccaggtacttggagccgaacagttcgcgcgtcttgatcttcggcagcggcttgcccttgggagaggttaccggggctactcccccggcttcctcgaagtagcgcacggccttttcggcttcgtcttcgcgacccttggcttcgaggaatcgcacggattctgggatgtgcacgcgggtgacgattgcgtagagcagtggcagcgcgccgatggccagcgcccagcgccagccccagtcgccggtgttcgggatcacgaagtagccgatcatggcggcgacgatccagccgacggcccagaacgattccagcagcacagtcatgcggccgcgctgtttggtcggcgaaaactcggagaccagcgtggaggcgaccggcagttccgcgcccaagcccagtccgatgatcagtcgggcgccgagcagcatgccgagtgaccaagatagggccatggcaccgttggcgatgccgaagataatcagtgtggcggtgaacacggttttgcggcccacgcggtcggcgatgaagccgcccactgccgcgccgatggccatgccgacgaagccgatggacagcacccatgacttttcggtcggggtgaggttgaagtgcgggtcggcggcgatggcggcgactacgaaggagacgaggccgacgtccatggcgtcgaatgcccagccgatgccggaggcgacgaggagtttgcggtgcgccttgttgaagggcagccggtcgaggcgctcgttgcgggtgagctgcgcgggttgcgctgaagtggtggtgctcacgtcgtttcctttctggtaagtggcgtcagatttaatggcgggtcaggtcggtgtaggactcttcgatggccaagctgatgcgttcgacttgttcgcgggtcagcggcttgcggaaggtcatgcgtaatgccgatttggcgatggacggttcgaggcccatcgccagcaacgtggcaggaatctcgtggcgcccgatggcgcaggccgagccggatgaggcagcgatgccgcgcgcgtccaggtcgacgagcagcgcttccccggtgacgccggggaagatgaaggaggcgtgaccgggcagacggcgttcggggtcgccggtcaggtcggcgcgaggcgcgacccggcgaaccgcgtcgatgagcatgtctcgggacgcgaccaactcacggtactgcgcctgcatgcgcgcattcgattcgttgagtccgatggcgagcgccacggcaccggccacgttctgcgtgccagagcgcaggccgcgttcctgcccgcctccggacagcaccggttcgatgggtgtgcggccgcgtaccagcagcgctcccagacctttgggggtgccgaatttgtgtccggatacggacagggcgtccacatcccagtcacgaaaacgaatcggaatctgcccggcggcctgtacggcgtctacatggatgggcacgccgtgcgcgtgggcgatgcggaccagttcctccacgggttccacggtgccgacctcgttgttggccagcatggtggagaccatcgtggtacgttcactggcctcgccgtcgagctcgcgttcaagtgcgtcgagatcgagatgtgcttgcgcatccacgggaatgcgcacgacttcgaaaccgaaccattcgtgcagccatgccgccgattgggccacggccgggtgctcgatagcggaaatgataatgcgcgggcgacaatttgccggctgtttgccatcggcttcggcgaatccgcagaccggccgcaagcccagtttgcgcatgcgcgccatggcgatgcctttgatggccagattgtccgattcggtgccgcctgaggtgaagatcacgtcatccggccgggcgcccaatgccgcggcaaatgatgcgcgagccgcgtccagcgcgcgggccgcggttttgccgggctggtgcacgctggccggattggcgtaggcctcagtcaggaacggggtcatggcctcgatgactgccgggctcactgattcggtggcggcggcgtccaggtacagttcgccgggttcaccggatgcgttgggggtatcggccatgactagttccaatccaatccgaggtcgatgctgcgcacagagtgggtgagcgcgcccacggagatcacgtccacgccggtgacggccacggctggcactcgctccaggctcatgttgccgctggcttccacgatggccttaccgtcgatgagctccacgccgcgacgggtgtcgtcgagcgagaaattgtccagcatgatggtgtccgctccgccggcgagcacggcgggaatctggtcaaggcggtcgacttccacttcgatatgcgtggtgtggcccacctgttcgcgcacgtggcggatcgcgccggccaggtcgatgccgcgcgcggcgagcgccgccagatggttgtccttcatcatgaccgcgtcggacagtccgtaacgatggttgtggccgccgccgcagaccacggcgtatttctcgaacgggcgcaggccgggcgtggttttgcgcgtatcgacgatgcgggtgcgctcgtagcggcgcggccgggtgacgggtccgtcataatcatcgccgtagatggcgttcaccgcgtccacgaaggcggcagtcatggtggcgatgccgctcatgcgctgagtgaagttgagggcgatgcgctcggcggtgagcaggtcgcgtaccgggcctttcacggtggcgagtatctggccgcgctggaatcgctcgccgtccttgatggcggcggtgacggtgacggccgggttctgtgcggcgaaggctgcggcgaacacgtcgatgccgctcatcacgccgttttcgcgcgcggtgaggtgggccgagccggtttcgtccgcggggatggtggtctcgcaggtgatgtcgccgtagggcgcgtcttcggcgagcgccgcttcgacggcgacgcggatgatgtgtgatgtgagcatgggtcagtccttgatgtaggcgacggagtgggcccagttgtcgactggctcgctgtggtcggtgcgggcgtgggcgcctctcgactcggtgcgggcgagcgcggcggtggcggccacatagcctacggtgagcatgttgcggttctccaaagcctcaacgctgcttgcagcaccatcggcgtttacatcagcctgggcgtttgcggcggcgaggccttggccgagttcggcgatggcggttttcagtccggcctcgtcgcgcagcacgccgacgccatgccacatggtgttctggatgcgggtacgattccacaccttgtcggcggcggtatcgtcagcagcagccgtagcggcaggggcggccagcgcgatcggcgcatggtcgaacacggcaccggtggcggagttcaggaacggttcgggtgcccagaccgcgtcgtcaccgtccgcgacggcggccagaccggcgcggcgtccgtagacgagcccctcgagcagcgagttggaggcaagacggttggagcccatgacaccggtacgagcgcattcgccggccgcatacaggccgggaatggaggtccgggcgttcagatcggtgcgaatgcctcccatgtagtagtgcgcggcgggcgccaccggaatcggctccttgctccagtcgaagccaagcgaacgcgtataggcgtcgatggtcgggaatcggtgggccaagaagctggccaggtcggggttctcgcgggccatcggcgagacgtcgagcatcacgggcttgccgccttgcgcctgcatcacgcggaagttctcgcgggccacgacgtcacgcggcgcgagttcggcgcgcggatcgatgtccttcatatacctgtggccatgctcatccagcagcaccgcaccttcgccgcgcacggcttcggagacgaggaagtgctcgcccacggccatggcggtgggatggaactggtagaactccagatcggcgacctgggcaccggcacgccatgcgacggcgaggccgtccgcggtggcgaccggcggattggtggtgtacgggtacatacggcctgctccaccggcggccaagatcacccggtcggcggccagatccttgtcctgcccgtcgatcagcaggtggacgccggcgatgtggccgccccgcacgatgagatctttgaggaaggcgttctcgatgatgtggatgcgcgggttcttgcgcaccatggcggagacgtccagttcaaacactttgccggtggcgtctcccccggcatgcaccacgcgggcgcgcgaatgagccgcttccaggccgcgcagcatgtgtccatgcgcgtcgcggtcgaagtggacgccggccgcggcgaactcgcggacgcgctccgcaccctcacgggtgaggatgtccacggccttcgggtcgcacaggccgtggcccgcggccatggtgtcggcggcatgcagcttcgggtcgtcgtcggagaagatggctgcagcgatgccgccctgcgcatgataggtgtttgattccaccagttcggccttggttaccaaggtcacgtcgtgtccggtgccggccacggccagtgccgcggacagtccggcgacgccggcgcccacgacgacgatttcagtgttgctcattgtgttgctttcctctgtttttgcgtcatctgctcccttcagtccgctacgcggacagctcccctcatgtacgaggagcgccagggacgaatcacgggtgaacgcgcagcatgcgctccagtgccaccttggcttcgcgggcggtgtcttcgtccacggtgatgcgattgaccacgttgccggcttcgaggttctccaaagcccaagccaggtaggccgggtggatgcggtacatcgtggagcaggggcagaccacggggtccaagcagaacacggtcttgtccgggtactgcgcggccagacggttcaccaggttgatttcggtgcccacagcaatggcggatccggcgggcgcgttggcgatctccttgacgatgtacgcggtggagccagtaccgtcggcggcatcgaccacctgcatcgagcactcggggtgcacgatcaccttgacgcccgggtatgccttgcgggcacgttcgacctgttcgacggtgaaacgctggtgcacggagcagaagcccttccacagaatcatcttggcgcgggcgtaatcggccggatcggcggcgccgccctgtgccttgaacggatcccacagcggcatctcgctcagcggaatgcccatcgcgcgggcggtattgcggcccagatgctggtccgggaagaacagcacgcgcttgccgcgggcgaacgcccattccagcacggcgtgcgcattggaagaggtgcatacgatgccgccgttgcgtccgcagaacgccttcagcgcggcggatgagttcatgtaggtgaccggaatgatctgctgcaagccatcggagtccggctgggtgccgcagatctcgccgagctggtcccagcattcctggacctggtcgatgttggccatatcggccatcgagcagccggcggacaggttgggcagggtcacgctctgttcgggcgtggagaggatgtcggcggtttcggccatgaagtgcacgccgcagaacacgatgtggtcggcgtccgggcgttcggtggcgttcttggccagctggaaggagtcgcccacgaaatcggcgtgcttgatgatctcgtcacgctggtagaagtggcccagaatcaacagtttggagccgagacgctgcttggcgtcggagatgcgctgctgcagttcctcgtcggaggccttgcggtattcgtccggcaacacctgctggcgcggcgcgttggcgggcagacggtcgagcatcgaggcaccgggaccgtagctgggtgtggtggtgtcgaagtgccatgggtcctgggtcagtcctgcatcgcaggtgctttgcgcgcccagcttggcgatgatctcgtcaacggacggcgcagtgaatagtgcggtcatagtggttcctttcctatatacgtctgtgataccggcccgaagcgggtcggcgggaaaaatcagatgcgcgcggatgggatcagcgcgtcgagagcgtcttcacgctcgccttgtctggacagttccacgatgtcgtcaccatcggattcgtggggcgtaccgttctcgacaggtcgtttggggatgtagcggtagacggtggccggtcgttggcggccttcgcgcatcttctccccggtgtcttcaaggtcgcccgaggcaagcattttgcggcggaagttcgccaagtcgaggggttcgccgccaatcgcctcatagacgccgtgcagttggcgcagggtgaacgtggggccgagcagtcgggtggccacgtcggagtattcgattttggagcgcaggcggagcagcgcgtagtcgatgatctggcgatggtcgaacgccagctcgggcagttcgtcttcggggaaccatcgtacgttgtcaccgtcctcgaagcccgcggcctcggtctggccgacgagcgcccagtacacgacggataccatgggcaatccgccatgggaccgggtcgggcctccaaaggtgtacagctgttcgaggtatcgcgggtgcaggtctgtggtcgattcgagggccgcgtaggcagactgttccaacgaccggtcggagcgcaggtcaccgccgggcaacgcccagcagcccaggaacggctgacggacgcgcttgaccaggggcaaccagagacgggaatgggccgagttcgcggcgttgccggaatcggcggcactgttgccggtatcgtcttccgggccgagtgccagaatcaccactgacacgccgacctgtggcggtgcgctgcggcgctcggacacattgccgaatcccatgccatgcctctttccataccggttgttctccctgcattgagagcatagcactacttatagtcacaatgaccataaatcacatatcggatggtctagcgcacgaatattggtcaggcagcgggccccaatcgctacgaaatcacgtccgtatcttccgatttcgactgtgtcatttcggcgacggacgggaggaatggcgctagggagggtagttcgtcgagactcttcagacccatttggtcgaggaagaattcggaggtgaccaagagggccgcgcgggattcggggtccacgccgtcttccttgataaggccgcgtaccgtgagcgagcgaatcactccatcggagttgacaccgcggatcgcggccacttgggctcgggtgacgggttggcgataggccacgatggcaagcgcctccagtgcggcctgactgagtctcgcagtctggccgtcggtgacgaatgatgagacgaccggctcgaacgcggcgcgactggcgaactgccagccacgagcggtgcggcgcagttcgaagccgcgcgggcggatgtcacgggattcatcgccctcatagtcatcgtgcagggctcgcaatgcctcttcgactgtgttgcgatccaatgccaaaatacgggccagctcggtggcggtctgcggctggtcggcgaccatcagaatcgcttccagacaggcgggcagcccgccgggaaaatcgtctaccgcgaaatccacgtattcggggtgagtctcctccactcccctcaccgcggcctttgcggattcagccgtcgattcggcatccgccatgtgttcggttgtattcgttgcgtcaatctgttcagtcaccaatcgccgtccttacgcaaaatcaccttcggaaatgttcacgtcgctcatcgtttcggctacgccgggtacccacctcaggtgcagttcggcaaacggaccatcttgctgatactgcagcacaccttgtttgaagaacacgagcacggccatgaaccgagccaccacctcaatacgagaagtgcagtcccgggtcaattcgctgaacgatatcgactggtcgcccttggattccaatgccgcgatcagccggtcgcgcaccaccagcgattgggcccgcagatcgaccaacggcacgtgcagctgatggatcggcacttcggaggcgggcgcgttggcgatgacctgggcggtcagtcgggcgagttcgagcggagtcagcgtccataccagctcaggcagcatggcggcaacgccctcgtccatggccgccgggtgcgggaatcggccggagttggcggcgatacgcgcccggaagtcacctgcggcctgcttgtaggcgcggtattggaggagtcgggcgaacagcaaatcgcgttcgcgcagcacttcgaggctctgctcgtcgtgctggctgtcttcgccgccgggcagaatcgccacgcttttggcctcgaccagaatagaggcgatatcgagaaaggcgctggcctcatccatgttttttgtgaaatcgagcccgcgcacgtatgtcaggaattcctcggtgatcgaggagagggaaacttcggtcagctcgagtctgttgttggcgatcatgccaagcaaggcatcaaacggaccggaatagacttcgaggttgacccggaagccggaagtggcggattcctccgtgctgatttcggcttccgcggagctcccctcagcctcgctacgcgagccagcttccctcagagaggggagccgagaaagggaagtctcattcatcgtttatcgaaacaatcgttacgccacgatgccgcgagcaatgagctcacgtgccacctcacggtattcctttgatgtcttgtgctcaggggcatagaccaccacgggcgcggcggcaaccgtggaatcgggcagtttgatggagcgggagatgaacgtgtggaacaccttttcgctgaacgcctcgtaaacgcgctggcagacctcttcgcagtgcagtgtcttggtgtacatggtgatgagcacgccatccacttccaatgcgggattgatgcgggactgcactttttcgatggactgcataagcagggccacaccgcgcaaggcgaagaattcggcggccacgggaatgatcacgccatcagctgcggcaagcgcgttcacggtgagcaggccgagcgatggctggcagtcgacgatgatgagatcgtattcagacttgagcttgcgcagcacgctgttcaggatctgctctcggcccacttcggtgaccagctggacctcggcggcggacaaatcgatgttcgccggaatcacatcgatgttctcgaatgcggtgtgctgcaccacatcatgtgggtccacggaaatatcgaacagtgcggtgtaaatcgtgttctccacggtattcgcgttgacgcccagtcccacagtggcggcaccctgcggatcgaaatcgacgataagcacgcggcggccatactgggccaacgcaccggcaatattgatggagctggtggtcttacctacgccacccttctggttgcacatggcaatgacacgcgccggaccgtgctgttgcagcggttcgggtgcggggaaggtttcgtattcacgtccaagcaaatcggtaggcatactgtctaccttatcaacatccgggttcgctgggggtgcaacgacatacgttcctgtcataggcagcgttccttgacggaatgcgctgtctttatcgcgggtatctcgccagtcgtccatcgttgccctcgccccctttgtcgggaatacctgctcgcccatcctaatgtactcgccgggctcgcctcggaacaccgttttgccgctggtattccagtgttccgaggtttatggatctcgtctcgtactatgtcgatgcgcttactcggtgcgcagtgcggtggccgggtcttgcttggctgccttacgcgagggaatcaggccgccgatcagcgtgagcaccacgcttaggatcaccagcaccacgccaccggtcaccggcagggcggcattgacgtccgcattgccgatgaagtggtgtagcacggcgttgatcggaatattgagcagcacggtcaagcccacgcccaacaggccggagcataggccgatgatgccggtctccgcattgaacacctgggatacgttgtgcttcgaggcacccattgcgcgtaggatgccgatttccttggtgcgctccagcaccgaaatgtaggtgatgatgccgatcatgatcgaggagacgatcagcgagacggacacgaacgcgataagcacgtaggaaatcacgttgacgatggtggtcaccgaactcatcatgagcccaacgtaatccgtgtaggtgatcttgtctttcttcgagacggtgttgttgtagtcggtgatcgcgtcggcgatgtggtccttgtcttcgaagctgtcggcgtagatgttgatcgagctgggcgcgtcacgactcaccacaccgaatgcggcgaggttgtcgtcgtaggtgccggtcgacacgtactggtcgtagatcgcgacaagcacgtcgttcgaagccgtggcgatatacgcgtcgaaactgtcggcgagctgctgttcgctcatcgcggccatggcggcggcctgatcgccggcacccgccgcgccagcgacacctgcagcaccagcaccagcggcgtccgatgcgcccgtgccggactgctgcccggcgctcatcatcgacttggccatgttcgccttctgcgtcacgcccagcgaagccacgtaggtgcgcgcgtcggccaccttggtggcatcgtccgagggcgagaacgtcatgccgttgagcacgttcgtgttcgggttggccttctgatcggtaacgatggcgctggaggccgcacggtcgatcaaatcattggtcagagcgcgcgcgtaccccacaccagcggccaacggcgtggccgaagcatccttcttcgccttgacgacgcccaccaccttgagtttggtggccgtttcgaggcgctgttcgatttcgtccttgtcgttgccgatgaaacggtagtggccgtcatcgcccttgacgtactggtcggatgccggaatcatgtacagcgtctgatcgagggccttagcatagtcgatcttgtcttgtggagtgctgaccttgtcgccggcgttgagcttggacatcatctcgtggtaatcggaggcgggcagcaggccgagctcgtacagcgtggtcagcggcacgctgttgttgtcgtcaagcaccagcaccacttcatccttggacttcggccatgaaccgttgaccacctggtagttgtcggtgataaccttgcctacgagcttgctgtcgtccgctcccggcatgatctcgttgaacgagtcgggcgcggcgttctcatcggttttgccggtcagcatcgacatctgctgcgaggtgatcgacgaggtgccggacatgccggacgagcttgtggacgccatctgcgaggctatcgaggcagagtcgctggatccgatcgtcacgccgtccgcattgaccagcgtgccgtcggggtcgtggtcgaacacggagaatttcacgtcatatgtgtactggatgccggtggaacccacatactggtgaatctcgctcttggaattatccaggtatttcttgaagcgggtcaggttgttttcggtaatcgaactggtcaggctggacgcctgcttgacgctgcggtcgtccgggtagatgccgtcggttttgtgcgtcttgccgccgtatccgtcatcgccgcccatctgtccgcccatcatgctgctcaggtcgaaggtctgggagtcgacggtgatcgggtaggcggtcatcgtgtcacgctggatgtcactgatgtatgtgttcacgccagtcgacaccgatagaatcagcgcgatgccgatgatgccgatcgagccggcgaacgaggtcagcagggtgcgcgccttcttggttttcagattgttgaagctcaacgccagcgacgtggcgaacgacatcgacgcgcggcccatcgtcttgtacacggccggctgttcggccgtctcgtccacgacgaacgggtcggagtcggagcggatcacgccgtcgcgcaggttgacgatgcgcgtggcatattgttccgcaagttcggggttgtgggtgaccatgaccacgaggcggtccttggccacgtccttgagcaggttcatgatctgcacggacgtgtccgaatcgagcgcgccggtcggctcgtcggccaggacgatgtccgggtcgttgaccagtgcgcgggcgatcgccacgcgctgcatctggccgccggacagctggtttggcttcttgttgatgtgttcgccgagtccgaccttctccagcgccttgcgcgcacgttcgcgacggtcggccttgccgatgccggaaatcgtcagcgcgagttcgacattcgacagaatcgtctggtgagggatcagattgtagctctggaacacgaagccgatggtgtggttgcggtacgaatcccaatcgcgatccttgtattggcgcgtcgagatgccgttgatcaccaaatcgccgtcgtcataccggtcgaggccgccgatgatgttgagcaaggtggtcttgccggaacccgagggacccagaatcgcgacgaattcgctgtcgcgtaggttcaggctgactttgtcaagcgcctgctgaacgaaatcaccggttttatagcgcttcgagatcgatttgatctgcagcatgaatacctcttcctggctgacggttcgctgttatgtactgtattgtcacgccttgaatttccggccgactttggtgctcccccgccgcgattccgctatgggcggacgcgtcgcaaaatggtgtgtctcaccgcgctctgggatgtgaggtcagatacgtttcgatcagggtttcagggcttacgtgcgtgtagatctgcgtggtggtcacgctggcgtgcccgagcagttcctgcacggtgcgcacgtccgcgccgccttggatcaggtgcgtggcaaaggaatggcgcaaggtgtgcggatggagtggtttggtgatgccggcccgctccccggttgctttgacgatttcccataccgattgccgcgagatgcgcttgccgcgtttgttgagaaacagtgcgcgcctctcgggaatcttggcgctggagcgctgttccaactcgccacgccccgcattgaggtatgcggtgatggcccggcatgcgtaactgcccaatggcacaagccgctgcttggagcccttgcccatgagtcgcgcgatgtgctcgtccaggtcgatgtcgtccagattcgcaccggtggcttccgagacgcggcagccggtggcgtacatgaattcgagcagggccttgtcccgtaataccaccggatcggttgagccgccgactgccgccgcgtcgagcagacgggttacctcgtccacggtgagtacgtcgggcagggtgctggcgcctttgggcgccttgactgcggccgaaacatccgccgtcaccgcgtgctgaccgagcgcgaaacggtggaattcgtggatcgaggccagtcttcgggctttggagcgggcggactcccccgcctggtcaagggcggcgatgtagtcttcgacgtcttgtttggttatggcgtccggttcgtggatgccgcgggtttcgagccaatcaatgtatttggcgatgtcggattcgtaggcggtgacggtggccgtggcgagccctcgctccacgccgatgtggacgaggaactgctcggtgagtctggtgaatccgttggtcatagtgcccatggtacaaagaaaccccgctcggaagcggggtttctagtgtgaagtcacgacttcaagcaatcaggcctcaaccggagcgttgacgtcctcaggcagggcggccttggcggcgtccacgatggtcttgaaggtgtccgggtcggagacggcgatctcagccagagcgcgacgatccagctcgatgccggcgagacgcaggccctggatgaagcggttgtaggtgatgccctcagcgcggacggcagcattgatgcgctggatccacagcttgcggaagtcgcccttgcgagccttgcggtcacggaagttgtagttaaaggagtgcagcagctgttccttggccttgcggtacaggcgggagcgctggccacggtagccggaagccctctcgagaacaacgcgacgcttcttgtgggcgttcactgcgcgcttgacacgtgccataatctattcctcagctttctaaagtcttgttatttccgggtaagccctatgctcacttctgcagaagctggtgcagcttcttggcctggccgccgcgcagcacatcgtcggcggacagttcacggcgcttgcgagcggacttgtgctcgaggttgtggcgcatggcggaaccgacatgcttcaccttgccggtgccggtgatcttggcgcgcttggaagcggcggaattagttttcatcttcggcattgctgccctccttgctggtttgcttcttgtcggaagtcttctgagaaatcgcggactgcgcgtcggccgcggcctgagcctgagactcctgcttggccgcgagacgagccgcctggcgagcctgacgctcggcgcgggactcggcgccacgacgacgctgctcggactgggtgtgcaccttcttgcccttcggcgcaagggtcatgatgatgttgcggccctcctgcttcggcttggactcgacggtgccgtattcctcgacatcgtcggccagacgctgcagcagttccacgccaccaatcgggcgggagatctcacgaccgcgcaacatgatggtgaccttgaccttgtcgcctccgttaaggaagcgggtcacatggcccttcttcacgtcgaaatcgtggtcgtcaatcttcaggcggaaacgaatctccttgatttccgcggtgctctggttgcggcgagcttcacgagccttgatcttctcgttgtacttgaacttgccgtaatcaatgagcttggcgaccggaggcttcgcgttcggggccacctcgacgagatcgaggtttgcctccttggccaggttcagcgcgacggaagtcgcgatgacgcccacctgctcgcccttcgggccgatcaggcgtacctgcgggacgcgaatctcgtcgttaatacgtggttcgtcgctgatgatgactccaatcctctacttcaattccgtggcgagggcctttgctggagtcctgttcaatgctttgggttcatggcaagccaaagcccgcgccaatatgcgctcagcttctgcagacgcatatcagttctttgcgtcattcctgattacgcgttgtatatcgcaatcgctaggctgtttgccttgaacccgaggccttgaaaggcttccaggtggggttgccccgctttcttgatttctcaagccaaatagaaagtctaccatacgcccggacattcgcggtccgtgtgtcgaacctactgcacggcgcgcagcagaccgccgaagccttcgtctttgagaatctgccgatatgggccggcctcatcggcgatgatttgatcgatggcatgcatgccgagtacttcgaccggcgccttgtcgtcggtgagaatagtcgacgctgagtccggttcgttcaccttccggaatcgagaggcgacctcttccatataccattcgagatcttcgctgccggtgcgctcgtaggtggtctcacgcaggttgagcgccttggaggcctgctgcatggagttctcttcggagccggaacccggcttcttggcgaacagttcacggttcgtggtgttcggcacgtcggccgtcagtgtgttcccattgccgaacacgctggcgatggtatcgctcaacgcctcgttgatcgaaccttggccgtccgagatcatgttcatgttcaccaccatcacgccgccggggttcaggtgctctctgaccatggtgaagaactcggtggagctcatctggaagggaatggtgatgtcctgatacgcatcgaccatgatcacgtcgtacttgtcatgcgaggcggcgagccaggctcggccgtcatacgtggtcacggggatgtcggcgggctcatcgaagtattcgccggccagatcggtgatcttctggtcaatctccacgccggtgatgttcattttcggataatactgcttcagctggcgggcgtaggtgccggtgcccatgccgaggatcagcgcggaattggcattgtcggcgagcgccggcgcagccagggccgtgtcgtagtacatacctgtcagtcctttgtctttcatcgtgacggactgcacgccgaacagcacgttggtggacaggatcgtgcggtcggagaggttcttgacctgcaggtagttgtagatggactcgccctcataggccaggttggtttcccagaacgcgaagccggtcaggggcgagacgcaggacgtggccacgaagatcacggcgctgaccacgcaggcgatgcgcttggccttgatcgagatgaagtagatcagcggacatgccggagaagaattcggtgatgtagaggaatatctttgatttgagaatcggccgttcgcttgcctcggtgatctgtgccatcgctccgctcccctgcctgtgcgcctatcgactactgttctgatgcgtagcctatcagcattttcccggccgatgggtggataccggctacagtaggcatcatgactcaggtatgcgtgatttttggtgcgggcgaatactatgcgggcacgcccgtggtgccggccggcgcgtatgtgattgcggccgatggcgggctcgaccatacgcgccagttgggtatcgtgcccgatgtggtggtgggcgacttcgattcgctggagggccggccgccccgcaccgatgtgcgcaccatcgcgctgcccgcgctgaaggacgatccggacatgctctccgcgctgaaggtcggttggtcggcgggttgccgcgaattccatgtctatggcggtttgggcggccgcattgaccatacgatttccggcattcaactgatggcattattggcccggcatggggcaagcgggtatctgtatggtgatgggctcatcgtcacggccatcaccgatggtaggctttcgttccccgcgcatccggtgcccgaggacggccgcatggtgtctgcgttctcccactccgatgtttcgcttggcgtgaacgagccggggctgaaatatgagcttaaagacggcacgctgaccaatacggtggtgcagggggtaagcaacgagttccgcgacggcgtggacgcggccatcagcgtggagcacggcacactgatcgtcaccttccccatcgaggtggcgttgcctcaggtgagtcgattccacgaatttggcggcgatatcggcgagctggacaccgcagtgtccaagctgctggttcgctgacttgcatgccgcgcgcttgctcatgatgattcgagacattcctccaaaggagaggaaaaatcacatgtcggttgcgggcaatccgaattgtgagcgctcacagaaaatacggcatttttgcccaaaacgcacgctgaaacgttgccatgtgtacagagtcggcattacagtagcaactgttggtaaacaatggcccggtgtgccaaagcgcgccaaggccaccctacaagggagaattacatgacagttaagattggtatcaacggcttcggtcgcattggtcgtctcgccttccgtcgcatcttcgagctgcaggctcgcggcggccaggctggtgacattgaagttgccgccatcaacgatctgaccaccccggctaccctggcttacctgctgaagtacgacagcacccacggcaccttccgtcatgacgatggcactccggttgacgtcaaggccaccgaagactccatcatcgtcgacggcaaggaatacaaggtctacgccgagaaggacgccaacaacattccgtgggtcaagaacgacggtgttgagtacgtgctcgagtgcaccggcttctacacctccgccgagaagtcccaggctcacatcaacgctggcgccaagaaggtcctgatctccgccccggccaaggatgacaccaccccgaccgttgtgttcggcgtgaaccacgacatcctcaaggcttccgacgtgatcgtctccgccggttcctgcaccaccaactccatggccgccatggtcaagctgctggacgagaagttcggcatcaaggccggcttcatgaccaccatccacgcctacaccggcacccagatgctgctcgatggcccgcgtggcaccaagaccggccgcaacctgcgcgccgccgccatcaacaccatcgcccactccaccggcgctgccaaggccatcggcaaggtcgttccgtccgtgaacggcaagctgcagggccacgcccagcgcgtccaggttccggacggctccgtcaccgagctgaccaccgttctgaacaccgagaccaccgccgacgagatcaacgccgccttcaaggctgccttctccgacaccgattactacggctacaacgatgagggcatcgtctcctccgacatcctcggcgacacccacggtggcgtgttcgacccgacccagaccgacgtcaacaccattgatggcgtgaccctggctcgcaccgtgtccttctacgacaacgagtacggcttcacctccaacatgatccgtaccctgctgtacttcgctgagatctccgagtgaaccattgcggtctaggccgctacggttcgtttgagaactaagctgtgagacccccgccttgtgcgggggtttcttcgtagtagaacggtaatcatggcaaagaaaagcaagcatgataagggcgcgggttccactccggcgacagtccaactggagaaggcgggcgtggaattccacgtatacgaatacgagcactccaacgaccatatggatgacggctacggcgtggaggcggccaccaagctcggcttcgacgagcatcaggtgttcaagacgttgatggcggacaccggtgccgaacgcgtggtgggcgtggtaccggtgagcggtcatatggatttgaaagccttggctgcagccgtaggtgccaagaaggcctctatggccgatcccaaggtggcgatgcgtgaatccggttatgtggttggcggcatctcgccgttaggccagaagacacgtcataagactgtgttggatgaaagcgccctgcaattcgaccagattctggtctccggcggcaagcgaggcctgtctgtgggcgtgaatccacaggacctgctcaaggtcttgaacgccgttgccgcaccaatcggcacgtggtgaccgttcttggctcccctcacggaggggagccaagaatgactacttcttcctgcgcaactccgccggcagcacaaagtgcatgttttctttgatggtttcgacggacttcataccggtgaagcccaagttttgcagagcgtcaatcacaccggacaccagttcgtccggtacggaggcacccgaggagatacctacggattccagaccctcgaaccatgccgggtcaagctcgctggcatcatccacgcgatacgctttgccgcgctcccccaagccctcctgcgccacctccatcagtcgcacggaattcgaggagttggccgatccgacaatcaccacgcaatcggactgctgggccaccagtttgaccgcagcctgacgattcgacgtggcatagcagatatccgaactcggcggctcttgaatccaagggaatttggccttcagcgcggcaatggtatcggcggtctcgtccacgctcaacgtggtctgcgagagcagcaccagcttggtgtcgggcgcaaaatccagcgaatcgacatccgattcatgctcgatcaagtgcacgtgttcggggctctcccccactacaccgaccgcttcatcgtgacctttatgcccgatatagacgatttcatacccctcgcgcacgaaacgcagcacctcacggtgcaccttacccaccagagggcaggtggcatccaccacatgcatgccacgacgttcggcttccgccttcactaccggagatacgccatgggcggaaaacaccaccggaatacccgcttgggcagcagcatccggaatctccgccaattcctggacgaacaccgcgccttgcccggccaagtcctcgaccacatgcttgttgtgcacgatctgccggcgcacatataccgggggcagcccatcctcgcgcgtccgctttccggaagcctccgcggctttgagaatggtctgtacggtaagaatcgcacggtccacacccgcgcagaagcctcgcggatcagcgagcacaacgcttttggtcatcggaacctcctgaacgtcaatagtgttttccagtgtaaggcagggattacaggaatctgccgtcacaacttttccgcgtctcccacaaatcaccggtttccaaggaatccacgtgcttctcgcatgatggtgtgagactcgtcactccacgtattgctaccgtgtttatacgaattgtttattatatgccgcatatcgccaatccccgcctcgatagaggagacgcgctagactggggccagcgatagcaggagctaccggcccaccaacctcactacgggagtgattccatgacgagtaaaacaccacgcaccggaaatcagtattcgattcactatggcgattattccgccgtcatctgcgaactcggcgccaagattcgccgattcgattatcaaggcaaggaaattttctgcccgttcggcgtcaacgacctgacccccacctgtaacggttatgtgctggccccgtggccaaaccgcatcgaaaacggcgaatacgatttcaatggcaagcattactgcgcgccggttaacgaatatcatcccgcaccgcgcaacaatgcgaaccacggatacgcctaccactacatgtggaagcttgaatcgttgaccgatagcgccgtgacgctttcgctgcgcttccccaacttggacggatacccgttcgatgtgaccgtgaccgtcacctacgaactcggcgacaacggcatgaccgcgaccgtcaatgcccgcaatgatggcgacgaaccggcaccgtgggctctcggcctgcatccgtggctggccaacggcaagcagggcgcaactgccgccgaacgcgatgccgactccgccgcctgccacctgcagattaaggccgccagtcatgtgacggtgaacgaggcgctgattcccaccggcaccgaaccggttaccggtatctacgacctgaacgatggcccgacgctcgaaggccgcgcctttgatgatgcctgggttgacgtggagcgtgccgccgatggtacgaccaccaccacattcacccgcccggacggtatcgaagtgaaaatcattggcgatgagacgattaatgcttggcagtgctacaccgccactggcgcaccgttcgccgagcatccgtatggcatcgccgtcgagccgatgaccgccccggccaatgccttccgcactggtgaccacttggtgacgctcgcccccaacggcgactacaccactgtggtccgctacgaagtagtccagaagtagttctgttacgctggctcccctccagaggggagccaattttttatccttatgtgccgccgcgtcttgggacttatgcgatacgattgtgagcgataacaatttgttccacaaaggagtgtgcactatggctttgaagcctcgcactggtaaccaatatgtcatctcgtccggcgaatggagtgccgtcgtcaccgaactgggtgccagcctgcgcgagctgaagtggcgcggcgaagacctcatcgtccccttcgacccgaacaaggtcattccctgctgcaacggctgggtgctggcaccgtacccgaaccgagtgaccaatggtcagtattctttcgatggcgaagactaccagatgccgatcgacgagttcgaccgccaatcctccctgcacggctatgcctaccgctacatgtgggagctcgttgatttgcaggaatcacacgtgacgctctcctggcgctcccccgacatcgccggctacccgtttgatatcaccatcaccgccacttatgcacttgacgagaacggtctcacggaaaccttcaccgtgcacaacaacgacagcgtgaaggcaccgtgggcatttggcatccacccgtggctggccaacggcaagcacgccaccggtcaggccattaccgccgacaacgagtcctgccgtcttgagctgcactgcgacacccacgtgaccgtagacgaacacttgctgcccaccggtgaagagccggtttccggcatcttcgacctgcgcgataaccccacgctggagggacgtggcttcgacgatgcctggaccgatatcaccaaccgcggtgaagacggcagcacttccgccgtgttcacccgccccgacggcatcaaggtcacgctgactggagacaagaccatcaactcctggcaggtgtgcaccggcaacgaaatcggcgagaaggctcgtcaggccggcgtggccgtcgaaccgatgaccgcctacgccgacgccttccgcaccggcaaggatctggttgtgctcgagccggatgatgactacaccaccgtggtcaccttccacgccgaacaaatctgaaaaaccgaataaccaagcctgacgatcatcgccacatggacacccgtgttgcatcacgtcgtgcttatgtggcataattccgaaggcttatttttttactgcagcaaaggagtccatcatgggcatgcgcggacgtaagcgcaaggatcgtcgtaagaaggccgccaaccacggcaagcgtcctaacgcctgattcttcgcgtttcttatggaacgctcaaggcccgtctgatgatacatcagacgggccttgttgtatatgtcgttacttatcttcgccgcagcagtgatcaagcgtggccttgagccgggctatcagacattcgggtgccacatccgggcgcaagtaggcacgcaacgcggcaatcaacgcctgttcacgctcgtcgcagcaggtacgggggtcaaaacagtcgccctccgtaacgatatgcacgtccgcctggaccgacgcagaggccgagccggtatccactgaacgatgatgcaccgccgtgatatgcacttcggtctggctgaccatgccatcggcccccgtacgggttatggagatatggcgagtacgctctaccggctgatcgttcatcagatctcctttcccgaaagcttgcttgactgttgtggcgtgcgggcgccagtcgcatgactatgtctcactgcggcttgcgtgtcgccattgctaccaacagtttgttcactacttccattatggccggaatcggcgattcgaccaacgttttcgcccaacttcgcggatggtgaaccagccgacgaaccagtcacgtacccgcgctctttcgcatacgaggcgagctcacgcttgagttgcgtgcgggcgcgattcaggcggctcatcaccgtgccgattttcacgccctgctcatcggccacctgctggtaggacttgccgtcgatggcggcgtcgatgaacacctgccggcgttccggcgagagtttggcgagcgcggccatgatttcctcgggcgcgaaggcgtccaaatattcctcttcagcggacttgagcccgtccgacgtatgttcggcggcatcgtaaatgtcccagtcgtcgtattcaccggtggagtcgttggcacgctgcgggcgccgcttggccttggcatactggttgaagtaggcattgcgctcgatggtggtcatccacgcctcgaagttggagcccggctggaatgagtcgaaggccttgaacccgcgttcgaaggtgtcctggaccagatcctgcgcgtcatcgggattgttggtcagcctcatcgcctgccggtacagtgcattgacggcgggcatggcgagctgctcgaatctggcgcgcttggctgccatggactcgcccgatccggctgactgcccggattgcgtagttgcttcgcttgtcgtcacgtttcaccattctaatcaaatcatgtgcccatatcgtggtcgatgacgtgtgagccacaacacgctgcaccccacctgtagaatggcgtatcggctagataatagggagtaacaattatggctttgactttggcttcggccgctgacctgctcaaggaacaccatctgctgcgtgaaatcatccaaggggatgtctggaccgacgacccggcccgtatcgcttcggcggatgagccgttcgccggcatcacctacgacacccgcaaggtcacgccgggcaccctgctgtgctgcaagggccgattcaaggccgagtatctgaacggcatcgatgaagccggcctggccgcatacgtggccgaaaccgagtactcagccgcaaccgccgcccccggcctgatcgtcaacgacgcacgtaaggcgatgagcctgctgtccgccgcgttctacggatatccgcagaacgagctcacggtcatcggcgtcaccggcaccaagggcaagacgaccacctcgtacttcacgcaggcgcttatcaacgccgtctccggcggcaaggccgcattgttctcctcggtcgataattgccttgacggccacacctacgtcgagtccgatctgaccacgcccgaatcgatggacgccttccgcatgatgcgcgaggcggccgataacggcatggagtatctggtgatggaggtctcctcccaggcgtacaaggtggaccgcgtctatggcctgactttcgatgtggccgcgttcctgaacatctcccccgaccacatcagcccgatcgaacaccccacgttcgaggattacctgtattgcaagcgccagatcatcgtcaacgcgaagtcgctggtactcggcgcggacagtctgcacgccgatctgttgcgggaggacgcggaggcagccggcatcggcgtgaccaccttcgccctgcatgacgcggataatgccggcaccagtgcggacgtcgtcgcctggcccgccgacccggcacacgcctccttccacatcgccgacggagatcaggcccttggcgactaccatctgtccatcgatggcgacttcaactacctcaatgcggcggcagccatcgccatcgcccatgcggttggcgtatcgctcgatgacgccgacgcactgcacgccatcgaatccgtacgtatcgccggccgtatggaacagttccgcgacccgcagtcaaacacgctcgccatcgtcgattatgcgcacaactacgcatccgtcaccgcgctgcttgacttcgtctacgagcgttggggcgaggaaaacccgcgtatcacgctggtgaccggatcggccggcaacaaggcctacgatcgtcgtaaggaaatcgtcgaggctgccgagaaccgtatcgcgaacttcattttcaccgccgaagatacggacaccgagccgatcatcgacatctgcatggaaatgcaaggctacatcacgaacaaggatgtggtctccacggtgatttccgaccgtctgacggccatcaccaacgccatttacgatgcccgtgcgcacgccgaccgattcaacatcctgctgatcatcggcaagggcaacgagcgttggatcaaggaccatcgcaagcatgtgccgttcgacggcgacgatcacgtcgtcgaacgcatgtttggcttgtgacgggattccggccaatcaaatcctgatcggatcccgattagcccacatcagatcacgcgcaatacgaccaaaccagaaacacgacatacggatacaaacgaaaaaggatagctgaatcgtaatgatcacgttggagaaagttgacggagccacactggaagccgaagccgagaaggccggcatcacgttgcctatcgaacagaccaaggtttggtctggttttcaggcggatatcgacggacgcacaccatggggcaattatctgatcaagcgtgatggtgaattggtcgccgtgatctcctttatcgattttgagacgcacggttatcattatctgcgctcgatgcatgggccggcgtgggtcgccaagcccaccgaggctgaggagcgcgaggtcgtcgacgccatcgtggacaccgtcaagaaggccgacaagagcatcgcgttcctgcgtatcgacacctggttcgccgatggtacggagaaggtgctgtccacagtgccgtacgaccagaccgtggtcatcgacatcaccggtggcgatgatgagattctggctcggatgaagcgtcgtggacgccgtgacgtgcgcaagtctctacgtgaatgcccggccgaggttgccgatgagacggataaggccctgaccgatttctccgaatattacgatgtgatggtcgaaaccggccagcgcgatggattcacgcctgctccgatgagcgactactccgatatgatcggcgcgttgggtgccgatcattgccgtgtgttcgccgcacgtattgaagaccgtgtggtggcatggtcgattgtcaccgtgaacggcacgcatgcggtgcgctactatgccggcatgcgcaacgaggttatgcgtctgcatgtgaccgacaagctgctgtattccgaatgctgcatcctgggctcgcagggtattacggaatacgatctgatgggcatcggctccgatttcgcgccgtcgctcaaggggcttaacgagttcaagtgcaagttcaccgaggaaatcaccccggtggcccccgcccgcgacgtacccatcaagaaggtcttctacaagacgctgcagactgtgcagggcgtgcgcaaggcattacgctaataccaccccgctcccgctggtgggagctgtcgagcgaagcgaaactgagggtggtctttcgagatggaccaccctctgtcacctgtggcgccagttcctaccagcaggaaccattcatttatcgttcgagtttttggctcaccacggctgttacgccgtcggctcgcatggttacgccgtagagcgcgtcggcaatcgacatggtgcgttgctggtgagtaataatgatgagctgcgcatgggcgcgtagctcattgaacgcattaatcaaacgggtcaggttcacgtcgtccaacgcggcctcgacctcgtccatcacatagaacgggctggggcgggcggtgaaaatcgcgaacagcaacgccagcgcggtcagtgaacgttcgccgccggacaggaggctcagctgtttgacacgcttgccggccgggctggcctcgaccagtacgccggtggtgagcatgtcttccgggttttccaggcgcagtcgcccggtgccgcctgggaacagcgtggcgaacatctgctcgaatgcctcggcggtatcgtcgaacgcggatttgaatacctggaccatcgtggaatcgagatccttgatgagctgcatcaaatcgtcacgtgatttgaccacatcgttgcgctgatcattgagatacttgttccgctcctcaagcgcttcgaattcctcggtggccaaagggttgatcttgccgagtgcggccagatcgcggcgagccttatcgagacgcttcttctgctcctgacggttatacggcacggtcttaaagcggtcggaatcgccgttggtgccggtctctcccccggtttctccctcttcggtctcagcctcagcttccgtctcatccaacggcacagggttgccctcatcatccagcacgggcaccggctgttcggggccgtaatcactaaccaattcctccaaagtgagaccgagttcgtcggacactttttgcatgagctgcccggattcggcggccaaccgttcgcggtttacatccaaggcatgttcgcgcccggtcagatcggtgaccttgggctcgatctggttgcgctgcgcgcgcagggccttgagttcctcgtcatggctggaggcggcggcctgcagctcgtctcgtttggcggccacgtcatgcagcgtatgctctaccatggcggccactgctcgcgcgtcatcggccacgccttgcaggtgtgcggcctgctcgcgtctgcgatcgttcaacgcctcgatgcgggcgcggcgttcggcggtttctttggcgttgtcccgcagcagcccggcctgtcggctcagtgactcccctttgcggcttgcttcggtccacgcgatttttgcggcgacctcatgctcgcgagtcaggttcagttcgcgctccagcgtgcgttcgcgttcatcgagttcgtcgaaatcggcatgttccgctgtggattgctgggccgatgccaaagcgcgattgaggtcgtcaagcttgagctgatgctcgttgcaattctcttgggtctcggtgattttcctatccagctgctcgagctgacgggtgaacgatgcgacgcgatctgtggcggatttcagagatttctccgcctgctgggctttgagccgggcttcggtgcgtttggcggattcctggtcgacgagtcgagccgcttcatcgcgcttggttttggcctcggccacttgctcagccattccgccgtcttgggcggtcaactgtttgacctgtgccaatgctttgtctcggcgggcggccagagacaggtccgattgagagattgaagagccgccgaccgccgccacgccgtgtgtgaaggtctcgccgttcttggtgacggcccgcatggcttcgccgaatgccacaatctgttgggcttcgtcggcggtgccggccgcggctacatcagccagcaggagacgcacggtgcgcacgaccgcttcggcctgtgccgggttctcggcatccgggttcgcggtgacgagtgctgccagcgcgttgcccgattgcggggcggcccccgcgttctcggcgctactctcctccgactccgtgcccggctctgtggcgggatcgccggcaatgctcgcggtcagcaccacggctttgccgagcttatcttcccgagcgcgttcgagggcgtgcaacatgttgcctgccgcgggtaccacgatggcgctggcatactggtcgagcgcgtgggccacggcttcttcccagccttcggccacatggatgaagtcggtgagtcggccaagcgaggccacgtccgtatcgcgctccaacgatccggaggcattgcggctgtctagcgtgtcggcaagcgcatcggccttggatttgagcgagatgatcttggactgtatctcgcgctgcttatcggcgcgttcattcagtcgttcgcggcattcggcgagcgttgcacgtgcggcgtccaatgcggcaccgtcatcgtcggcaatggagtccgcttcgctgcgcaatgcgtccagctgttgctgggcatcgtcgcgctgggaagtcagcgagtcgcgttgggaggcgtaatccttggcgcggctggtcgccagttgtacggcggattcctcgcgggcgatgagttcgcgcagtcgggcgatttgcgcatcgcgttcctgtgcggttttgcgcagttccgtcaaggtctggcggactgaggcaagctttttctcgtcgtcggcgcgttcctcggtggccttgtcgagtgcgatgcgcgcatcggccacggccttggtttgtgccgctgcctgagactccagttcctcggctcgtttgacaagcatgccgggatcctcaccgaagttggtgacgatctggccggcgagtgaccggctgcgctcttcggccaactgggcgagcgcgttcagtcgttcacgggtctgcgagaattcatgccagtattggttggccttggcgatggccggactggattcggagctcaacgcctcgacctgttcgatgcgtactttgacttgggcgagttcacgttgggcgacggccagctggttacgcacagcgccaagctcttgacgtaccgtgtcgcgacggctcatcgagcgttgagcgtcttcggcgtacaggcgggcttgggcgtcgcgtacggatatctgaatcgcgtcggcgcgccgggagatacgtgcctggcgtccgagggggccgagttggcggtgaatctcccccagcaaatcgtcgagtcggctcaggttcgtttcggtattggccagcttgcgcaacgcgcgttccttgcgcttgcggtgcttcaggatgccggcggcctcttcgatgaacgcacggtggccggacgggtcggccttcagaatcgcatccaatcgtccctggcctacaatcacatgcatctgctggccaagaccggtatcggagaggagttcctgaatgtcgagcaggcggcattgcgagccgttgatcgcgtattcggagcctccgttgcggaagatggtgcgggagatggtgacttccgtgtaatcgatatcgagcgtgtgatcggaattatcgatggtcaggctcacctgtgcacggcctaatggcgggcgggaggacgtgcctgcgaaaatcacgtcctccatcgaagtgccgcgcaggtttttggcgccctgctcacccattacccagatcagggcgtcgacgatgttcgacttgcccgaaccgttggggccgaccaccgccgtgatgccgggctcgaagcgcagcgtggtgacggaggcgaaggatttgaatccgcggagggtgagttccttgagatacatggcgtgagactgttttccgtatgccgggtgtccgggtatccgatatgccttggatgcgggttaccgggcgtcggcggaatcgtcggtgtcggcgctggctgtgtcagtgctgtcggtgtcggcactggccgtgccggtgccggcgttaccggcgtcactggcctgttccttaccgaggccgaggacgtcgaacacgtcgaagtcgtccgggcttaccgaatcctcgaggttgtcggcggcctcatcctcggccttgtctgccggctgatccgaatcgtccgggtcaaccgccggctgatgaacggccatagcctgcctcatcgtggggctggcgtgttcctcaagcatcaggcgtgcgtcgccggcggtgacgaagctgccgcagataagcacgccgtggccgtagcccacgcccagctcgtcctcggcatcgaccatattgacggcggtctgaatcgcgtcaggcaggttcgcttccttgatcacacggtcacggccgaacacgtccacggcaatcttctcaagctcgtcggccggcatcacgcgctcgcgccacgagttctcggtgaccaccacggagctcaggatcggctccagaacacccagatattcctcgacctgcttgtcgcgcatcatggcgaccacaccgaccagctgcttgaagtcgtagctttcctcgatggccttgcgcagggcttcggcggcattcacgttgtgtccgccatccagaatgatggtcggtgaggtgcggatctgttcgatgcgtccgggaatcttgaccgagctcaacgcctcggccaccaagtcgccgtccagcgggccgttgaccggaatcaccacttcggaggcggcgagcgcggcaagcgcgttgtgggcctgatgctcgccgaacttggcgatcggcacgccctcgtaagtgccgttgggcgtggtcagggtggcgacttggccgccgactgcggccatacggtcggacgcggtcatttcgtagccgtcgcgcacgagcatggcgtggttgcgttcggcggcttcggcgagaatcggcatgacggcttcctcatgcggctgcgggccgatgatggcggtgcagttcggcttgatgatgccggccttctcggtggcgatctgttcgacggtgtcgcccagccactgcatgtggtccatgtccaccgggccgatgatggccgcatccgcgttgagcacgttggtggcgtcccacaggcctcccatgccgacctcgacgatggccacgtccacgggcgtgtcggcgaacttccagatggccatggcggtgagcacctcgaagaagctcatcttcggcttgccttgctcctccatcttggcgtccaccagggccacgagatccttggtctggtcccagatgtcgatgaaatcgtcatcggacagctgctggccgtcgatggcgatacgctcgttgatcttctccagatgcggcgacgtgtacaggccggtgcgcataccgtaggcgcggcagatggcctcggccatgcgtgcggtggagcctttgccgttggtgccggtgatatgaatcacgcggaacgactgctccgggtggcccaggatgtcgagcatcaggttcatccggtcgagatccagattggtggtgttatgctccggcgggcggctcatgatgtccagttcgacgtcccgcatgctctcattgttccgattcggatgctcgaatgacatatcctcttctaacctctgctcgtgttgctgttgcgccgttcggagtgcgtatgccacttacgtgttcgcgccattctcgtcatgtctacgcatgcccgcatatattccgcttccgcatgcgcaggaagctccccttgcacaggtttgccccgcatggttcgggattcttgccttcacgcgtggagccgcactccctcaattccctctatcctagccgccggggtggtttatcgtgcgcgcacagtgaaaccgtctaatatgtcgccgccgcgcgggcagtctctacctgcagccacgcacagtgaagccgtctcatatagttgcaatgcggctcttgccgtcggcatctcattcttaatcggctgcaatccaaaacttgtatgtccggcgacgctgatgctattcagcgtcggtacagtgccagcttctggcggtacaccgacgctatgatgctcttgcgagtcggtggctggccaaaacctggattaatcccgactccatcgcctctcagtgtcgtctcctcgccaaggcatgccattctgccgtcgttgagaaatttcaacgtcgtcaatcgaccatgtcttgccccggaaacgactctcacaaacgtcctctacatcatcttttgaactcgcagaggctcattcactgttatgactgctctcaccgtcggcagccgtccaagccctggatctatgccgccaataaattgcagcaaatcgtcggccccgatacaaccattggactcacgccgacgctagattccacactcagacagaagccagccaatatctgaaccagcaccgacggcgtacaaagcataagcaccgttaaccgtcaattcgccgccctctaccagctacatccgccttcgccgatgatatcttgttcgaatccccaaagcacgttgttcgaatgacattactgatggtggataagttttgtgtgttatccactattccgaattagcggcctaataccttgaaattatcgggagtatctcgctccaagacagccaagctccgaggctagaaccacaatggctgaaattcatacttacgctgcttcgttccggctacgctcgacgtcatgaagacacacaaagcagtggcctcgctcatatcagccgcgcagaatgagctgagatgcgtctattcaagaaatgaagcggaacagaccgctctacgccgccgtgcccagagtggcgagttgttgaaagtgtatgacggcattcccagtctttatgcaaataccgcatactgggatggtttgacgccgccggagcgaacgttgcatatggcccgcgctcttgcgcaagagcatcctcagtgggtttttggcggcttggtggcagtaagtgcctatggattcgaacatcaatggcatttgcatgatgactgcataaccatcgtgacttccgatcatggatctcgtcaatgccatcagcgcttacgacatgtctatatgcccgatatgaacaatccgaagacacatcacgaggcctccggcctatccctgatatcaccggctagaaccttggtcgaggccgccatagaccttgattttcggtttgcgttgccgatctttgactcggcccttgccaagggaataaccaaggaagagatagccgccgactgcgttcaatggagaatcgattatgcccgagtattccgcctgctgcgctatgcaaacgaaaggagcgagaatggtggagaatccctcgcgcgaggcaccatcatcgaagatcgcttcctcacgccgcgtattcaggtaacggtgaccgacccacagacgaataccgagtaccgcgttgatttcgtatggaagctcgatgacgggcgcgtgatagtggccgaatacgacggcacacaaaaatacgtggacccagccatgaccgataaccgcagcattcaggaggtggtggccaaggaacgcgcacgcgacgagggactgaaacgagccggtgccaccgaaatcgtccatttcacatacgccgacgtcatcgaacgtactccgctgcgggtaaaactgatcaaagccggggtgcctcaggtggagacctccgcatagcagtgagtcccgcgacgcgataaaccttcatcgcatgggttcacatggattcagcccacagaatatgtcaatatcaatcggcaagctccagcccaagcccatgcccctctccttccctaccgagaacaataaacgggcccgcattccagcccgccgcactcgccatatgggcatgtccggaagaccgtccaaattccgtacttggttttaccgtcagccgtcaatcgtggcacatcgcataaagccgactaatatgaggtgggaatcgatgattcgacaacaactacatacaggagagtggcaatgggtgaagtgatcaccgccaaggacaaggaatatgaggccgaagagcgcgctacggcaccgggcgcgaaccagtcgatgagcgaccgcgtgaacaaccgctcgctgcgcccgcagtcggccgcattcaaggagttcatgaagtccggctgggccgacgatgatccggagattaatcctctcgaatcctccaagttcacgccagcccgccttgaggcgctgggcaaggccttcccgggcgagcgtctggtcattccggccggccagccgaaggtgcgcaacaatgattgcgattacatgttccgcccggacaccacgttcgcctactacaccggtctgggttccgattacgaggccggcgccgtgctggtcctgaacccggtcgaccccgactcccccgaagccgccgccggcaagacgcacactccggaactgttcgtggcgccgcgcgccgacaactccaccgaggacttcttcatgtccgcccactacggcgaatactgggttggcccgcgtgccggtctcaaggagatgcaggcgatgaccggcatcgaaacccacgacatcgcccagctggccgacgccctgtccaaggacgtgggtgccgaagccggcgccgtacgcgtgcgcgtggtcagcgaaaccgacccgcaaatcacttcgatggttgaatccatccgcgaggccaacggtttcgccgatccggacaagaactccgcatccgacgacaagctgcacgagttcgccgccgaggcacgcatggtcaaggacggctacgaaatcaacgaaatgcgcaaggccgtggacgccaccaagcatggcttcgaccgtctgctctccgcactgccggccgcgctcgacaagccgcgctccgagcgtatcctcgaaggcgcgttcaacgccgtgtcccgtgaactgggcaacgccgtcggttacgactccatcgtggcctccggcccccacgccccgattctgcactggatgcgcaacaccggtgtggtgaagaccggcgacatgctgctggtggatgccggcgttgaggtcgattccctgtacacggccgacatcacccgcaccttcccgaccaacggcaagttcaccgacttccagaagcgtctgtaccaggccgtgctcgactcgcagcaggccggtttcgaagccgccaagccgggtgccacctactccgacatccaccacgcctgcatgcgtgtgatcgccgagcgtctgcacgattggggtctgctgccggtgagcgtcgaggagtcgctgtccccgcaaggccagcagcaccgccgttggctcgcctgcggcgtggcccaccacctgggtcttgatgtgcatgattgcgcgcaggcccgtttcgagtcctatcagagcgcgccgattcgcccgggcatgatcttcacgatcgagcccggcctgtacttccgcgaggatgatctgctgattccgccggaataccgcggcatcggcatccgcatcgaggacgacgtgctcatgaccgagaacggccccgaatggatttccgccggcatcccgaagcagatcgacgacgtcgaagcctggatggccgagcaggctgcccaagcgaagtaacctaagctccctctgatgagggagcttcttttctactaaggaggcaatgtgtccactccggaatttgtgttggaattgcgtaagaagatcggccatgatctgttgtggctcaatggcgtgaccggttgtgtactgaacgaacatggtcaactgctgttgggccgtcgttcggacacgggcgaatgggcgatggtctacggcatcaacgagccgggcgaacagccggcggacacggtggtgcgcgaaatcaaggaggagacgggcatcgatgccatcgtcaccgatttggtggccgtcatctcgtcaaacaaggtactgacctacgccaatggcgacaacaccatgtacatggatcattcgttcctgtgcgccctgaagcccggcggcaatgccgagccgttcgtaggcgacgaggaaagcctgagcgtcggctggttcgatctggatgacctgcccactcccctggcggccagcacgagcgagcggctggagctgttccatacttacatcgagaacaaaaaacacggcgacgcccacgccctgttccagttcgatgggcagcagtactagcggatataaagttagctccctctgacgagggagctccaatgctatgcgattacgcctcttgggctaggagctcgtggaggtgggcgcggtgttgctgctgttcgcgcgggtcgggcacgggcagggaggccagcagcttcttggtgtacgggttctccgggtgctgcataatctggtcggcatcgccgtgctccacgatctggcccttatgcatcaccatgatgcggtcggcaagcatatcgaccaccgccaaatcatgggtgatgaacaggcacgcgaagccgatttccgcctgcagtcgcttgaacagctccaacaccttggcctgcaccgacacgtccaatgcagaagtcggctcatcggcgatcagcagcgacggcttcaacgccaaaccacgcgccaaagacgccctctggcgctggccgccggacagctcatgcgggaaacggttcatgtaggcgcgcggcagctggaccatctccagcaggtcgcccacatagttcttggcatcggccacggaaccgtacttgtggtgcacgagcagcggctcggccacattctccgcgatggtcatcagcgggttgaacgaggagcccggatcctggaacacgaaaccaatgtccgcgcgcttgggcttgaagtcacgctccttgacgccgttcatctcgatgccgagcacgttcagggagccgccggacaccttctgcaggccggcgatggcacggccggtggtggacttgccggaaccggactcgcccaccaggcccagcacttcggagcggtggatggtgaagttcgcgccgtccacggccttgaagtcgggctgcatgagatggcccgggtacgtgatggtcaggttcttggcctcgacggcgatcggctgttcgcgccaatcggccttgcgctcgatcggtttgccctcgcggtcgcgcacgaccagcttctgaccgatgcgcggcacggcacccagcagtcgcttggtgtagtcgtccttcggatggtagaagatctgctccacgtcgccctgctcgaccacgtggccgcggtacatgacgaccacctggtcggcgatgtccgcgatcacgcccatgttgtgggtgatgatgagcacggaggcgtcgaactcgtcacgggcgaggcgcagcaggtcgagaatttcggcttgcacggtcacgtcgagggcagtggtgggctcgtcggccagaatcaggccggggttcagcaccaacgccatggcgatgacgatgcgctgcttctggccgccggagaactggtgcgggtagtagtccacgcgggtttcggcatccgggatgccgaccttcttcaggatgttgatggccttggcgcgcagttccttcttgtccttcatgccgtgggcgcgcaggccctcttcaatctgccagccgatggtgtacaccgggttcagcaccgaattgggctcctggaacaccatcgcggcctcggaaccacgcacttcgcgcagctgttcgccgctcagggagagcacgtccagcgaatcggagccatcgcgcttggacaggtagacggcaccggaggtggtggccgtctccggcagcagcttgatgatggagcgcgcggtcacggacttgccggaaccggattcgccgaccacgccgaccacggtcttgcgcggaatggtgaagttcacgtcctcaacggccttgatggagccggcgtcggtcatgaaggagacggacaggtccttgatatcggcgagattcttgttgttttcgctcatctctcactccttgccttccggcttgccctcgccggtccattcggaggcgacgatggtcgggtcatggtcggtgacggtggccggcgggtcgacgttcgcgtcgagttcggcaatcacctcgttgcgtgcggtcggcttctcgtttgggtcgacggacgtgtcttcgatcgatccgaccacttcgccggcggacttgcgggcgcgcagacgcgggtcggccagatcgttgagcgattcgcccacgagcgtgatgccgagcacgatgagcacgatggcgatgcccgggaacacggcagtccaccagatgccggcggtcacgtcggaaaccgagcggttcaggtcgtagccccattcggcggcggcggtcggctcgatgccgaagccgaggaagcccaggccggcgagggtcaggatggcttcggacgagttcagcgtcaggatcaccggcaacgtgcgggtggagttcttgaacaggtgcttggtcatgatgcgccaggtggaggcgccgaccacgcgcgcggactcgacatacgcggattccttgatgcggatcacttcggcgcgaattgtgcggaaatactgcgggatgtacaccacggtgatggagatgccggaagccagaatgccgctccacaggccggactggccgtgggagatcatgatggccatcagaatggcgagcagcagcgaggggaaggagtagacggcgtcggcgatcatcaccagaatgcggtccacccagccaccgtagtagccggagaccaggccgagcagcacgccggcgaagatggagagcagcacggccacgacgatggcgatgacggcggtgcgtgcgccccacaccacacgggagaacacgtcgaatccggcggcggtggtgccccagatgtgttcggcggagggtgcggcctgcgccgggaaggacgtgccgtcggcggccttgatctgggcgtggccgtagggggcgatcagtggggcgaagagggccacgagcaggaagaacgcggtgatcgcgaggccggtgatcagcatgcccttctgccagccgaccgccacgcgcagttccttgatgattggaatcttggtccagaacggcgtcttggtgctgacgttgagcttggtgaggcggtcgtcaccgggaacggtgatcttgtcttgggatgtggtggtcatctcagtacctcactctcgggtcgataagcgcggcgatgacgtcgacgaggaagttgacgacggccacgatgatggcgataaggatcacgatgccctgcacggccacgaagtcacgggccttcaggtactgggacagcatgaagcccaggcccttccattcgaaggtggtttcggtcaggaccgcaccggcgagcatcagggcgatctgcatgcccatgacggtgatgatcgggatcagggccggtcgccaggcgtgcttgttgagcaggcgcttttcggagacgccgcgcgagcgggcagcctcgacgtagccggaattgtaggtggagatgacgttggtgcgtaccagacggatgaacacgccggcggtcaggaggcctagggcgacggccggcagcacggcgtggcgcagcacgtcgacgagcacgttcatgtcgccgagctggatggcgtcgatgatgtagaagccagtcggcgataccagacgggtgaactgcatttcggagttcaggtcggagcggccggaggctggaaggatgttgagccagacagcgaagatgagcttcagcacgaggccgaggaagaacaccggggtggcgtagcacaggatggcgaaggtgcggatgccggcgtcggcggcacggtcgcgtttgcgggcggcgagtcggcctaggccgatgccgacaatcagcgccacaatcagggcgaggaaggccagttcgaatgtggcggcgccgtagtgcgtaagaatgctgatcaccggctggttatcggtcagcgtcgtgccgaggtcgccgtgcagcaggccgccaagatagtcgacgtattgcacaatcagcgggcggtcatagccggccgcgtggatgcgctgctggagttcggcgggtgtcaggcggccgcccaaggcggcggaaatcgggtcgccggtggcgcgcatcacgaagaacacgatggtgaccagaatgaaaacggtgggaataatgagaaggaacctcgtcagcacgaagcggaagaaactacctgacagtcggttcttcttcgtcttggctttcgccggagtggtgctggaggtcgctatggcgctgtctgacacgcgatgctccttggtgttggtaatcggtatataaagcaataaaggctcccctctccgaggggagctggcggcgaagccgactgaggggagtcatacgagttgggctcccctcagtctgccgtcggcagacagctccccccccctcaaagaggggagctcatgctggatcagcccttggtgacggaggcatagcggaagcggaaggaagcgtcgagggtgacacccttcacggaggtgccggtgacggcgacctgggcaccctgcagcagcgggatggtggagaggtcttcggtctcgagcttctgaatctgcttgaggatgtctccacgagcagactcgtccttctcgccggcctgcttgacgatcaggtcgttgacttccttgttggagtagccgttgttcacgaagttaccatcgcggaagaacggggacaggtagttgtccgggtcggagtagtccgggaaccatccaagctggtagaccgggtacacaccgtcggaatcgtcggtaaccacacgatccttgttgtactgggtccattcggtagactgcatgtcgaccttgaacaggccgcctgcctcaagctgggacttcagggcagcgtattcgtcggcggagacggagccgtagtggtcgctgttgtactggagcttgaggtcgaccggggtggtgacgccggcgtcggcgaggaccttcttggccttctcggtgctcggcttgccgttgccgtcgccgtaggcggacttcagcgtgtcatcgtgaccggccaggccgtccgggatgaaggagtacatcggggtgtaggtgcccttgtagaccttggtggagagctcttcgcggtcgatgaggttggcgacggcctggcgcacggccttggccttgttggcgtcggcgtcgggctgggattcgccgtagggctgaatcttgaagttgaaggcgatgaagcgctcctcaccgcccgggcccttgacgaccttgaccttggagtccttggagaggtcctcgatgtcggtcgggctcagggagcggttggccacgtcgatctggccctgctggacggccatcttcaggttggaggcgtcggcgaagtacttgacctgcacggcggagttcttggccggggtcaggcccttgtaggagtcgttcttggcgtaggcggcggactcgttgatcttgaaggcggtcagcgtgtacgggccggcaaaggccttcttggagacgatggtgtcggcgtcggtgagcttgtcggcgtcgaaggtatcctcatcgacgatcgggccggcggggctggacatgacctgcttcagagtcacgtcaaaaggcacggaatccttgaacaccacggtggtgtcgtccttggcggtcacggattcgacgttggcgagcagggagctcgggccgttcgggtcgttgatcttcttgatgcgatcgtaggagaacttgacgtcggaagcggtcaggtcgttgccgttggcaaacttcaggccgtccttgagcttgacggtgaattcggtgccgtcatcgttccaggtaccgtcatcggcggcgatgtccgggctcagttcggaggtgttgtagtcctgggcgtacaggaacgggaacacctggatctgcacggcgtatgaaccgttgtcgtaggagccggcggggtccaggctggtgatcttatcggtggtgccgatggtgatggcgttgccggaatcggcacctgcggtggtgtcatccttcacaccgccgcaggcggtcagggatgcgatggcggccacggagacggcggcggccagaatcttcttggaattcaacaggaatcctctctcataacttgtttccacgtcatcactgcgggcgtggattaccgcctgactatggtgcggatgtgttacctctgcgtttccatagtcatcgacttatgtttcgcttgtggcgaccaaggccggttttatgcggtatcgagcagtattacggattcttgtattacgacgtgaataacggtcacatggtgagacaaatatactatcatctcaccatgtgaccatgttcgtagacgaatgccttccattcgtcaaccggtcggcctactgctacttgagcttgcggcccgcgcaccacacctgttcgaccgtccagtcggccgggtccgcaaggttgaaatcggcggcgaagccgggggcgatgaggccgatcggcgccccggtgaccgggttcggccggtcgaagccgaacgccttggccggcgtcagagttgccgcctcgaccgcgtccaccgggctgaagcccagttcgcacaccgcacggcgcacggcgacctccagcagcagagtggagccggcgatggcgccgttggagaccaggcgcgcatgcccgccgaccacgttcacgtccagcgcgcccaacttgtaggcgccgtccgggcagtcggtggcggccatcgcgtcggtcacgaaggccgtgcggtgaggcgcgaaccggaaggagaggctcaccatcggatcctgcacgtggaatccgtcgttgatgagctcgatggtgacgcgcgggtcctccaccgcggccggaatcggaccgggttcgcggtgatgcaggccgttcatcgcgttgaacatgtgggtcatgatgcccgcgcccgcgtcgaagccggctttggcggtctcgtagtcggcgtcgcagtggcccacggccggcaccacgccggcagcggcgaactggcggatggcggagatgccgtggggcagttcgggggcgatggtgatctggcggatgcagccaagcttgccggaggcggggtcggcaccggaggcctcaagcatcttatcgacgatgtcaggcaccggatccttgagacattccgggtcatgtgcgcccttgcgggccagggccaggaacgggccttccagatggcagcctaggatgtcggggcggccggactccattgtggcgcggacggtgcggatgttgcggcagatcacgtccacggggttggtgatcagcgagagcacctggcgcgtggtgccatgcacggcgtggccggcccgcgccacgtcgatgccgtccggcccgtcatcgaagctcttctcccatgcgccgtgcgcgtggatgtccacgtagccgggggtcagaatacggccttcggcgtcgatgaccgcgttgcgatcggccgggtcgagccccaccgtgcggcagcagtgctcgaaggccccctcccccgtgccggccgccacgatgacgccggcggcatcggagacgacccaatatccgcgccgttcgccgcgcgcatccaccttgcgcgcgttacgaatcgccaccggagccggcttgccctccagtgccgcggtcacgcgcgagactatctcgttcctatcagacatgttgttctccttaccgctcatgcgctcccgctggcgggagccagcacacgataactcagatgccctgccaggccggcttgtgggtgtaggcgtaacggtagtagtccttgtggcgcaggcgggacgcggcctcctcatccacgataatcgtggcgtgcgggtgcatctgcagcgcggaagccgggcagaacgctgacacgccgccttccaccgtctcctcgatggcttcggccttgccggcaccgaacgccagcagcacgaggtgacgggccttcatgatcgtgccaataccctgcgtgatgcagtgggtgggcacttggttgatgtcgttgtcgaagaagcgcgcgttgtcgatgcgggtctgttcggccaaggtcttgacgcgagtgccggaggccagcgaggaaccgggctcgttgaagccgacgtggccgtcggtgccgatgccgaggatctgcacgtcgatgccgccagcggcttcgatggcacgatcataggccgggccggccagcgcgatcttgtcgccgtcttcaagcggagtgccgttaagtacgtcgccgggcacatggaccttggccgggtccaggccgagcggttcgaccacagtgcgatggatggtcgcatgataggactcgggatgggtcagcggcagtccgatgtattcatcaagcgcgaaaccacgcacgcccgaaacgtcaatggcctcgtccttgacgatcttggcgagcgcctgataggcggccagcgggctggagccagtggccaggcccagcacggcgtccggctttgctttgatcaggtccgccacgcaacggccgtagatctcgccggcctcggcttcgttcttgacaatgatgatttccggcatcggtttcctccagttccgtgcggcccgcccgatgcgagtcgctgtaccgccgcccgtcttgcggataatggcaacatccttgtcacgtccgggtgccgcgcggcgttccaaccaccgttcggcgtagcgccgattggtgattcgctatttgttaatgatactaacaattttggaccttatgaacactcacggtgtttcctgacgcttcacacaggtacactggaatttattagtgaagtttcataacagtttcaacgacgaaattgcgcttcaccgtctaagctgtgtatggaacaacaatcgccgtccactcgctcaccatcaggcaggaggaaacatgtcatatctcggtctcaacacaacgaccgacgaccatgcggccaaggcttcccccgccgatgtgcgccgcaagaaccgccaacttatcttcaggttgttgttccccaccaaccagtattcgcgcgccgagctcggccgacgcaccggattgagccgcgtggccgtttccgatgtggtcggtcggatgctggaggaaggattgctgcgcgagaccggtcaggcacccagcggcggcaaaggcaaacgaggcacactgctaagcatcgatatcgatcgactgcgcatcatcagcatcgacctgacgcaggagcacctgctgcacggcgcagtcaccaatctgctcggccagccgctgcgtcacgccgaagtcaccctgaacaccggctcattcgtttccgtggatgtgatcatcgagctcattgagaagatgctgggcatgtccgatggcgaggtcatcggcatcggagtcgcctcccccggcgtggtagacaacggcgtggtccgctcctccacgatgcgcggctggaacaatctcgacctgtccacgccaatcgccgaacatttcggacttgaagtaaacgtcagcaacgacgccaccgcagccatgctcaccgaacgtttctttggccaaggcgggccgaatatgcttttcgtgcgcatcgaaagaggcatcggttcggcgattctgctctcggacacgccggtaatcggcgaactgcacgcggctggcgagctcggccatatttccatcgatcttgacgggccgctgtgcccttgcggcaagcacggttgcttggagacgatgatttccggaaccgcattgaagaagcaactcagcgcagcagacgtggagcagcatcagggtatccttgctcgggcgggccgctatcttggccaagccctggccatgcctgtgggccttttggatatggcagacgtatgcgtctatggccagccgaacatcatcaacgcgacgttcatcggcgcggcccagcaatatctggatgccgccacatcctcgtccttccacaaacacacggtgattcggcgctgcgaatgcggacctgacatcaccgtacagggcgaggccatcgccgtggtcttccaacacttggccaaataaaagccggtcaccccggcaacgaaacgcgcaagaccaagcgcggcacagcacgacataaagcgatataggactgcgtgggagatggggcctcggagacaaatctgaggcctcatctcccatgccccggcactatgccaggctacgccgccatggcggcaccgatggctccgactggttggccgacaggtgccagacgcagccgggccggcaggtccagcgtttcgaggaatcggcattgcgattcgcgccggcgcagctcagccgtgatcacctcgaccaatggttcgccggttttggccatgccaccgcccaagatgatgagtcgcggatcaacggactgagccaggatttgtatggtgtcgccgatggcgcgcactaccatgtccagcacatcgacggccttggcctcccgctttttcgcgcgacgaatcaggtcgggcatcggcgggtcggcgttgggccacagacgccccacggatgcgcccgagcagactgtttccaagcatccgtattgcccgcaagggcacttgaggcgatgaggttcgactgggatatggccgatttcgccggccgcgccgctatagccatgcatcagcacgccgttttcgacgatgcccgcagccagtccggtgccgaagttcaggaacgcaatggtaccggccatgccgtccgcaccgcccaatacggtggccgcgccgacggcggcggcattgacgtcgttttccacatgggccggcacgcccgaacgctgcgagaccaacggccccatatccagcgagaccacgtcgagattcacgatattgcccacatgcccgctggccgaatccaccgtgcccggggtaccgataccgatggccctcacctcgtcaaaacgctcacccgctgcctgatgtgctacagcgacgatgtcttcgatcacggcatcgttgccatgcctggcgggaatacgggcggaacccaataccgtgcccattgcgtcaaccagcacagcttcgatttttgttccgcccacgtcaacaccgattttgagattgttcatagtgttttcagacatcagtcctcccctgttcttcatcgaacgtttcgcttgatatcagtgtgcatccgactattgacaaccatcttaacaaattaccccaagacgacactcacatgcacgacacaccgaatgacatattgattgcgtcaatcaattaacagcgttaatatcttaatcaagttcagattcaaagacgagcggaacaactcgcagcggtgcagacaaggaggacttaagaccgatggcaacaaacaccacccacgccacttcccaggccagtgtctccgaatccaaccgctcccgcatcgtcaagcacctgtatcacaacggcatcagttcccgcgcgcaaatcgccaaggcactggaactcacccccgcggccatcaccaaaatcaccgcacgccttatcgaggccggcatgattgaagagaccggcgatctggaaggctccaagaaccgccgttccatcggactcaagctcaacaccacgcacttccgcatcatcggcatcaaattcgcccgctcgctggtgcagatcggcgtgttcgacctgtgcggcaacaccctgagctttgaaaacctgcccacggtgtgcgacaacaccatcaacgactccatcgtcaccatccaccagcgcgtcgaacaactgctcgacaacgacccgtccatcgtggccatcggcatggcagtgcccggcccctatctgcgtaacgtgggccgcaccgccgtggtgtccagcatgcagggctggcgcagaatcaacttcatcgacgaattcgccaccgctttccgcgtgccagtgttcatcgaacaggacgcccgcgccggcgccctcgcacattatctcttcgacccgtcggtgcacgccgacgacaacctcgcctattatctggtcggcgaaggcgtgggcctcggcgtcatcgacaacggtcgcctcatcaacggcttcctcggtgccgccaccgaaatcggacacatctccattgacgtcaacggccgcccctgcgattgcggcaacgtcggctgccttgaacgctactgctccacccccgccattcacgatacgctcatcgccgatggcaccgtggttcccggcgcggccgatatgacccacaccgaagccgcccgcgccctgttcgccaaagccggcgacggcgacgaagcggcaatcgccattgtccgcgaagtcgcccgatacgtcggctacggatgcgtcaccatcttcaatggatacaatcccgagcacatcatcatcggcgacatcgtgtccgaagccggcccgatactgctcgatgaggtgcgcgccacggtggccgaacgggccatccccgaaatcaatgcctccacttccatcagcctatccaccttgtccgccgacgcggcggtctccggtgccgcagcagtggcagtgacccaattcctcgaacacccctcggtgttcttcgacgtctcctaaaccaagcgccgacatcacaagattttccatacgaaacacccgataaaggaaacaaaggaaaggaaaccaaccatgactaccccgatcgttctgagcctcggtgaactgctgtgggacatgctgccgagcggcaagcgagccggcggcgcccccgtcaacttcgcctaccacgcgatgaagaacggcaccgaaggctgggccatcagcgcggtcggcgaggatgaactcggcgacgaactgattgccaaggccaacgaggccggtatcaacaccgtcatccagcgcaatgcctggccgacctccaccgtcgaggtcgcactgaagaacggcatcccggagtacaccatcgtcaagggcgtggcttgggaccacatcctgtacacccgccagctcatcgacgtggtctccaaggccgacgccgtctgcttcggcaccctggccctgcgctcccccgaatcgcacgccaccatcacggagctgctcaagcacaccaagccgggcgcgatgaagttcttcgacatcaacctgcgcggcgaccactactccaaggacctcatcgaggaactcctcaaggcggccaccgtcttcaagatcaacgacgaggaactcctgctgctgcgcgacatgttcgacatccgcggcacctccggcgaagacgcctcccgctggttcatcgaggaattcggccttgactacgtgattctgaccgccggctccgcctactccaccatcatctcccgcaagggcgaggtctccacgctggacactccgcacgtcgaggtgaacgacaccgtgggtgcgggtgactccttctccggcaccttcaccgcccgcatcctgctgggcgacacgctggcagaagcccaccgcaaggccgtcaacaccgccgcctacgtctgcacccaggccggtgcctggccgcagtacccggccgagatgcccgactatctggctgaaatcggcaagtaatccaaaaccacctattttcccgatggctttgccgtcctataccggcaaagccatcctgttttaaaaaggagttaccatgtccattcgcgacaccgtcaccggcgtccagcatgtcggcattccgaccacggatctcgaaggcaccatcgcctactacgagcgtctcggcttcgaatgcctcggcatctatcccaacggcgaggaccgctgtaccttcctgcgcctgaacaacctgaccctcgaggtgtggaccatgaaccccacgcctatggaaaacggcgccatcaaccacttcgcgctggattcgacggatatcgaagcgtccttcgccgaagcccagaagctcggcctgaacttcgtggaaggctccatccagcacatcgacaccttctggagcaacggcatccgttacttcaacgtactgggcccgaaccacgaggtcatcgaattctgccaaatcatgtaacaccctgatggaacccggcaacaggactatcactattcactagtcatcatccattgatcgatcgatctgtcatacgtccatttatagagaaaaagggaatacatatcatggacaagaccgcatccaagaacgtggcgtgggtggaaagccctgacggctaccttgatcgcacgccagtattgcaattttcaatgacttcggtgctgttcgccttctaggccatcgccgcaagcctcaatgacattcttatcacccagttcaaggccgtattcgacctgagcgacatgaagaccgcgttcgtgcagtccgcattctatgccggctacttcatcgtggccatccccgcctcgctgttcatcaagaagaccagctacaaaatcggcatcatgaccggcctggcgttcttcgcgctcggctgcttcatcttcttcgtggaccgtatctccgccagctacccgctctcgaaggtccgcgagactcgcgtgctgaccgtctacatgattatcggctgcgtgattcttctcggcaccgccttcatcctgccccgccatcgagctgttggtcgtcggcctgtacttcctgactgaattcaagcgcgacacgtacaccccgccccagctcaaggccatggacgagaagaacgaggcctgattccgccccctttgttcgtcattcgtgtgacttcacgaatcgactgaccgcaaccggtgagattctccgaacaggaaatctcaccggttttttcatatggtgtactcacggccacgctcttcacatcctttcgcgtgtcttcaactaaagcggtttagaataatgctgttcccttgatatgtatatccctcaaacaaagaagttgaatttatgacgaccaccgcgataccgaagtcggtctcggatttcttgcagcgcatcacggacctatgtggcaccgaacacgctgattgggccgagaacttcaacgcctgctttgccgataccctgaccaccacggtcaaacggcatgacgacggcaccacatttctgctcaccggcgatatcccggccatgtggctgcgtgattcgaccgcgcaattacgcccttacctagcccttgccgccaaagacgacgacattgcgaacttgatcgccggtctggttcgccagcagttccgctacattaccatcgacccgtatgcgaacgccttcaacgaggaaccgaacggtgcctcctgggacaaggacgatcagtccgacttctccagcccttggctttgggagcgcaagtacgaggtggattcgctgtgctaccccatccagttggcttggatgctgtatgcgaacaccggcaacaccggtcatttcgatgccgaattcattgccggcgtcaagaagattcttgacgtattcgagaccgagcagcatcatgaacgctccccgtatttcttcatccgcgacacggacatccccaccgaatcgctgagcaataacggcaaggggtcgccggtggcgtacaccggcatgacctggtccggcttccgccccagcgacgacgcctgcacctaccactatctggtgccctcgaacatgttcgccgccgtggtgatgggctatctggaacgcatcttcggcggtgagattctgaatgatgccgatatcgccgcccgtgccggcgagttgcgccgcaccatcaccgaaggcattgaagcccacgccaaaacgacgaaccgcaatggagagacgatctacgcattcgagaccgacggcctgggccacgtcaatatcatggacgacagcaatgtgccctccttgatggcggccccttacttgggatactgcgcaccggacgatccgacatatctggcaacccgacgtacgctgctcagcgacgaaaacccgtactactacgagggcgagtatctcaagggcatcggctcaccgcacaccccgccgcgctatgtgtggcccatcgccctgtctatcgaggcgatgaccagtgacaacaaggacttcaaggcgcatatcctcgaccgtcttgtagccaccgacgccggtacacatctcatgcacgaaggcatcgacgtgaacgatccgaccaagtacacgcgcgaatggttcagctggtcgaatatgatgttctgcgaactggtcatggactatttcgacattcgcgtgaaacactaagacgtgcccgctgaatgctcattgtgcacccaccgcatgttctcgttaaggaaaggaacaatcattatgaccaataacccacgttatacgctcggcaccgaagccaaccgcattttcatggcttccgaaacctacgagctgctgaagttcggcaaaggcttcccagcaccgaacggcggttccggctggctgaacgccgacggcaccctcgacccctcccacggcgtcgaaacgtggatcaccagccgtatggcccatgtgtattcgattggtgccatgctcggatacctgggtgcgggcgagctggccgacgcggcgctcaagggattgaccggcattctgcatgacgacgagcacggcggctggtatccgcaggtgttcgcggacggcacccatgcgccgggcaaggtctgctatgcgcatgccttcgtgattctcgccgcgtcctccgccctgctggccgggcgtccgggtgccaaggaactgcttgatgaggcacttgccacgtatgacaagcatttctggaatgacgaaatcggtttggccgtcgatacctggaacaccgaattcaccgagctcgacccgtatcgcggtctcaacgccaacatgcacaccaccgaggcattcctagccgtggcggatgccacaggagacaacgcctatcgagtacgcgccggacgcatcatcaatcatgtgatcggctgggcgaagcacaacgagtggcgcatccccgaacatttcaagtccgattggtcgctggacctcgaatgcaacgtcgacaagaaggatgatcagttcaagccgtacggcgccacgccgggtcacggcatcgaatgggcccgcctgatcacgcagtgggcgttgagctcctttgccaaccttgacggagcacagccgtacgtcgacgccgccgaacacctgttcgcgcgtgccgtggccgacgcatggaacgccgacggcaccgtgggactcgcctacacgaccgactggaacggcaagcccgtggtcaccgatcgcatgcattggacgctggccgaatcgttgaacacttccgccacgctgtacgcggccaccggcgaggagatgtacgccaactggtatgccacgttcgcccagtatgtcgacgaacatgtcatcgaccacgagagcggctcctggttccaccagctcgacaagaacaaccacgtgatcggcacggtctggccgggcaagtccgacctgtaccacgccttccagtccacgctgattccgttcttggacccggccgtgtccattgcgacggccgtgaagaacgctgaataatcgacagcatctaagcctctatatccttttttcctctttctcaacggcgttggcccccgtggaatacgggggccaacgccgtactggtcgcatgtcattgtctgcaagccgatgcaatgaccgttctacgccatggtatccatgggcttggcggtgctgtcccgaatcaccagtttcggggtgaggattcgccggttgccgctcacctgctctccggcaagcactttgagcagcagtttggccactttggcaccgtattcgctggcatcacgatgcgcggcggtaattgacggatacgccgcctcacaaatgaaactgtcttcaaaactgacaatggcgggcagcccattcggatagacttccgcatggccctcccccgcctccatctgccgagcggaataatcttcggccatggcgtgaagactggccgcggcgaggatctccgtttcatagatgaacgcggtaggcggcttcggtgaatgcagcatctccaacgtgagcatcgcggcctgttccgcaacaaaatcggtgaattcgatgttgatggattccagctttcgccgtttggcaaatgcgcggaacgccgcgacacgcccctgtgaataatccaggttcggatcgccggaaagataggcgattcggcggtgtcccaatgacgacaaatgttcgagcacggttcccatcgtgcgtgaatcatcgatggacagtgacggcacataattgttcgggtcgggtcctccggcaagcactgcgcgcacacccagattcttcaacaattccgggcgtggatcatcggctcgcaaatcgacgaggataacgccatccacgcgcttgcgcgacgcccaatccttgtatacgctcatctcctcgttcaggaatcggcatgggcggtacagcaaaccatagcctttggggctgagcgaggcgtgcacacccgccatgaagtgcagcatgaagctttcatccgtgagcccctgcgtggatcgtgcgggggcaaagcctatggtcatggtcttcgaggatcccagtgcttgtgcggcgtagaccggcgtccagccgagcctggctgcagcctctttgacccgacgtttggtttccgcggaaacgccgggccgatcattgatggcgaaggataccgcggtctgcgagatgcctaattcatctgcgatgtctttcaggctcacacgctgcgtgccgtcagacgatgacgatgcctcgcgagcagatctcatgaacactcctttttacgaccgcattgcgactattgcgatacggttgacggcacccccgcattgggccatatgcatcaaccgtgcgctaactcttatgatatcaataattttagtcaatttttatatctaattttggattattcgcataaccactatactttcaagcattttggagtatagaaaaccattcattttaccactaatttaccacgattgaatgagccttgatatgactataaaataacacccaaaagacatcattacacctaaatggtgtctttttaaaaagcagtcaatcataagactaactgctttgtatgtagggatatgaaattgtaaactagattgtctgttatagatttatagtcataatatattcttcgctgttttcatcaacaacaagaaaacctgctttcttatacatttttactgcataattatttttctgaacagataaggaaatttttgaataaccaaaagatttttccactaacaataattgttgcaataatgaagtcccaatcccttgtcttctatacttttgaaaaacagacatagcaagggacggtgtatcattgtcaatgtgtccgtaatcgttcattattcgtacccaaatagcacctatgacatttccttgaacttccgcaactaaagccctatcatcttttcgctttccaaattcaaaaacatattcttgtaattctggacagttaattattgatttaggtggtggctcaacaccgtctggaatataaattgcttcatacaaaaagtcattgagtaaatcatattctgcttttttaatttcccttatgatataatccataacttgactcctaatctattttatcttttttcataccccgattataccattcacatataagcactacaacaaaattttatgcttcaataatcttgttaaaaagttctaagagtatatcatttcatcactccaatctataattttggtaagaaaaaagcagtcaatcctaagactaactgctttatatgtgatataaggttatcagacaatttaccaacaaagtatatactatcgactcaataacataggcaaaaattctactgaaattttttataaataactaaagcattttagtcactggtctcggcatatgtcttgcgacaaaacaaacgggatttagggggggcacccattgggcaacccctaaatcccgcttatggcacgagtatcaacacccgtattgcgacgaaccactccgtcttgctacgagcgcgaagtaccaccgcacccgcgccaagcagcaccaccatggccgccacaatcgcaatgaccgacgaacccgtggcactcaacgaagcgccattcttgtcattgttcttgttgtcgttctggctgggcttgttcggcttggtatcgccaggcttgttctggtcgccgggcttgttcggcgtcaccgcgaccttggtgaattcgacggtgacgcccttgccgatggcattgccgttcagcacggccttcaccgtgtacttgccgaccttcgtggacacgacgttcagcgaagccacgccggcggcatcggtcttgacggtggtgtttccgccaatggccgagacgccttcgggcagtccaaacgccacctcggcattggccagcggattgccgaacgaatccttgaccgttgcctgcaccgtgcggatggccttgccgtcggccacggccgaaccgtcgaccgcggtcagcgtggacttcttggcatccggctgggtggggtcggcgaccgtgcacttggccagttcgtcggcggtcggaatcttcaccggatcggtcttgttgccgctgtaatcctcgacctgcacccgcagttcatgactggcgggggatggacctggtgtatgaggcaggtgtggtacgaccacggataataccagtgattggcggagtgttctgcgagtaggtgtagctagcacccagctggttctcctgctgctgcttgccattctcgccgatccacttctcggtcatgtacaggtagcgccagtcttgagtctcaggacgggccagcgtcacattatcgccattccagatcaccgagcaagccggatacggctcaatggcggcatcggcaaatgcacctgttgccgtagcggtagtgccacctgcattatcgacgttcaccacatagcgggagctgtcaaccggcgcattggcaatcgtcactttgctcttgtcggcggcgaccttgacggtctgggaatacggcttcgcggcgtaacgccacgaaccggtgtcggatttgacggtcacggttttctcgccggatacctgcggattggtccaagagaccttgacgttgccgtccttgcctggttcgactttcacgtcggagacggccgccgcttcgttcagcggcgcttcggtggcgagcgaacgcgagccgtccgcgcccacggcgtagagcttgagcgtggcgatcttcttacccgcgtactgggacaggtccacgctcgcggtcttccagccgttgcctgccgaaccgtccgtcacgtccaccggcaccacggtctcggggtcgtcggcaaggatgaggccaagctgcaacttggaatcatcgctgttgagcttgttgtaggtcaggtcaatcttggagccggcagcgacatccaggtcggtcttgtacaggcgaatggtgttgtcgttggagagcttgccgctcagcaccagcgaatcgccgccttcgtaaccaccgaccttggtgtacttgaagcgtggtacctcctcgtagtccttaccgtagtcgaagtcggcctgcagcgggtcggagtcggcatcgatccaccactgccatgtcggcagaatatcctgcaggttgatgttgccccactgctggtcgctggtccgttcgccgccatcacgccattcgagaccgtgaccggtgttgaacgacgtagagaacatggaaccgccaaccacggagcattcggcgatctgggaagcgaagcccttccaaccgtcattgctcgtgccgtcgtcgatgtaattgtcggcgatgtcagtggtgcccttctcgccggtggacgagccggtccacagtcggcgttcgcggtcgaacacctggttctggtatttcggatagaccttcttgtcgtcgcccagttcgcgggagacgaagtcggcgccgagcgcggcgaggctcacatacggcttacctgtatcgtcgagattgacgttcatatagcccgcattgctgccgatactgtcgaacttcttctgtccggactcgatgccagcaaacaccgcatatttcggatcgatgccgaaactctcggcgtgagcggccgaatccttaagcatgttgccgctgaaccagtagttcaggaagatggaatcagagatcttgcccttgtccgtatcctgcacatacggcgaattgctgccgttgaacatgtcttggtagcctacgccgccacccgggtatgtggctgagtcgtaccactggatgtaaatgccctgatcgacaatctgcttcatgaagtcctggtaggctggaacatcgtcggcgacatcgccaacttcaaaagcgcggcccacctggccgcctgcgccggcatcgctccggccaccggccagtccggcaccagcatcaagggcgagagaccctccagacggggcaacaaacgcctcaggaacgcgctgtggcagtccttgttcgtcgcgtccgccaaacacccgccgtccatcgcctactacaagcgcaaacgcgaacagggcaagcaccacaacgccgctgtcatctgcctcgcgcgccgacgctgcgacgtaatctacagcatgctcaaaaacggcgtcctctaccaggaaccagccctcgtagcctgaatcgggccacacgggaaaggacgccggacgccaccggcagggcgaagcgcgcccacgacagccaaccggaatcccgacacgtcaactccccaaggagttgacaaaaacataggaacacccccatggcattgtgctggtggcgctggccggtgcggccaacgccgccagcgtggtcatcgacaataccgcggccagaccgctgcacagccatttcctgtgttgagcccgggcagaagtacacccagcgggatcgcctagtgacaatctcatctataatctcctttgacttcttccggcttacgccggagatcaaccgtctgcgtactacttcgtccctaccgatgtgggccatgggatacggcgcttcgcatatcgcgccgtatcccaaatactgtttttcggttcattcgaaccggtgttatccgcggcggcggactgcgaatacgctgataccggcgagcgtcataatcacggcgaccgatagcacgacggtgccatcggaaccggtgcttgccagacgtccggttgcagactgtggcttgttgtgtgatgcgtcaccggaactaggtttgtccgtttcgcctgtgcctggctgttgcggcttgggcttgccgcccgttgcatctgcgattgcggtgttgagcgatgccgtccaagagacaacgtcagctccggtatacagcttgctggtcaggccagtgaccgccgcgtttctggccgtggtcagcgttgtccgcacatcggtatcggttgcgccgtcagctagcaatgcatccgccttggctatggcaccggtaagtgccgtggtgtcgatggaggtcagggaaagttcgagcgtcggatcatatgtgttgctgtatccgtcgttccaatccgcgccgagcaccgccttgttcacctcatacaggttggtggccgctgccacggtttggcgcgtttcggctggaacatccttggtataggacatacggtcaaggaagtggttggcagcctgcttggcgttttccagactcatgccttggctttgtgcgatggctgtcttcgtccaaatcagattcgacggtttgatgtgtgccaaatcatcgtcggaataggtgcgtccgtcgcggtcgagcgcgtagacgaacatgcctccgagattgtggtcgtacgagtatgaggccacatcatagaaatgactgtccaggtatggttcggtcgcgtcgttccaccggttattcatgtcaccctcttcggggaaggtcaggccgggaacgaacttggtcgagtcgataaactgttcgtaggtggcagcggccttggccgtccggttcgaatcggaaccgtactgctggtaggcaacatagtcgaagcaatcagaaacgttcttaaacggagcagtgtagctgccattggtgtcgtaaaggaacatcgtgccttccgggttatccgacttcggcccgatgcgcttggcgagggctgtgatgacctgatcggaaatcgccacctgcgcggcatccgggaaagtttccatatcgatgtcaagaccgtcgaggccaaccgaggtcatgtacgtttcgatgacatgatcggcgtacgcgtcataatccgattcggtcgcgctatcgacgtttttgccctgctgagcaatccacgtcttgaaaccgtcgaccataacaccgctgtaatccaaacctcgtacgagtttgatgcctcgggcatgcagatacggcgcgtaatcgctcttgagcttgtcatagaacggctgggccgccgcttcctggccactgggaacgtagctgaacacattgacgacatcgatgccgtatggaatgtcgtacatggagatccaattgtcatccggtaaatcggtgttcacgcctttcatggtcacgtcacgccatgcgcggtaatacaccatgaaatgcttgttgccgttaccctcctgcgacgccgcaacgggggaatccccctcctgggcgttcgcaaccgttcccatggccagcgaacatccgagcatcagtgctgtggcgactacgcccgccgcgacggcggcgagtctgcgtccgatggacgagcgcccttcactaccttgtgagcaacacatatataatctcctttgttgtttcctctatcgggtgacaacccgcagacttgcaggttgtgaggatggatgccttgcggtttcaggctccatccgggggtgtgatgcggttccagtgcttcgcaccccacattcatacatgccccctaatattcccccggcagcgtcgccgtgaccgtatgcgtcgaatctccatccagcgtgcaggtcacctgaacttgcccgtcaccgacatcccgcagacgatcacacggcacgtggaacgcgatatcgcgacgctctcccgcgttcaagtccatgtataccgaatcgacaagcattgccaaacgtgggatgcggcggccgccgctgacatgcgcgaacagattcacggcacccgcggccccgtgatcgtcagcatgtgccgtcacctgcaccagcacttcacctggatgcgattgcgtatcggcgtgcatctcgctgaacgtcaccgccgccagcgaaccggctccatagccgaagccgcgcaatatcggttccgccgcatccttgtagacatgcgcggcactttggcggtcattgtatcgaacgggaatggctgcgggatatgcgggtaaggtcacaggaaggcggccagacatgtcggctccgtcaaccaatacgtcggctacggcctgcggcccatattggccggcatatccggcccagatcgtcacggcggagcgttccagcacatcggtcagtacatgcgcgcgaccgcacaccgccaccgaaacaattggagcggtggtcaatgccgcgacttcacctagcatgtcatcctgacgccagggcaggcggatgtcagacaagtccacgccttcgccgcaggtggcaccgtattcggttacggccttcgccgcgccattgtcgtcgaattcactgtcatagctgcgttcgctggtgctgccgcatacgaataccacggtcgacgcacgcgcccattgatcggccggcgcatcgctcggcttggcggccaagagaacccggtcctccccgagacgtgccaccaattgccggtagacgcttgactgttcatcggcgggcagaggggcggtgtaatcgcccaggaagcagccgaaatcgtcggcgaacgggccggcgacaatcacagggccggcttgagcatcagctatgacgctgcggatatcgtcgagcgtggcggcagactggccatcattgatcagcgttatcgcctcgcgggccatgcgcttggcctgctcacgcccatccgcagtggcctgcgcgatggcgtcggcgctcggcatggcaattgcggcggtatcggcaccgtcttcgggcaagagaccgaacatggctttgagttccagcacccggcgcaaggccgtgtcgacagcggccactacctgttcgtcatccgcatattcttcgaggcgggtgaatccttcatcccacagggagacgtccacgccggcgagcagtgcggcacgccctgccgcgggaatggagccggccatgtcttcgagccgatccacggccaggccatcggccatcacgatgccgtcgaaaccgagctggtcgcgcagataatccttgagcagccacgggttggcgcagcaaggtacagaatcgatatcgttgtaggctgccataaagcccaaggcaccggcgcgcacaccggcggccaccggcggcagatgaatttcatgaagatcgtgcgggcccagtacggcggactgtccgttgcggccgcccacggcctcgccttgcgccgccagatgcttgagcaccacggccactcccccgtggccgaccttgctgcgatgctcaccctgcatgccggtaacgatggcctcgcacatgcgggcagccatcagcggatcctcgccgaagcattcctcgcaacggccccagcgtgggtcacgggcgatgtccaaaccggataccaatgcgatatgaatgccgctggcggccagttctgcggcaaccgcggcttccgcttcctgcaccccctgcgggtcaaacgtagcgcccaaacccagattggtgggcagcaccgtgccgcccagcgcctgatgcccgtgaggcgcctcttcgctaagtaatacgccgatgccgtgcgcgccacgttccagcacagtttgctgcaccacggcaatcgcctcagtccgctcctcagggcgtatgccgttaccccaatgttgaccagaccatgggtcggctcgcaatagaccgtacagggtgccgagtccaccccatcggtcaatctcctgcttgagctcgtccgaggcaaccagccgtcccgcagcattgcgttccacggacttccaaccgagcagacgctggttcaactggccaactttctgcgtgaagctcatcgaatcaatgagtcggtccactgcggcgcaattgatgctcattgagcgcttccccttctcgtatattgtcttctcgttcttctcgctcttcggcgagtaccgggtcttatgttttgccctgcgcactgcaattgtgcgcactgcaattgaaaatatccggctgtggaacaaggagtagatgattccacaaccggatatcggtttaatcagccgtttcgaacgatgggtccgaaaccgcagtgtagtaacgggcggcataggggtgttcgtcagcgtgcaattccagaatgccacgctgcgcgagcgcctcttgattggccgccacctgcgaggtgatgatggtcgggcgctggcccgccacctgcagcttcatccacaggtcgcacaccgagcctcccgggccgagcgcactgcggttcaccgggtttccggcctcatccacatcaatcaccacggcgacggtcttcggctgagccggcaatgcggaacggtactgtgcggcgagttccccgaacgtacggccgatcggcttcagctggccttgctcgtcgaacaagcccagagagtgctcgaagaacgggaagtcttccatgctggcgggcacatcgtgcgagcaccaccacgtcacaccccacaggttccggcaatccatggcacgttcaacggtcttgcggcagaattccggcgtgtagtcggtttccagcacattctccggcgcaccgacttcctggagccacaccgggcgctcggaatccttgccgaacgccttggccagctcggccaggtacagtgcgtacgacgagcactcctcactggtggcgccgtatccttgcgcgatgccgttgaacacccaggagtgaatcactgtcatatcacccttggtggcggactgcaccggagtgaacgggtgcccatcgatgaaccaggtgccatcgttgacgctgtacagcgcgttgtgcccttcaccggcggcggtcggaagcagcgcgtccagccatgcgtcgatctgccggtccgtggcgctcatcttcgtgggatgcggcctgtcagacagctgattgacctcgttgcccaaggtcagacccttgaacgcgggttccttggacagctcatcggtcatggtcttgaccagttcacgctcggccgcaacggcgtccgcatcggtgaacatgttgcccgcatgccaggtgaccagccatgaaggcaggaagtcgaagctggacagatgcccttggaacacgtccacataggcatccaaaccgtgctcgccggcgatgtgcaccatgcggcgcacatccgccacgcccttcttgttgatccaggtgcgattaggttgcagatacggccagatcgggaagatgcgcacatggtccatacccagttcgctgatctgcttgagatcgttgtcgatgccgtcccagtccgggtcgagccatgcgtggaaccagccatgcgacggcgtgtagttgactccgaatttcattggagtacctcctttttccagtccgctcagcccttgagtccaccctgttccaggccacggaagaagtagcgctggaagcagcagaagaagacgatgatcgggataagcgagacgagcgcaccggcggcgatcagtcgcggatcttggatgaacatgcccttgagtcggttcatgccgagggtcaaggtgtacttgctttcatcggagatcgcgatcaacggccacaggaagtcgttccaggcaccgacgaatgcgaagatgccgacaacggtcatcgtgcctttgacctgcggtacacagatgtggaagaaccgctgccataggttggcaccgtccaccatggccgcctcttcgagttccattggaatggatttgaaggcgttggtcatgagcaggatgttgatggcgccgcacaggccaggcagtgcgactgccagcagtgtgttctgcaggtggatggagcgaatgatcaggaactgggagatcatcacgccttcgatcgggatgaccatggtgcccatgaacatggtgaacaccagtccgcggccacgccacttcaggcgtcccagtgcgtagccggccatcgtggagaagaccacgttgccgaagatggagatcaggcagaccaccagcgtgttgagcatgtagtggaataccgggacctgcttgaacacggaaatgtagttgtccagcgtcggggtcttcggcatcaggtagggaggcacggcgtagacgttgtcgcccttgcccttgaacgacagggacagttcccagacgaacgggccgacgagcagcaggaacatcagaatcagaatcagatactggacgactttgccgacggtgaccttatgcgtgttggtattcatcagtcctcacctcgcttttgtacgatctgctgcacgatgagcatgacgccgacgatgacgagcacgacgatggagatggcgctcgcgtaaccagtgcgggcctggataccggtgccttcgcgcttgataagcatcgacatcgtcatatccatgccgccggggcctgcggagccgttggtcaacacgtagatttcgttgaagactcggaatgcggcgatggtggacagcatcatgatgagcatcatcgtggagcgcacgccgggcattgtcacgtagatgaactggcggacagggccagcgccgtcgagggaggcggcttcgtaaagggattcatcgatgttggcgagggcggtcaggtagatgaccatgtagtagccgaggcccagccagattgtcacgaacatcgagctgaagagcacgccccatcgatcggtgaggaatggaaccggcttggagatgatcttcaatgccttgagcacggagttgaccagaccggcggaatccagcaggttggtccagatcatacccaccacaacggcggacataaccaccggcatgtagaaggcggtgcggaagaagcccatgatgcgggagttgcccttgaccagataggccaggatcaacgggaggatcaccatgaacggcactacgcagatcacgtagagtgtggagttcagcagtgccgtgaggaagtactcgtcatggaacagtttgatgaagttttcgagtccgacgaaggttcccggacggagcagcgtggagttggtgaaggcaagcctgaaagtgttgagtgccgcaaggacgatgaatacaaacacaatcacgaacgctggcagaacaaacaggtagggggcaatgatggtgccgaagctacgattctgcttcttgccgtggttgaggttcatcggttcaggccggccggaggccgtgcgggcctccgacctgtcagcggcgagtgccgcgttgctcactgtgatagcttctcgtttgcgaactcgacagacttgtcaagggcttccttggcggtctgcttgccctgcatggcgagggcgatctgctgctggaagttcttggagccgttgttgtcggtgaactcggacggacgagagccgtagccgtccttgacctggtcgagcgtgatcttcagagccttgccctcaagggtgctttcgtcgatgctcttgtagtagtcgtcatccagaccccccttggcggacgggaacacggaggccttcttgtcgaactcgatctggttcttctcgttggtcacgaatcgggcgaagtcaatggcaacgtcggggtgcttcgagttggcgctgatgccgagcatctcgtaggccacggaagcggacttgccgtcgttactgatacgcgggccgactgcgaggttcttgtagaggtccggagcgttctgcttgaagccgtcagcggagtaggcggagccggccatggagactaggttgccacgctggaagagatcggcggcctggctccaagaggagtcgagggcctccggcgggatgccgcctttcttgtacagctcaacgaagcggctgatctgcttgacgccggcctcatcattgaaggtgtacttgctgtggtcatcgttcatgaaggacttgacgcctgcggtcatcaggtcttcggtgttgtaacccatcgtggtgcccaggtagacatccttgcagttctgcacgatggtgtcgccggcggcgaagtattcatcccatgtggtcggaatcttgttcggatcaaggccgcacttctgcatgagctcggtgttccagtaggtcgggccatcgttgacataccacggcaggccgtaggcacccttctcgatgccattgccctgcatggtcacggacttccatgcgccttcgtagtagtccttttccgcatccggagcctgcttggagacatcgagcagcgcaccggccttggcaagaccatacaggatggagttgccgccgtcgacgatgtccggcagttcgccggccgcagcctggctggacagcttgtcttcgtaaccatcggacggggcgtcaagccacttgacggtgacatccgggtggtccttctcataggccttgatcagcgcctcgaaatacggggtgtacttgtcgttcttgaggttccaggtctggaaggagatctccttcttgccgccgtcatcccccgcagttccgctaccacaggcagccaccgatacgagcatcgcaccggcaccggcgatggcgagaatcttcttcatagaaaacatgatgtttccctttcctttcgattcctttttcatcccgccctactgtggacggagaaacctaatcgttgtgctccagcacagtcacccgtcgcggtgattgacgtggtatcacaacctttattcagttctcatcgctgagactaaaccgctttagtttccggccagttgcgagcctgtaaactaaatcggtttagcaaaaatataacacaatcgaaacatgcacgcaacgaattcatcgtcgcgtgtcgcattgatatttgtccaacgggatcgctctccctcttctcatacaataatgggccgcgcccaaccgtatggcagagccggtctgttccggttccgttacggttgggcgcgacccaaaatatcgagtctaggcccaatatcccttatcggcgaatacgcagcgtggcgagctggaatggcgccaacgaaacgaccgcaccgtcggcaggcattggttcgtcaccggcgagcgcgcgcggcagttcggcatccagctccggctcctccatgagattcacctcccgcacgccggccttggcatcggagagagcggcgtcaaggcgcagtgtggccgtggcattgccgccggcggcctcgtacaggcgcacgatcagatcgctggaaccgtcatcggcgagcttgatccagtccaatacgatgacgccggtggcgtcggcgagcgagaccagcggcgccatatcaggcaactcccctattacggggctgttgagtcgcgccgcttcgtccagcaccgcattcatatcggcgtcagcgaccagagaccacgcgaaggagtgtgcgccttggtcggtgcgtgggtcggggtacagcggtgcggacagcagcgagagccgcaccatggtgccgcggccggtgccatgtgccgcatcggcgtggatggggctgacgtcggagccgtaggtggaggcgttgaccacagcggcggcatagtcggcgtcggcgatacgcacgaagcggtgcgtgcagctttcgaatttggcatcatcgctgcgcgtgttcttgttgatggggcgttcgaccagaccgtattggcattcgtattgcgcgttcaccgcttgcacggcgaccggcatatccactttgaggaactgttcgacggcatgccagtccacatcggcggtgaagtccagtgtggcggagcccggccttaaggcaatgcccgtacgaatttcaacgcccttcgcgcgagtgacagcatgcacgacggccccaccgttggcggtttcgtccacgcttgcaatcgatgcctcgctgagcgcgttggcggtgaggaatgcatcgcgttgaatatcccaagcgtcccagtggaagggttcgtctttgagcatttcgtagcggcccagtcgggtgccggcgggcaccagttcacgattggttcgctgatcgacgattgacgaaacggtgccgtcggcttcaatgcgcacgtgcagtcggccgttgtcgagcacaatcgtatcgccgtcatgggtaacggcgacccgagccatggatgcggttcccgcttcggctcggctcgaagccgggcgtaccacccacgcctcacaggcttggcgggaatatggggcgattacggcgtcggttatggttgcgtcatcgggttccacggctgcgatcgcgcgcccggcttcaagggcgatctcgttcagccgagcgacgtcacgcgcgtattcgacccgcgcctgacggtgtacccatgcgatggccgaaccgggcagaatgtcgtggaactggttcaggagcagcgttttccaaatacggtccagctcttcgcgcggatagacatagtccgggttcttgatgcgggccgcggcgcacaggtattcagcgacgcgcagcatcgactcctcctggcggcagccacgcttcatgtcctgctgggcggtgagggtggcacggtgcagttcaaggtacagttcgcccttgaacaccggggtctctccttgcgcatcgtcgacgatatccttacgcacgcggtcgaacagttggtcgggagtaccgaattcgatcttcggcacgccggcgagatcatggtcgcggcggatgcgcgcggtcatctcacgggtgggaccgccaccgccatcgccgaagccgtacagcagaatcgcgttacgggagaggtccttgtccaggaagttgcgctgcgaatacatcagctcatgcatgctcatccacgagcagtaggtatccgagggcgggaagtgcgtgagaatacgcgtgccatcgatgccctcccacatgaacgagtggtgcgggaacttggtggtgtcgttccacgagatcttctgcgtgaggaaccagtcgaatcctgcacgacgggcgatctgcggccaagagccggtgtagccgaaactgtccggtagccagatgccacgcggcgtgacgccgagatgctccttgaaatatcggcggccgaacgtgatctgccgcaccaatgattcgccggaaggaatcatgttgtcagattccacccacatgccgccgaccgggatgaaccggccttcttcgatgcgccgcttcattcgtgcgaacaggtcgggatgttcctcttccagccatgcgtactgttgggcggaactcatcgcatacgtgaagtccgggtcttcgtccattaaagccagcacgttggatacggtacgggccactttgcggcgggtctcgcgcaccggccatagccatgcggagtcgatatgcgcatggccgatggcaatgtggttgattacgctggatgcagccggttcggcgagcacgccggcgagcgccgcacgggctgccggcacggtttccaagtcgcgttcatcgtagatgttcaaggagcgttgcagcgctttggcgagctgccagtagcgcgggtcgtcgtctttgagttcgcaaatcagggaggatacggtttccaagtccatgtcataggcgaacacgtcttcgttgaagatggtgatatccatgcgactcagtgtgtatgggaagtcacaggtgccggtggcctcttcgccgagttcggtgggtgagaacggggtggggccttcgacgaatgggttggcggcggcttcgatatagacggtgaagtcgccatgttcatcgagttctacagtgctgctgccgcccgcgtagacgagtggaatccagtggttgcgtgggttcgcggatttgatggcggtgccatcggcacgatagacaagtccctcggattggaatccggggccgcggtgatcgagccagccgaggtctaccatgagttcgacttttcggcccttgaccgccgccatgtcgatatggccgttcacctcgaaccatgtggtgccccatgtggtgccccagactccgggaacgcggaaaggttcgaagggaacttggccgttgcgcactttggctagaaattcgctggagggcaccggttcgccgggattgtggaacgaacgcaaggtgcatgcggcgagcgtggtgtggatatgcggtttgacgcgctgctgcatgacgcggtcgcagcgctccaactgctgattgggcagaagaaacatggagagttcagctcctttgctgtgtctggtggtaggggtgggagtgatggtaattggagaaaccgcaatacgacatacttctgccccctcatggcgcgaggaggcagaagcgtcaggcaaaaattcagcgcgtgatgcgcagggtggcgagctggaacgggccgaagtgcagtgtggcgccttcggcgtcctgtgtgccgtcttgcagcgcgaccggcaggtcggcggccagattgtcgccttccaacacgttggtctcatgcaccgaagcgcctgcgagcgccgggcagacgtgcagcgtggcatcggccctgccaccggccgcctcataggcgcgcgcaatcaggtctccggagccatcgtcggccagctttatccagtccaacactacggtgccgtttgctgactcgatcgaggcgagcggcgctaagtcgggcatgtcatgaagcgtcggtgcgttgagtgcgcaagcggcgtcaagcgcacggcccaccgtggcgttggccaccacggaccagtcgaactcatgcgcaccgatatcggtgcgcgggtcggggaaggccggcgcggagagcaatgacagtcggaacatggtgcccgagtcacgaccttcggcggcgttctcggcgatcggcgtggcatcggacccgtacaccgatccgttgatgacggccgccgcgtaaccggcatcgccgatgatggcgaagcggttcgtgctgctctcatacttggcttcgtcggatgcggtgtttttgacgattgggcggcggaccagaccatactggcagtcgtatgttgcttggtcggccacgatacccagcggcagatcgactttgaggaagcgttcacgttcgtgccagtccatgtcggcgtggaaatcgagcgtgtgtgaaccggggcgcagcgtgatggtggtggtgatgacggtgtcatcgtcggcggtacacacgcggactcgtgccgcaccgttttcggtatcgaccgattcgattgatcctgtcatggcattcgccatgagcagggattcgcgttcgatctcccaggcatcccaaacggcgggttcgtccttcaacagttcgtattggcccaatcgggtgccggccggaaccagttcacggccatgctcctcgtcaagcagcgacgagattgtaccgtcggcctcgatggtgacggacagtacgccgttggccagcagtacacggccgttgtccaatgtctgggtcagtacggaacgcgcgttggtcggttcgttgatgcggctggcacgccaagccgcgccgtcattacggaactggctgatgcgggcttcggcgagcaggtcggcctgcgggttggccttgcgcagcacggcgcacatgtcttgggcgatttcggcgagacgcttcagatcgcggcgatagtcctcgcgggcttcgcggtgcacccatgcgatggacgaccccggcagcacgtcatggaactggttgagcatcagggtcttccagatacggtccagctcttcgcgcggataggcgtagttcgggtcggccaacgtggcggccgcgcccaggtattcgaccgtgcgcagcagcgattcctcttggcggcagccgcgtttcatgccctgttgcgaggtcaaagtgccgcgatgcagttcgaggtacagctcgcccttccagacgggcatttccgggccggcgttctctgcaagctgccgatgcgccttgtcgaagaagtcgttcggctcttcgacgctcaccttggagacgccttcgaggttctcgtagcggtgcaggtgctccatcatgttgcgcgtggggccgccaccgccatcaccgaagccgaagagcagaagcgagcgatcggcgagatccttgtcctggaagttcttctcggcgtagtcgagttcctgaaccttgcaccaagcagcataggtatccgccggcgggaagtgggtgaagatgcgcgagccgtcgatgccttcccacatgaacgagtggtgcgggaacttggtggtgtcgttccacgagatcttctgcgtgaggaaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtggtgcgggaacttggtggtgtcgttccacgagatcttctgcgtgaggaaccattcgtacccggcacggcgggcgatctgcggccatgcgccggtgtagccgaagctgtccggcagccatacgcccttgggctccacaccgagatgttccttgaagtatttgcggccatatgcaatctggcgaatcagtgattcaccggcgggcagcatgccatcggcttccacccacatgccaccgaccgggatgaaccggccttcttcaatgcgccgcttcatgcgcttgaagatgtccggatgatcctcttccagccaggcgtactgctgggcggagctcatcgcgtatttgaagtcggggtcggcgtccatcagcgccaatgcgttggatacggtgcgggccaccttgcggcgggtctcgcgcaccggccacagccatgcggagtcgatatgtgcgtggccgatggcgctgacgttcatggccgaggcgttggccggcttggccagtacgccggcgagtgctgcgcgcgcggcttccacggattcggggttgcgctcgtcgtaggcgttcagcgagcgctgcagcgctttggcgagttgccagtaacgcggcgactgtttgtcggcgaattccatcagggagctcaccacgtcgagatcgacggagtagttctcgtagcgttcatcgaattcggccagatcggcggacttgaatacgtacggctcgtccggcttgccggtggcatggtcgcccagttcggtctcaatgaacggaggcacgccgagcagcagcgggttgctggcggcttcgaggtacagggtgaagctgccgtcttcggcgaccggcacttgcgcgttgccctcagcatccatgaacggcacccaatagttgagcgggtgtacggctttgatggcggtgccgtcggcacggtagacgaggccctcgatatggccgccgcaggagtgcgggtaccagccgaggtcgaggatgagctccagcggcttgcctttcgggtagccggccggcacggtaccggtcaggcggaaccagactgtgccccatgtggtgccccattcaccgccgagcgtaaacggcttgaagtcgatgtcacctcgattgagcttctcgaagaactcgtcagtgggcatcggctctccgggaatgtcaaaggactccaccgcaagctgtgcgatcgatgggtggatatgagggtccacgcgctggcgcactatgcgcttgcaccgctccagttgctgttcaggtttcaggaacatctgctgttcactccccttatctctgccgcttgtgcggccacatcattgtgctgcccgttcatgggaaacatatcgacatgcgccctcgcccgcagaagactaaagcgctttagtaacatattggagggaatgggatatgatgtcaaattactatcgcaattcagcgtgttccgtcaggcatgtcatgctcggtgtcgatgacgatggtcaccggcccgtcattgaccagtccgacccgcatatgcgcaccgaaacgaccttccttcaccggcactcccccggagcgcaacgcctcgtcgaacttgatccacatgaaatcggcatgctcgggcttgccggccttgatgaagctcgggcgattgcccttgtgcacgtcggcgaacagcgtgaactgcgagatggagagaatctcgccgccgatgtcctggatcgaacggttcatcttgccctgcgcatcctcgaacaccctgagattcagaatcttatgggccagccaggcgatctgcttgtcgccgtcctcatcggtgacgcccaccagaatcatgaatcccgggccaatctgctgcggctcgaacgtgggatccagagtgcccaattcattgaccacgtctaccgatgcttcggatactcgttgcactacaactctcatgactccctacagtagcaactgcagcaacaaaaaagcgccgttcccttacggaaacgacgcttgtcttggtggaggcgcggggaattgaaccccggtccgatgaccgagcccacagtcttctacgtgcgtagtctgctggccaagttggcgatttttctgcccccatcgatgtcgcagacaactgatggcgagcatatccgcagttaaagtcccgatgcagccctgaggctcaactgcatcagcaagtcttctaaacgacgctcagcatcctcccaaagacgaggaggagtgaacggagcggctgctcactggttaattctgactaaaaatcaggcagcgagagcgaactcagtgcggttagatttagcacttattcttttgccggggtcatccacgagcggacccggcgttctcggcacgcttccctgcagcgaacaggtcaccgtcgaaaccgatcgcccccaatcttgagttatcaagcttccggcttttcggccggacttttcagcatacaccctatggcgctactcgcgcaaatcgccagcagcgaacatcgccccggaaccaacgaagccaacgaaatcgccgtcacttgatgatgggcttctgggatgaggaaacatcaatctgatgtttcccggcaaagccagccgtgccagcggtgatgttcttgtcgatttcctcgacttccgccaacttcagcttcagttgcgaagagtcgccccaaatgattacgcggtcaccgtcgttaagcgtggtagtcaccgaatcctgcgtctcagcggtgaccttggtaatggacttacgcatcgattccggcaacgcgcccagaatcgtcagcgtctccttcaccgaacggttcttgagactggcgtctatatccttgacctcgatcaccgggatgccatccacgttggcgttcttcaccgagttcaacacacgcgcctgggaatccaccgcggtcagggtatcgcctcttttcagcatggccgcgggccgttgcgccttgacttccacgctcatcgacttggggaactgtttggagaccttggcctcgctgacgccgggaatggacttgagttgctctgtgacctcatgggcggagaccaggaacaacgactttccagcctgcttatcggcgatgacatggatggtctgcgcactcacccattcgttggcaccggatacgccgatctcgctggtttccagacgaaacaccgacgagaaaagcagcagccatgccagccccgccactacagccacactgacgaccgcaatcaacacgcgtaacgcaacgacgcgcacgtttgcacgcttgcgttctttggcgcgttcggtgaaattcaccactttcgggcgtgatgcgactcctagggagccggtggtctgatgcagcgtttcggcaacgtaatcctcgctgtgcaaccgccgtgcatcgacgaaggcaccggcctggcccttggctaccgtcacatcgtcgatgatctccggctcgtcgatctcatgcccggaagacacggaccggggagcgcgagacttcgacgagcgacccgtgtttccgcgtgaaccgatggtgcgcggcttgcgggagctcccagacgaacgacgtgagccgttgtcattgcccccggatctgaccgtgcgcccggacatcactcgcagctttcccgatgggcctcaagtgcggtgagcagcacctgatccatgtcggtgatgtcgcccgcgcccacggtgaagatcacgtcgccgtggtgggcgcgcatggccatcatcttggcggccaggcacatatcctcaaccggctgaatccacgtgcctgcggaagcatccttgagtcccgcagccgcgtccacgatggtggaggggctgatgtccgggaaatcggcctgcttttcacgggccgggaagatgccggtgataatgacgtcatcggctttggctaaggatttggcgaactggtgcgcgaagaacttggtgcgggagaacaggtgtggctggaagatcacacgaatggtcgaatcggggtaccggcgtcgggccgcatccagcagggccgcgatttcggtgggatggtgggcgtaatcgtccactacagtgacctgcttgaccgtgccgcgcacctggaagcggcgtgccgcaccgaggaatgtgccggccgcattggccgcgtctgcggggctcacgcccagcagcacggcagcgctgatggcggcggccgcattgcgcgcattgtgcacgccaggaaccttcagggcaacgctctgagacaccggctcccccgccgtcaccgcggccggcagatgcagggtgagctgttcgacgccgctgcctgcggtctcgctttccgaagcgatccagacatacgcggcaccgcccaaatcgggcagggattcacgcgcggtagtgccgtaggcaacggtatgggatttcacgtcggcgggcagggcctccagcacggcaagtccgtcggggtcgtcaatactgatgatcacgtgaccggtggcccggccggcgtgggcaacgaacgcggcacggtagtgggcttcgtcgccgtaatggtcgagatgatcggcttcacagttggtgataatggcgatggtcggatggtatttggcgaagctgccgtccgattcgtcggcttcggccaccaggatgtcgcctttgcccgcgtgtccgccgtccagcgtggtgccgtccgggccttggataaagccgccgatggcgtagcttggatcggcaccggcgttcaccagaatgtgggacagcatggagctggtggtggttttgccgtgcgctccggccacggtgacggctcgtttgccgttcatgagcagggcgaggatgtcactgcgatgcacaatgcgcttgcccgccgcgtgtgctgcgacgatttccggattgtccggtttgatggcgctggagtagaccacggtctcggcctgggcgacattttcggctcgctgcccgaattcaacggtgatgcccagcgtttcaagtcggtcggttttggcgctgtgtgcgcgatcggagccgtccaccgcgactccttcggcgtgcagcatttcggccagaacgctcataccggcaccgccgataccgatgaaatgggtggcgccgagatccgcggggcgggccgcagcatcgaatgaggcatacgtggggtcaagcactatgggctgatcttgagacaattcaaaactcctttagggattccagcaccctatattatgaccgtatctcgtgctgcggaacggaattggtcagtatcgcgcacggaatgatatctgaatactacttggatggttcggctaattgcagaacgtgccgggccatgatttcggcagcgtttctgatgccgtattcccatgccttgcggccgaattcggcaagtcgttcgtgatcggcgagcagatcgggcacatgctcatgcacccactgcggggtcaggtccttgtctgcgaccagaaggccgccgccggcgttcaccactggctcggcgttgaaacgctgctcgccgttgccgatgggcagcggcacgtaaatggccggcaggcccagtgcagccagctcggataccgatccggctccggcacggcaaatcaccaagtcggcacaggcaaaggccagatcgattcgttccagatattcggcggtatggtagtcaccttgtccggccgattcggggccgatgccggtaagcacgtccgcgccggccgaggccgtgaccagttcgcgtacttcgctgattttgcctcgcccggtcaagtggatgatttgtgcgtggaccaacaggtctgcggcggaggaggcgatggcgcggttcaggctttgcgctcccagcgatccgccagtgaccagcaccagcggacggttcggatcgacgccaagctgcgcggccgattcacggcgtacggcggcacggtcgtcaccgatgcgtttggtcagggaggcgatggccgggcgcaacggcagaccgacgcgctcgacgtcggctccggcacgcggtttgagaccggtgccctcgtacacggtaccgatgaaatcggcccaacgagcgcccagtttattggccatgccggcacgcgcattctgctcatggatggcaatcggaatgcccatcttgtgtgcggtggcgtagacgggggcggaagcatacccgccgaatccggccacgacatccgcatgccgcgtttcaagaatggagcgcaccttggcggtttctcgcttccattttgccgggaagcgcagcatgtacaggttagggcgacgcgggaacggcactttttcgatggtgtcgagctcgtagccggcctccggcaccaaatccttctccaaacccaccgcagtgccgatgacggtgacctgtgccgtgggttcgatgtcgcgaatcgccccggcgaccgcgagcagcggattgacatgtccggcggtaccgccgccagcaagaacgatatgtggtgtgccttgattcatgattaccgagtctacttacgcgctctgacgcgactgttttatctgcggttgagagcgcataagtcccacaaccagtccggccgccgtcaagcacataatcatggatgagccgcctgcggagacgaacggcataggcacgcccaataccgggaacacacccacgaccacgccgatgttgaccatggcctggcccacgatccaaatggtgacgcacatcagcaccatggcaacataacgatcggtgacctgcaatgcgatgacgatcatgcaccaggcgagaatcgcgaagaacagcaatacgatggcgcaaccgacgaatccggtctcctcgccgatgatcgcgaaaatgaaatcgttatgggcggccggcaggtaattccatttctcccgcgaattgccgatgcccaatcccagaaaacctccggaggcgatggcgtacttggcgtgaatggactggtagcatacgctctgcgcgtcagcggccgagcaatcgccatatgtggccagaatacgacgcaagcggttcgggctggaaaccgccaatgcaccgaccataaccaccgcgcccaatacgccgactcccatccatttgccggggaacccgacgatcagaaaggccacacctccgatgaagaccagaatcatggccgtgccgaggtccctgccgcccatcaccagtgccacgcctatcgcatacaacaccaacggcgcggcatatgctttgattcccttcttgtggtacatcttgctgcaggcatgcaacgacgagggaagccatatgcacatcgcgaacttcatgaattcggccggctggatagtggtgaagccgaggtccagccaacctctgttgccgtagacgtcgtgacccaaaggagtaaaggtcagcgcctgcaacaggcaggcacccaccacaaagaacacgccggtccgtttccagaacgtcaccggcatcatcaatgccacgaagcccagcaccaagccgatcaggcaaaacgcgccctggttcagaagctgaaggaacggcgacttgcccagtgcggccatggtgaccgtggagctggagaacaccatgatcaggccgaagcatgtcagccccaccacggccatgcggaagccgtggtagcaccatagcgggttgagcaagcttcgccaacccgtgtagtcggcgatttcgagtgagggcttgtcaggggctctgtatgccttacgcttatgggtatcagtggaggccatgcacctcgctccacgtcttggctgcggcggcgaatcgattgcctcgatccgcgtaggacttgaactggtccatggaggcgcaggccggagccataagcacgatgtcgccggcggcggtatacgtgccgcaggcttcgacggcacgatccatgacggtatcgttgtcttcgggatcgatgatggtcaccgggatgtccggagcttggctggcaaacgcttcgatcatcggctgctggtctttgccgatgatgacggccgctttgatggtgtgtgcctggtccttgaccaggtcctcgaatcgactgcccttggccagacctccggcaatccagatcacagacttggccgggaagctggacagcgaggcgcgtgccgcatggccgttggtggctttggaatcgtccacaaaacgaacagagccgccctcgactgcggcctcagccacggtttcgatgcgatggccgcccggcttgaacgaggtaagcgccttcaacgcggtatcgcgatcagcgccaagtcccagcaccaacgccaatgccgtcaatgcatcggccaccagatgcgggtacagtgagccgtccggctctgccagatgcgtgaaatcggtgatggcggccagtctgaccgactctcctactgcgccgccggccacgccgctcctgtccacgatccagccatcttcaatgccgatctggccggcttgaggggcctcgagcgtgaatcccaccttgcggcatccttcggcagtctgagcctcggccgccagttcgctgactttggcgtcctgcgcattgtagacgatggcgcgtttggcgttgtggaacaccttggatttgtcggcggcgtaattctcgcgcccgccatgccagtcgaggtgatcgtcggcgatattggtgatcgccgcgcagtcaagtgccagcgaatcggtgaagtgcaattggaaggagctcagttccacgcacagtacgtcgtgctgcggattggtggcgcaacgagacaggctcatgctcatgtctccggaggcgatattgccggcggtcggcgcgtcgagtccgcaggcggtgagcatttccgaggtcatctcggtggtggaggttttgccgttggtgccggtgatgccgatccatggagccggagtaccgatgcgctcgttattcacacgcagctgccatgcgaattccacctcgctcatcacggggatgccacggcgttgggcttccagcacgaacggggtgcgggggttgaacaccggggacgacatgacgtagtccacgtggtcccagtccacgtcatcaaaggagtggagatcggcctcgggcttcctctcgtcgacgccaatcacgtgggtgccgcgttccctcaatacctccgccaacgaggtgccggacacccccagtccggcgatcaccactgtcttatccgctacttgcattgttcctcctgatataggaattccgtgggtgagcataatccacccagatttccgctagctgaacagcaggccggagcgggtgacccagtcgccgtagaaaatcgtcagggcgagcagcacgaagatgagttcgatcatccagaaccgcaccaccaccttggtttcggtccaaccctccagttcgaaatgatggtgaatcggcgccattttgaatacacgtttgtgggtcatcttgaagtacccgacctggatgacgtcgctcatggcttccatgacgtacagtccgcccagaaccaccgccaggaattcggtgtgcgtggcgatggacagggctgcgaacagaccacccaaggccagggaaccggtatcacccatgaaaatcgatgcggggttcgagttgtaccacaggaagccgaagcaggcgacggccgcgcatacggcgatgacggtcagatcgagaggatcggacacggcataggaatatccgccatggctgccgcccttgatgtggtagctttcccagaatgcgatgatgccaaaaccagtgaaggcgatcatcgacgaacctgccgccagaccgtcaagtccatccgtcaaattcactgcgttggtccatgcggtcatcaggaagttcacccagatgacgaacaggatgatggctacggcacggccggcgaagtcgaagttgaagaacggctgttcgatgaagctgatgcctgcctgcgcactggggaatcccgatttggtgggaatcagcagcgcaagtaccgcgtagatggtggcgaagatgaactggccgatgaacttgccgcccaccgataggccttcgttctgcttcttacgcaccttggcgaagtcgtcgataaagcccagcagacccatcgacagcatggcgaacagtacgagcgccgcggaccaggagggcacgtcgcccgaacgcaggtatcggtacagtgcggaggatgcccaaccgagcagaatcgcgaagttgatgaccacgccgcccaacgtgggggtgccgcgcttgaccagatgcgactgcggcccatcctggcggatgtactggccatagtgcagcttgtggaccagccgaatcagcagcggggtgccgactaaggtgacgatgagcgacaccagcattccaatgatcagagcaatcacgtgcagcttctctttcttgtcggtttcttggggtggttatcaggtcagttctttgcccagcgttcagccaaagcgctcaggcctgacgcgtgcgatcccttgagcagtaccacagcgtcgggatggttgcgagccaagtcgatgaccagctgttcggccgcatcgatgtcgtgtacgcaatccaccgacgcggattggctctgacgggcaccgtccgccagagcctgtgccagtgcatcgagatgttggtcttgggcggaaccgaccgcgatgatcgcgtcgatgcccaattcgtccgcatacgtgccgatcgaggtgtgcaatgccgtttcatcggcgccgagttccagcatggcacccagcagcgccacgcggaacggctccttgccgtcatttgagttccaggccttcaacccgttcaggccggctttcatggagtcgggattggcgttgaaggaatcatcgatcagcgtgaaggaagtcccctcgcgattcaccgtagacaatgccatgcgatgagggctgatggtgtgctgcgaggccagaatccgtgccaccgtttcgggtgccataccgtaacgcatcgccacggttgcggcggccaacgcgttcatcacattgtgacgtccaggaatgcccagatgcaccggcgtatggttgccgtccgcatcgaccaacgtgaattcagcatgatcggaccggtcggcagtgacatcaatggcccgcacctcgggctcctgcgacgatcccaagccgaaccacagcacgtcgccgttggccaggccggccatgggaaccacgtgttcgtcatcggcgttcagtaccgcggtgcctccgggaagcaatccctgcacgatttcgcttttcgcctgtgcgatgcgttcgcgggagccgaattctccaaggtgagcgacgccgaccttcaatacgattgccgtgttcggcggtgcgatacgggtcagtcgcgcgatttcgccgatatggctggcacccatctcagccacgaagaaccgggtgtgctcatcgacccgcaacgcagtgagcggcaggccgatctcattgttgaacgatcccaccggagccacggtcggacctacggtggcaagcagggaggagagcagatccttggtggtggtcttgcccaccgaaccggtcaatccgatgatgtcgaagtcgccgtccagctcgcggcggcgaacgatgttgtatcgggcgagttcgccaagggcgtcgaccgtgtctttcactacgatctgcggaaggccatcggacttcacctcatggtcgacgatggccaccgtggctccctgtccagcggttttcgccacaaagtcatgcccatcgacacgctcgcctcggatggccacaaacaccgatccggggccggcctgccgcgagtcgctgaccgtattggtggctcgagactcggaaccggcgtctccgatcaatcgaccatcgacggccttggcgatctcctccacgctcatcggaaccatggtgtttcaaactcctttacgattacgcttcgtcccgtatccacggacttaattgagattattggccacatgcagggcactgcgtatgttgtttttcctcacgccggcggccagcaccatggcgatggccaaggacatgtgcccgagtcggacgcggtcatacattgccggtgaatccgcagccatttcatccgattcgggtgtcgacgaggtcatggacatgtcatgttccgcaacgaatgcgtagcgtgtcttcaattcgttcaagcttgcgcttgcgttgacatcctccgtgcccagtacatccacgttcaccgattccaacgcatgctcggccaacgtgcggtcatccatggcgatgatcacggccgccacaccgtcttcggcgcacacggacagcgcgcgctgcatatcgaggatgcccagaggatagttcaggttcatggtacgtgtcatcgacgtggacccggatgcggtgattaccgccaccggattgcccagcatgtgcaggaattcggagagctgggacacgcctgcgtcgacggcctgctcatccgcaccggtcaccgcgaacaccgccatggcattggacggtccgccggccagaccgctggccagatcgccgagtacgcgatcgtcgaaatcgccgtagagcaacggtatatcggcattggcgatctgccctttggacgcgcgtggcagcaacgccgcataggcaccggcctgtgcggcatgcagtacatcgggttcctgctcatgcgtgcagatgaacagcgagccgggaatcacggtgtccacggcatcgctgagtgaggtaatggtgacattggtggcgaagggtggatcgacttcaaaaccgtaccgttcgaccagcattcccagggtcacccgctgggcgatggattcgctcactgcactcatgggctatcgcctttctcccctgatccttaccacgtgactggaatagcatttttgcgtggactggagacaggcacctcgtatttctgcataaggaactcacaaatctgtgcggaaacagggccggccgtcagaccgccgaacacaccattcggatccttcatcaccacggtgaccgcatagcgcgggttgtccgcgggaatcaccacggaataatcggagataatggacgagagcgtaccatccgagccctgcacctctgcggtaccggacttggcggccatgcggtaaccatcgaccttgacgaacttgttgtagccttccgccactgattccatcgcattcatcatgtccgatgcgaccttttcatccaccacgcgggtggcttcgcccttcttggtctcagtggtcttgccattggcatcggtggttgatttgatgatcgactgctgctgcttgacacccttgttcgcgatggtggccaccacgttgttgagctgcagggcgttgacggtgtagccctgaccaaacaggatggtgttgcgcgtacgcagatcccacgccgaagggttggtgagcagaccgctcgattcaccgggcaggttcagtccggtcggttgtccgatgccgaatttggtcaggtactcgtagcgttgctcatccggatagttctccccggccataatcatgccgacgttcgatgagttctgcagaatgccggcgagcgtccagcgctcagtgccatggtcgaatgagtccttgtaggtctggccctcctgtgtgatgtggtccgggaccgacaattgatcgctcatcttatgcagtcccatctgcagatagccggacatggagatgaccttgcccaccgaaccaggctcgaaggtttcggacacggcccgagacgggctcatcttcgccgcatcggtaccagcctgtacttcatcgctatcggccagtgcgagaatctccccgctctggacatcctgcaccacggcgatcgcccacgctgcaccatacttggattcggcctccttcaagacctttttgacataccattgcacatcacggtcaatggtcagggtgacatcgtcgccatttttggccgccaccgattcggtcatggtgccgggaatctcttcgccgccattaccacgctggtaggtttcatggccatcggttccggtaagcgtcttgttctcgacctgctcgatgccggcgacgccatcgccgttgtcgttcacgccgccaagcagcgcgcccatgagatcgccatccgcatacagtcgttcactgctcagctcaccccagacaataccgcccaggtgcaacgactcgatgctgcgcttgacctgcggagtcacatctttcttcagaatcacatactgcccggtaccggacagatcagcgcccagttccatggcgttcatatccaggactttggccagcagtcggcccacggccgccgctccggtagcgcccacgggtttgccgtcaatttcgtggcagtaatcacgggtgttgtcattgcaagtaatcggctcgaactcctgtgcagcctccggattggcgacgatagtataacgctccacgctttgagcgagcacggagccgttggcgtcgaggatacgcccacgcttggcgctcaacgtcacggtcagggtgcggttagccgtggccgcttgtgcggtttgacggccgccgacgagctgggtggaggccagctgaatcacgcatgccgacgccaccaacgccaatgcggcgccgatggcgatgcatttgaacgcgaaggtcttgaccttggcgaactctacgatgcgacgaatggtgttcactgggttccgcctttgttggactggtatccgcttaagtcgatggacactgatccctgctgcgggaccatgcccatgtcgctggccttgtcgggcaggttcgcgaccaattgatcgagtttggcctgatcgtcttcgatatcttgggtaagtctgttgatgttggtttcgatctgtgccgcctcaaacgagttctgcaccatctgggtacgcagcatcagcgcgccgaacaaggtgccgacgaggaagatcactgcaatggccacgtgcaccagcggtgcgcttcttgttctggtccattcgatgacccgtccgacgacattgccctgctcgtttccacgcgggttggagaccacccgcagctcaggtcgggaggaggactgatgcttggtgtgcggtcggttcgaggctggagccgcgttcgatcgaatgctacgtgcagttgccatatgctgttatcccctccttgtacgaattcgtgccgtgtttttggctctgcccggagacgcggagccttgtatcttgacgtcattcaggccctgcgcggtttgcgtaaagcgtttcctccatcgtgacggaatctcacggctgacttccaccgcccgtaaccgcaccgaagccgatctcgggttggctgcgatttcatgttcgtcggccttgatggcacctcgcgtgagatccgtgaaaaacggttgggcatccggcggtatgacaggcaggccagccggaacatccactcgcagcccttgtgccatgaacgatttgacggttttgtcttcgagcgaatgataggactccaccaccagtcgtcccccgacatgcagtcggttcgcggcctgcggcaatgtggaggcgagcttgtccaattcgccgttgacttcaatgcgcaacgcctggaagacgcgtttggcgggattgcccgccgggcggtgggcttgcggcaccacttcatcgaccagacggttgagctgtgcggtggtggtaaacggctccttgtctcgacgcgccacgatggcgcgggcgatctgacgcgagaaacgctcttcaccgtattccttgaatatgcggaccagttccgccgcatcataggtggcaagaatccgttcggccgtcaacggctggctgacgtccatgcgcatatccagcggcgcatcatgcgaataggagaagccacgatcggtttcgtcgatctgcaggctggataatcccagatccatgaatacggcgtccacgcgttcgatgtcttggtccgccaacacctgatcgagctgatcgaaggcggcatgcaccggaatgaatcgatcggcgagcccctcccgttccatacgttcggtggccagccccagcgcttcactgtcacggtcaatgccgatgagccgagcctgaggcgcggccttgaggaaggcgatggaatggccagcaaggcccagggtgcaatccactgcgatggcgttctcatgttccagggcaggtgccatcaggttcacgcaatcgtcaagcaataccggcagatgaatattcgccacatcaaccatcagaattccacctccggcaacacatcgtcagcaatatcggaatatccctcttccttctcggcgaggtaggactcccacgtgtccttattccacagttcggcacgggtgccaacgccgatcaccacgacgtcggaacccagattggcgtaatcgcgcagcatctgcggcaccagcacgcggccctgcttgtccggctgctggtcgacggcaccggaaaggaacacacgcaggtattcgcgggcggctttgtttcccaccgacacacgctgaatctgcgaggcgatacgtcgaaattcgtcgaacggcagcaggtacacgcaccgttcctggcctcgggccatgaccaggccctgccccagctgggagcggaatttggccggaagcgccatacggcccttggcatcgatcttcggcgtatatgtgccgagaagcaatggcggcagaccagccatgagatcggccatagtggtggagccttgtgcgttggcatcagcgtcgcgaatcgtctgatcggcaaccatggctccacctccttcatcgttacgtgggatacacttcggccaactggctcaccactctaccccacgattccccatttctccccactcatgcacgatttgctcacccttttagggcaattaccgatggattgcgcgtgtcggccacgactgtcgcacgaatggacgctccgcacatctaatccacgtcgcgcaccccaccgaccgagcagcatggtgaattcacgctgaattcacctattccgagttgtccgcatcactgacgtagggggtgtgcggtaaatttgaatgccttaagtttttctgccccacggaaatggaacgaagagaacagcatgtcgagttacgcctcccagctgcatgaagagcagcaggccgtcgatcgcgcctatggacgattggatgatctgcgagccgaaatgtggcaacgcctggacaccgtacgcgccgccggctcccacggatcccccacgcaacgcagcgaacgagactcctttgccacaatgtacgaaaaccgcctcacgcaattgcgcagcgttgaggatcggctggtgtttggccgcctcgatgccaagaacggcgaccgtcattacatcggccgcatcggcctgtcgagcccggaccatgagccgattctgaccgactggcgtgccgaagccgcacgtcctttctatgaggcgaccccttccaatcacggcgacatcgtgatgcgcaggcatatcaccttgagtttccgcgaagtcgtgggcgttgaggatgaggtgctcgacgtgcattcagaccaggtcggccaagcgtcttccgccggcacattgaccggcgagggtgcgctgctggcttcgttgagctcacgccgcaccggcaagatgaccgatatcgtggccaccattcaggccgagcaggaccgcatcatccgctccgacatgaatcgcgccgtggtggtgcagggcggccccggcaccggcaagacggccgtggcgctccatcgcgccgcctacctgctgtacacgcaccggcgcacgctggaacgttccggcgtgctggttgttggccccagctcggcgttcctgcactacatcgatcaggtgctaccctccttgggcgagaccggcgtggtctcacgcaccatcagcgatctgattcccggcatcaccgccacggcggtcgactccccttatgcagccaagctcaagggcgatcgacgcatgacctccgtagtggccaatgccatcgccgcacgcgtgcgtgttcccgctgctctgccgacagtaaccattagcggcattcaggtaccaatgctggccactgatatcgagcaggcgcaggcggacgcgaagcgcacccgacaacctcataacaaggcccgcgagacctttatccgttcgatgctgaccagcatgcagaaccgttatgccgaacagcttgattacacgccggatcaggcggagctgaaccgcgcgatgtcgctgctacgtatgaacgagcaggttcgcaagaccctgaacctgtgctggctgccgatgaccgccccatggctcatcgatcagctgttcgcccatcccgaacgtctgaagtctctggctggttggctgaccgacaacgacatcgcggcacttgcccgtcccaaaggctccccgttgacccgctccgatattccgctgctcgacgaagcaatggatatgctgggccccgatcccaaggcggtggcccgccagtccgtcgccgacgcacgtcgtgccgccgaagagcagtatgccaaagacactctggccgcgaccggtctgggtggaggcatcgtctccagtcagatgctgctcgaccagatgaacggggacgacgctgagctgaccgcgcagcgggccgcggccgaccgtgaatggacctacgggcacatcgtggtcgatgaagcgcaggaattgaccgccatggactggcgtatgttgatccgccgttgcccctcccgctcgttcaccatcgtgggcgatgtggcgcagacttcggcgctgggtggcacccgacgctggagcaaatcgatgaaccgcctgttcggcgaaagccactgggatttgaacgagttgaccatcaactaccgtaatccgcaggaagtttccgaacttgcctcacgatttgccgaggaggaaggcctctacatctccacggtcaatgcggtgcgcaccatccccgattcggtgtcccgcaatgtggtgcccgacatgtcgtccttgctggaaacgacggccgagcaggcggcgcagcttgccgaacaattcgtttcggcagacggcaccggccgcatcgccgtcatctgtcctgataatctcatcgccccggtgcgcgatgccgtgcgccgcaaactggctgtcattcttgacccggccgaatacgcaaggctcatcgagcagcccgaatgggatgagcaaatcagcgtctgcggcactgaaacggtcaagggtctggagttcgatgccgtcgtggtggtcgagcccggtctcatcgaggatgacgcgccgagccgcctggtcgccgcctcggacctgtacgtggcaatgaccaggccgacccagaaactggttatagttcggacaaaagcggacgaaaagtccctgaacatctaaggtatgaagcatgcccaaagcactgttattggaaaacattcaccccgatgcggccaaatcgctgcgtgatcgcggtttcgaagtcgagaccatgaagggagccctgagcgaggacgaactcatcgatgcgctggatggcgtggacttggtgggcgtacgctccaagaccaacgtcacagcccgcgtgctggatgcgcgtcctacgctaagcgccatcggctgcttctgcatcggcaccaatcaggtcgatctggcacatgccggcaagcgtggcatcgccgtgttcaacgctccctactccaacacccgttccgtggtggaattggtgatctgcgacatcatctgcttgatgcgccgcattcccgcacacacgcatcacatcaagcatggcctgtgggacaagtccgcttccggctcgcatgaagtgcgcggcaagaccctcggcatcatcggctacggcaacatcggctcccagctgtcagtactggccgaggccctcggcatgcgcgtggtgttctacgacattgaggagaaactggcactgggcaacgcccaccgttgcgacaccctcaacgaactgctggaacagtccgatgccgtgaccctgcacgtggatggccgcaagtcgaacaccggcttcttcggcgaagaccaattcgcccacatgaagcaggacgcgattttcattaacctttcgcgcggtttcgtcgccgatctgggagctctgaagcagcacctcgattccggccatctgtctggcgcggcggtcgacgtgttccccgttgagccgaagaagagcggagatccgttcgagacctcactggccaatgaagacaatatgattctgactcctcatattggcggctccaccttggaagctcaggaatccatcggccatttcgtctctcagcgtcttgaggattactggttcaagggttctacctccttgtccgtgaacctaccgcagatcaacctcggtgagtgcaagggcgtgtgccgtatcacccatctgcacgacaatcttcctggtgtgctggctcatgtcaatcatgtgctcggcgaggagaacatcaacgtttccttccagtcgctggcaaccgaaggcgaacttggctatgtggtcaccgacgtggctcaaaagcccagcgccgccacgcttgaagcactgcgcaacatcgaaggcaccattcgcatgcgtgtcatcagctgacgcagctcatcctcgattgatatgaaagagacccgtcgtcgacgggtctctttcataagtgctgggcttcatgattggctcgcaccatggtttgcgaatcactcgcatatcacggtgcatggcattcgcatattattcacgcaaaccatcaatggcgctttggaaatcctccagacctgcaaagttctggtacacactcgcgaatcgaaggtacgccaccacatccaagtcacgcaacggtttcaggatggctttgcccacttcatctgaggtgacttcggcaaggcctcgggagcgaagatcctcttcgactttctgtcccagcagcttcagatcctcttctctgaccggccgcccctgacaagctttgcgtacgccggaaatcactttgtctctactgaatggctccacgccacccgaacgtttagtgaccagcagcatactggtttccaccgtggtaaaacgcttgctgcatttcgggcatacgcgacgccgacggatggaatgaccgtcatcgctaatgcgcgtatcaatgactttggtgtcggggttctggcaaaaaggacaatgcatgctccccagaataacgtgtacgggcggaaaaaccatgccgctcgggtttcatttactcaaccggaacaataatgcgctgcccggcctgcaatgatccggactcaagattgttcaacgcaatcagctcatccaccgtttccgatacatcatgaccagcaggcgtgatagccgaagcatatgaccagagcgtatcccccggccgcacgatataaccggtcacctgcgtggcccccgtatccgattgggcccgctgaacggtaagcgcgccgaaaccacaccaggccagcgtcaaggcgaccatcactgcgataatcttcccacgcacattccggcgggacgttccagcatgctgcatagctacacgtgcactacaggccggggccatcaccattgaaccagtcatcacgaccacctctctcgaacagatgttctatcgaacaactgttcttataatggcacaaacgttcgacacggtcaagtcaaaactcgaacagatgtttgatttcacacgaacaacacgttatgctggtgacataacgaaaggagccctgacgtgagcaccattcccttctcccccaagcagaagccggacgagtccaccctgaccgaccgccagcgcaaagtgttggacgccattcgcacgcatatcgacgaacaaggcttcgctccctctttccgggaaatcggaaatgccgccgggctcaaaagtccgtcttcggtcaagcatcagctacaagttttggaagacaagggcttcatccgcatgaacgcgaacaagggtcgagccatcgaggtggtggcaggatccgccccgaatgccgaaaagccctcccaagccagcgaagaggcaaccagcaccagtaatgtggcggagatataccaattccccgccgaagccattgccgaatcacacgatgtgccgctcgttggccgtattgccgccggcgtgccaattaccgccgaacagcatgtggacgacgtcatgcgtctgccggaacggctgaccggctccggcaccctgttcatgctgaaagtccacggcgattccatggtggatgccgctatctgcgatggcgactatgtggtggtgcgcgaacagaattccgccgtcaacggagatatcgtcgccgctctgctggatgacgaggccacggtgaagaccttccgcaaggaaaacggccatgtctggctgatgccgcacaaccccgcatactcgcccatcgacggcacacatgccacgattatgggcaaggtggtcaccgtgctgcgcaaattgtagcctgttcgccaccagctgatcagcgtgcaccgaatcgcgccggtcgtgctatagtcacgcacagcttacgaaaccccggcctcgcgccggggtttcgtcgtattcagaccatatcgcaaatggtattgagaagcggtttcaactcgatagagcgaaggagtacatatggctcatacccatgcacccgcaccatccacatccgtaaaccctgccgcgcaccagcgtaggctgattgccacgttgaccgtaaccggttcggtcttcctcatcgaagtggtgtcggctgtcttaaccggctcattggccctgctggtggatgccggtcatatgctcaccgacatgtccgtgctggcggcatccacaatcaccgccatactgatgcgccgcaagcccagcaacactcgtacttggggctgggccaggcttgaggtgctcaccgctgccgcaggtgccgtggtgctgctcgtcgttggcatctatgcgttgatggaggccggcatgcgtctgttcggcggttccaaagcggaaatcgacgatatcggcttgctgctgttcgtgggcattctgggtcttgccgcaaatatcatctcgattttcatccttgcctcgcagcgcgaagacaacatgaatatgaaggccgcgttcctcgaggtgatgaatgacgcacttggctcggtggccgtggtggcctctgccctggtaatgatctccaccggatggaatggcttcgacgccgtggccggtgccgtcatcgcactgatgatgattccgcgcgccatcaagttgctgcacaacgcggtcaaggtgctgctggaggaaacaccggatggacttgacctcgataaggtacgcgaacatctggaagacgtgccgcatgtgcttgccgtgcatgacctccacgccagcacggtgtccaccggcatgccgattctgatggcccacgtggtagttgacaaagacctcaccatggaagatgccgccacaatcctcacccaactgcaggattgcctgcgcgagcacttcccggtctcggtcccccacaccaccttccagctcgagcccgagggctatagctccccctcctccaacgaactccacgaataaaaaatgctcccaacgggagcattcagcagggtataaaaaatcgctgtatgtgtgcgattttcgtgccgcacaagttgaaggcctacaaaggtaggtcgagtcttgtgcggtgcgaaaggcgctccgtacagcgattttttatcagaagccgaactgggcggcggtttccttcagcgtctcggcagagcgcttcagagcggcgagctccttgtcggagaccggggtgttgatggtgttgttgacgccctgacggttgaggagggtcggcacggacatgcagatgtcggagatgccgtggaagtccttgagcatggagctcacgggcaggatgcggttggtgtcgtgcaggacggcttcgatgatgtcgacgccggacatgccgatggcgtagttggtggcacccttaccgttgatgatcttgtaagcggcgttcttgacttcctggtggatctcctcgcgcttgtcggcgtcgagcggatcgtggccgggcagcggggtccagtcgcacatggggacgccaccgatggtggcggactcccacagcgggacttcggagtcgccgtgctcaccggcgatgtaagcgtgcacgttcttgacgttgacgccggtctgctgggcaatcaggaagcgcagacgagcggagtccaggttggtgccggaaccgaagatctggttctcgggcagaccggtgagcttctgagccacgtgggtagcgatgtcgaccgggttggtgatgagcatgtagatggcgttcggagccaccttgaccaggttcggcatgatggccttgaggatgttgacggtagcgccaacgagctcaagacgagactgacccggcttctgacgcggaccagcggtgatgacgaccatgtcggcgtcgcggcagatctcaggatcgtcggaaccgtcgatggacacggtcgggtagaagctggagccatgctgcatgtcgagcacttcggcttccacgcgctccttggcgatgtcttcaagcacgatctcgcgagcgatgccacgctgggcagcggcgaaggcgagggtggagccaacggcaccggcaccaataacagcaagcttcgtgggcttaacggtagtttccgccatgatggatgaacctctcttcaaaggcggtctgctgatgaatggcaggccttgtaactaacgtcttcactctataaacccgctaagacgttttgctaccagcacgccaccctgtttgataaccgtatggtaatgttttcaacggttgttagcgctcacgaatatactgtgatgtttatcacgttagtcaatggactgttcgaccacctgagcggcaagatgggcgtcaacgtccgcttcaagctgtatgccatcatcgcggtactccaccttgtctaccttgccgtattcgcgtacacgagagatcagggagccagcggtatacggcagcagagcgttgacatgcacatgcgggaccggcagcagactttcgaccgcggtacgcagctcgtccaatccctcaccggtataggcggagacgatgaacgcatctggctgcagcgcggcgagtcgttcacgagtcgcctcgtccgcctgatcggccttgttgaatacgagaatacgcggaatcgaggccgtaccttcgatgtccgccaacacgtcattgaccgcgtcgacctgagagaacgggtcagggtgggagccatcgaccacatgcaggatcacgtcggcctcggccacctcttccagggtggatttgaacgcctcgaccagctgggtgggcaggcggcgcacgaagccgaccgtgtccacgtaggcgtaggcgcgtccgtcgcgggttttggcgcggcgcacggccgtgtccaatgtggcgaacagcgcgttttccactagttcggccgaaccggtcagacggttggtcaacgaggatttgccggcgttcgtgtagccgaccacggccactgtgggcaggccgaagcgacggcgtgaaccgcgcttgacctcacgtgccggggccatctcacgaatctgacggcgcagtctggcgatacgcgtgcgaattacacgacggtccatttcgattttggtctcgcccgggcctcgcgatccgatgcccgcatccgcgccggccgcgcgaccgccggcctgacgggacaacgaaccaccccaaccacgcagtcggggcagcatgtattcgagctgcgccaactccacctgcgccttaccttcacgcgaggtggcgtgctgggcgaagatgtccagaatcaccgcggtgcgatccaccaccttgactttggcggcgtcctccaatgcacggcgctgtgacggcggcaggtcgtcgtccacgataatcgtatcggcttcctcacgcgccacgatgtcggcaatctccttggctttgccggaaccaacgtacgtggctgcatccggcttggagcgatgctgcagcaaaccatcgcataccaccgcaccggcggtttcggcgagcgccgccaactctctcaatgattcctcggccttggcttgcgtggtgacggcggacgaccagacgccgacgagcaccacacgttccagacgcaccttgcggtattcgacttcggtgacgtcctgcagctcgccgagaccggcgacatgcttgagctcgttgcgggcctcgcgctcctcccattcctggttggcgtcctcatgccagccggtcgcgcgctggctgtcgtcgagcaacacttcggactgctcggccagcacaccttcaggagtaacgtcgttgttgccgcggttgatgtcggtgtactgggtgttgtcggtcaagtgcgcctcgtttggttggaatggttcacgattcttctatggtcctttattatcatcacatgaggtgacatgctggcatagatcggcacgtaccggcataggccggctgatacaggtcggcatacgagagcggcgaatcccgcagaaatggagcgaccatggcagaacagtatttctctgcggaacccgcatcgaaggatgtgcgccgcacattgaacgtaacgttgcgcggccatgaggcgaccgctcaggtgtcgaacggcgtgttctccggctcgcgcgtggacctcggtacgtcggtattgctgaagcatgcgcccgagccgccgcttaccggcgattttctggatttgggctgcggctggggccctatcgccctgacattggcgtttgagtcgcccgaagcgaacgtgtgggcggtggatgtcaacgagcgcgcggtggacctgacccatgccaacgcacaggcgaacggccacacgaacattcatacggctcaggtggacgagtccagcactcccctgcctgccgagaaccagccggcgttctgcgagacggtgccgagcgacctcacgtttgatgtgatttggtcgaacccaccgatccgagtcggcaaggaagcgctgcatacattgcttatggcttggctgccgaagctcaaggtgggcggtgccgcctatctcgtagtgcagaagaatctcggttccgattcgctgatcccctggctggacgatgcgctcggcgaggggttcactgcgagcaaatacgcgagctccaagggcttccgtatcattgaagttcgtcatgaaatatgagtatcccgcagaacttcccgtatctgccgcgcgtgatgagatagccagcgcggtcaaacgttcccaagtcgttattgtgtccggccagaccggttcgggcaaaaccacacagctgccgaaaatcctgcttgagcttggccgtggcacgcacggcaagcagatcgtgcacacccagcctcgccgtatcgccgcacgcacggtggccgaacgtatcgcctcggagatgggcgtgaagctcggtgacgaggtcggctatcaggtgcgtttcaccgacgaaagctcgcccggcacacgattgagggtcgtgaccgacggtattctgctcgcccagatccagcgcgatccgaaactcacccgatacgatacgatcatcatcgacgaggcgcatgagcgcagtcttaacatcgactttctgctcggctatctgacggcactgctgcctcagcgccgcgatctgaagctcatcattacctccgcgaccatcgattcggtcaagttccaggagcatttcgagcacgccttgcatgagaaggtgccggtaatcgaggtttccggccgcaccttccccgtgcaggtggtctacgagccgcttggcaccgcgcccgcgttgatgcgcgaagtgccgggattcgcggtgggcgcccgccccggcgacgccgattacgacgagctggccagcgccatcgcggaatccgattccgaccggccccgcggccggtccggtgcctcctatgccgatgacggcatcaccgatatgcctaccgccgtggctcgagcctgcgccgagctggtgattcactcctcccacgagcgcggtccccgcgatattctggtcttcgcctccggcgagcgcgacatccacgagttcgaggccgcactgcggcatcattacggcccgcgcgccgacgacatgcgccggccggatgccatcgagatcatgccgctgttcgcgcgactgtccgccgccgaccagcataaggtgtttgaatcgcaccttcaccagcgcatcgtcattgccaccaatgtggctgagacctcgctgaccgtgcccggtatccggtatgtggtggaccccggttccgcccgtatctcccggtattcgaagaccgcaaaggttcagcgtctgccgatcgagccgatcagccaggccagtgccgaccagaggtccggccgatgcggccgtgtggccgacggcatcgcgatccgcctgtattcgcgtgaggattacgagacccgtccgcgcttcaccgagccggaaatcctgcgtacctcgctgggtgccgtggtactccacatgctgtcggtgggcgtggcccgcacggccgaggacgtcacgaacttcgggttcatcgatccgccggatatgaaggccgtgtcggacggtttcaatgagctcaccgagctcaaggccatcggccgcaagcgcggcgaggtgacgctcacccataccggtcgtcagctggcgcgcatccccatcgacgtgcgtctgggacgtatggttatcgaggccgcgaaaaccggttcgccgaatcttctggcccaggtgctcgtggtcgtggcgttcctgagcttgcaggacccacgtgaacgcccggacgacaagcgtgaggatgccgaccgcatccacaaccggtatgcggatgagacctccgacttcctgacggccctgaatatctgggaccgcgtgttccaagcagacggcgacccgagcaacaacgcgctgcgccgtatctgcaaaaccgagtatttcagctggctgaggatgcgccagtggaaagatctcgtctcccaactacgccagatgtgcaaggagctgaagttcaaggtcggcgacccgctgcccgcctcccgcccaggcttggagatccgccagctgccgttgaatcagcaggccgcgcattcgctgtgctgcgcgtgggatgcggacggcatccacaagtcgatgctcgccggattgctgtcgatgatgggcatgcaggtggtgcgcgagcccaaggcctccgatttcgcggggctgaccggttcggcgcgcgcccgtgcgatgaaacgcgcccagaagcagtcgaagaacgattatcagggcgcacgcggcacccgtttcgccctgttccccgcttccgccgtggccaagaagaccccgtcatgggtgatgagcaccgaactggtggaaacctctcgcctgtgggcccgctattcggcggccatcgaccccgcgtgggccgaaccgttggccggccaattgacccgcaccacgtatgcggagccgcactggtcgggttcgcgtggctcggctgtggccaccgcgcgcgtgctgctgtatggtctgccgatcgtacaggaccgtgccgtgcagtggggacgcatcaatccacttgaggcgcgcgacttcctgattcgccagggtctggtcgagggcgatattcagcagcgtttcagttacgacgacttcgtgggcaaaaaccgcgacattctcgaggatgccgccgatgatgcgagccgcacccgccagctggcggataccgtgtccgacgaggatctgttcgacttctacaacgcggtcattcccaacgatgtgaccagcgtggccgatctggcgaaatggtggaagtccgagcatgaccgtcagccgaatctgcttgatttcgacccggacaaggtggagcgtctggcatccagcgattcggtgagtctggacgattaccccgaccattggcatacgaccggatcggacggccaacccatcgacctgcgtctgagctacgtgtacgatccggccgacccggccgacggcgtcaccgtgcatgtgccgttgaaggcgctctcgcgtatcacgcccgaccagttcacatggaatgtgccgggtctgttggatgagctgatcctgtcgatgatcaaggcgctgcccaagcagctgcgcgtccagttcgtgccggccccggatgccgcgcgtgcgattcgtgactggatcgacgagcattacccggatctgccgggctcgggctcgcagcagaagccgaatctgccgccggtggatgaggatggcacgaccgttggctggcccgatctggcacatgtgttcaccaaggcggccatcgccaccaagggtgcgcagattcatcccgaagtgttggggccggaactggtcgagcgtctttccccgtatctcagagtcacgttctcggtggagcagcaactgccggccggcaagcaccctcgtggacgccggcatgcgcgcggccccatcaaggtgctgggtgtgtccaaggatctgaaggcgctgcaacgcaagttcgccgcgcaggcggaggcgtcggcccgtcaaatggtcaagaagcaggccgatcaggctggagaacagggcaagctggtcagtcaggcgaacctgttgcataaggcgggtgccaccaccgagtcccgggccacgatgctctggcgtggcgcattggatgcgttgcgattgccggccgaacgcatctcgtcgcgctggctgggtaccgaggcgttgatgctggcttctgctccgtacaagtccaccaaggatctggtcgaagacctgcagctggccacggtcaaacggctgatgccgaatgtcgacaggctctcggacgatgaggcgttagccaatgcggtgctcgatgtgcgcgaagtgtacgaggacaccgtctatcaggtggcgcatgacgtgatcgccgtgctcaaggcttatgccgaggtcgacaaggccactggcggcaaggctgatctgccgatgctttcggtgttgcagtcgattcgcgaccatatcgccacgctcgtctaccccggattcatcgggcgcactcccccggatgcgctgaagtcgttgagccgatatttgagagccgatctgagccgactcaataaggcgaaaaccgataagaaccgtgatgtcaagtgggcttggcaggccgacgaggcccgtcaggtggttgataaggcgttggcccgtgccaaggcggagccggccggcccgaagcatgaggcattgatgaagcaggccgaacaggcccgttggatgcttgaagagttctacgtgtccctatgggcgcaggagcttggcaccaaggggccggcttcgctcaaccgtatcaagaaagcgctggcgtgaccggacggcaaacaagtcgccaggccacgcgccagcgcacgcgcaagccgtcatcacagcgtgggcaagtgcgcggacgcctcggcaatcggaacaggaaacgcaatcgtaggcacggtccgatcaatgctctgaagcgttcctggcgtaaggcgaactggccgacctgtatcaagatggtgctgattcccacggtggcggtggtcgttgtcgtagcgctggtggccgggctggttcgtttcacaaactggcgggcacaggttcgcgcagccgaggcggcacagctggaactgacgcgaacatacgatttcaatccgggcaatattatttcggatggtcagttcttcaacggttcggcgatgagtcaggccgaagtccaatcgtttttggacacacaaggcggctcgctggccgcgatgaccttcgacacatcgaacgagtcaggcgaaggcctgtgcacggactatacaggcaccaaaggcgagtcggcggcggcaatcatcgaccagtcggcccgcgcctgcaaggtgagccagaaagtactgctcaccgtgatgcagaaggagcagcatctggtcactgccgtcgatcccagcgactatcagcttatggcggcgatggggttgaactgtccggataccgccgactgcgatcccacctatgccggattctttcggcaggtgtatggcgcggccaagcggtaccgttactatctcgagcacgaggaacagtacgggtatacggcgcacaatctcaactacatccaatatcatccgaacgcggtatgcggcggcgcacaagtgtatatcgagaacaaggcgaccgccctgctctacatctatacgccctaccagccgaacatcgccgcactggccgccggcaacggtaccggcgattcctgctccagttatggcaaccgcaacttcgcgcttatctacaccagctggttcggttcgccgcgaagttgataacggcagccgaccgatcttgtccgattggactcggccaacactgtcagcgttcgacgtatggacgcagcagggtcgtgatgccaaccgccagcagcgaggcgaaagccagcagacacaggcagacggcctacacgcagtagatcggtcgaatgtgggtcaatggttccacgccatgacctttgtcggccagcttgccgccgtacaggttgctccacaggcaggcgcagccaggatgcccgctacccaccacaacgacacgccatagaaaaccccgccgatgaccaatcatcgacggggttcggcacatgtgcaacgcttgcgattacagcttcggcagatacttcttcagctcgtaaggcgtgacctgctggttgtactcctcccattcctggtgcttgttgtccaggaagtagccgaaggcgtgttcgccgagcacgtcggccacgaaatcggatttctccatgatcttcagcgcctcgtccagcgagcgcggcagcggctgaatacccatagcctgacgttcgccgtcggtgagctcccacacgtcatcactggtaggctcgcccaactgcatctgcttatcgataccgtcgagaccggcggccagcagcaccgagtaggcaaggtatgggttggccaccgggtcgagcgcacggaactccatgcgcgcggagttgcccttgcccggcttgtactgcgggatacgcagcagcgcggaacggttgttgtggccccagcaaatgtagcttggtgcctcgttaccgccccacaggcgcttgtacgagttgacgtactggtcggtgaccgcgcagatttcggccgcatggtacaggatgccggcggcgaactggcgggcggtcagggacatgttgaactcctgaccggcctcgtagaaggcgttggaatcgccttcgaacaggctcaggtgcgtgtgcatgccggaaccgggcgcgtcggccaggggcttgggcatgaagctggcgtgaatgccacgctccaaggaaatctccttgaccaccgtacggaatgtcatgatgttgtcggccatggtgagcgcgtccgcgtatcgcagatcgatctcgttctggcctggccccgcctcatggtgcgagtattccaccgagatgcccatttgctcgagcatgttcacggtggcacggcggaagtccatgcctgggctgcgcggcacgtggtcgaagtagccgccctcgtcgatcggggtcggggccttggaccagtcgtcctggctttcgaacaggtagaactcgatttccggatgcacgtagaacgtgaagcccttgtccttggctttggcgagcgtgcgcttcaacacgtgacgtggatcgccgagcgaaggctcgccgtccggggtcagaatgtcgcagaacatgcgggcggtaccttgcgggccaccgcgccacggcaggatctggaacgtcgagggatcgggttgaacgatcatatcgtcttcggacacgcgggtcatgccctcgatggcggaaccgtcgaagccgagaccctcctcaaacgcggcttccagttcggccggagcaatcgccacggacttcagtgttcccaacacgtccgtgaaccacagacgaataaagcgcacgtcgcgttcttcgaccgtgcgcagcgcaaactcctgctgtttatccatagtcgcctatcgttccataaccgtgttacgaagggcgttaacatctcactgttcgtcacctgcgagtcgcgagatttcatcaacatgccccggtccgcatgtcaggcatggttcaggcccatgccggcacggcactatggtagtgactatgagcgaagatcatctcaccccatccgccaatccgcccgtcgacgtgaccagctggacgcaggccaccgacccgcgcgaccgttcgcgcgccggcatcgccactcgtaccaaggcgccgctggacgcacatgccatctggaaggtcaaggagggccggcgtgaggcgatcagccttttggaggagcagtccgcgattcgcgtaccggatctgattccgctgcgttacaagcgtatgagcgccagccccttcaccttctaccggggcaccgtgctcatcatgaccaatgacctggcttccacgccagtcactggcattccggtgcagtgcgtgggcgacgcgcatatcggcaatttcggcattttccgctccccttccgcccgtctggtgttcgatatcaatgatttcgacgaaaccgctatcggcccgtgggaatgggatctgaaacgtctcgccgcctcggtggagatctgcggacgcgccaacaaaatcaaggagaaggaccgtcgcgccgccgtggtccagtgcgtacacacgtaccgcacacgcatgaagtggttctccgaaatggattaccttgacgcgtggtacgagcacctggacgtggaggagacgctcgaccgcttcgagaccaccggttccaaacgcagccgtgtgctgcgcgaggcggccatgaaggcgctgctgaaggataacgacgcggcggcggccaaactgtgccgttatgagagcggcaagctcaggttcaaatccaatccgcccgagctggtgccgatcaatcagctggatgattacgccgacttggatgcgttgcaggcacgtatagacacgctgttcgagagctaccggcattccctgtacgacgatcgccgttgggtgttcgatcatttgcgctatcaggatgcggcccgcaaggtggtgggcgtgggctcggtgggccagcgcgcgtggacgtcggtgtggatcgcgcgtgatatcgacgatccgatgatgattcagatgaaggaggccacgtattccgtgctcgagcattactgcggcgcgtcgccgtacgccacgcacggtgagcgcgtggttcaggggcagaagctgattcagaatacggccgatgtgctgttgggttggtcgagctttatggccgaggatggccgaccgcgcgactattacgtgcgccagttgtggaatggcaaggggtcgattgatatcgacaatctcaacgcttcgggattgagcgatctgtcacgcatgtgcgcatggtcgttggcgcacgcccacgcccgcaccggcgattcgattgcgatcgccaattacatgggtggcaccgacgaattcgatcaggccatcgcctcattcgccgtcagctacgccgaacagaatgatgaagactacgccgtcttcaaaaagctcctcaaatccggcgacctcccttgctgagccgttaagcggacagcccattgggctgtccgtaggaggggtctgagtgaagcgatagctgagcgaaggtagattaacagtctcgctaaggcgagtcctttgcctacttcgctacttcaagcgcttcctggagcgtgaacgcacgtgcatagagggacttgccgaggatggcagaatcaacaccaatttcagccagttccttgatggcgcgcaaatcgtccagcttggagataccaccggaagccgtgaccttggcgtcggtgcgttcagcgacttcactcagcaattgaatgttcgggccggacatcatgccgtccttagccacgtcggttaccacgtaacgcgagcagcccacggagtcaaggaacttcatggtctcaaacaggtcgccgccttcgcgcgtccagccgcgcgccgccagtgtgtgaccgcgcacatccagaccaacagccacgcggtcgccgtacttcttgatgaccgaggcggtccaatccggattctccaaagcggcggtgccgatgttcactcgggcggcaccggcctcaagggccgcgtccaacgaagcgtcatcgcgcacgccgccggacagttcgatgttcacgcggtcgccgagctcatgaacgatttctcgcagctgatcgcgattgttgcccgtaccgaaagcggcatcaaggtcgaccaggtgaatccattcggcaccggcctcaacccaagtacgggcggcctcgaacggcgaaccgtaatcggtttcggaaccggattcgccttggcgcaggcgcacggccttgccatcgcgtacatcgacggcgggcagcagagtcaacgacataagaagagcctttcttcagttacttatacacaatttgagctccctcgtcagagggagcttcatgcttttttacagcgtggcgatccagttcttgaggagctgggagccagcgtccccggacttttccgggtggaattgcgtggcggacagcgggccgtgttcgtaggcggccacaaagcgcgatcggccgtacgagcaccagctcacgcgttcgggcgaatcgctcagatcgatgtcgaagcgggacgtatccgccggcttcacttccatcgcggcgtaggagtgcacgaagtagaaccgttcgttctccacgccgttgagcagcaccgaatcgggggcggcctcgatcgtgtcccatcccatgtgaggcaccacgtcggcgtccagcaggttcaccgaaccgccgatcagtccgatgcctgcggcatgggcaccgtgctccagaccgtgttcgaacatgatctgctcgcccacgcacacgccgagcaccgggcggccagcgcggatgcgatcatagatcacacggtcgccgtcgaccttcttcagtccttccatacatgcggcgaacgcacccacgcccggcacgactaggccgtcggcctccaacgactgccggtagtcggaggtgagggtggtgtcgacgccaagattggcgagcgcacgcaccatggaacgtacattgccgaaaccgtaatcgaaaacaaccgctgtggtcatctgctctcctatcccctactggtttggttggcgtctattcgatgcgggagccgcgcccgccacgtccgcgcctagtgtggttggcgagaatctgcatcgcctgatcatggtcgagtccagcggaatccaccacttcgaacccttgggtcttgagttggttcagggttacgatgccgagcatcaggtcctcgacgaagcgcggtgtggaggtgaacagcacgggcggcgcgaaactctggccggcctctccctgcacgtacatggccacttcgagcttgtcggcacggttgactgcaagaatcacggccatgccggataccacggtggtcaggtccttggctgcggcttccgggccgtcgccgttcagattcttcagcaccgcgacggccccctgattggcaccgatgcatgcggcggagatgtccgacagctggcagaacgcggccaacagttcggcggaggcaagacgggtaacgatcagcgccaccttcgccttgttacccaacagtccagcgagttcgttgtcgaagccgagcgaggggtcgaccacgtcggccatggcctcgttcaccgcatccgcaacggacccggtgacgtcgtcggtcataggctggccggaatcagcggaagccttatcagccgtatcatcattcgcgtcggaatcggacttcgctgaagcagcgtccgctgttttatcggcatcactggtatcactgacatcgccggataccgaatcgtccgcgaattctttctcgaatccggcgagcgcagcctcaagctcctcgtcggagaagtgcgattcgtccggatcgaacttgtcgtcggtcatcacagggctcccttggtgctgggcacgccgtctacacgcgggtcgatttccacggcgaagcgcagcgcacgggccagcgccttgaattcggcttcagcgatgtggtgcgggtcgcggccggcgagcacctgcatgtgcaggcagatgccggcgtggaaggcgatggattccatgacgtggcggaccagcgagccggtgaaatggccgccgatcatgcagaattcgtagccttcgggctcgccgctgcacacgcagtacgggcggccggaaatgtcgaccacggccttggccagcgcctcgtcgagcggcacggtggcgtcggcgaagcggcggatgcctttcttgtcgccgagagcctgcttcagagcttcgccgaacacgatggccgtatcttccacagtgtggtgcacgtcgatgtcggtgtcaccgtgggcgtggatggtcaggtcgatcagcgaatgcttgccgagcgcggtcatcatatggttgtagaacggcacggatgtatcgatatcggttttgccggtgccgtcgaggttcagttcgaggtcgatgtgtgattcgctggtttcgcggacgatgtgcgcggttcttgccatcatgtctcctgtgtgattcgtcatattggattgcggcgggactcgaatcgcttcgggtctcgccgcaatcggaaagaaacgtcccttatgctgcttccactatacgaagcacttcaacaagggcgttacggaaggtttccatctcctcgtcggtgcccatgcacacgcgcagccaaccgtccggtccgaccacacggatgagtacgccgcgcttcaggagctcgtcgaagatggcttcacgcttgtcgaagtgcccgccgaacagcaggaagttcgagccggattcggccacttcaagcggctggtccttgtaggtctgttccttgagccatgcggcggtggcctcgcgggtttcgcgcaggtgctcgacacggctcagctgctcgtcggtgtgttcgaaggcggccagtgcggcggcctgggtcacggcggacaggtggtacggcatacgtacgatgcgcacgcagtcgatgatacccttggatgcggctaggtagccgactcgcgcgccggcgaaggcaaaggccttgctcatggtgcggcttacggccaggttcgggtggtccttgatcaggctcacggcgctcggggtgccgggcttgcggaattccacgtacgcttcgtcgatgacgagaatcggatgcacgccctcgcccgcgccgaccacttcagcggtttcgcaggcggcgagaatacgttcgatatcctccatcggcaacggagtgccggtcgggttgtttgggctagtgagcagcaccatcgagggcttgacctcggcgatggcctcaagcaccttgtcgacgttcagcgtgaagtcggcgttgcggtgggcgagcttccaaccggtgaaggtgtcgcgggcgtactccgggtacatggagtacgtcgggtcggcaccgagtgcggtgcggcccgggccaccgaaagcctggaacagctggagcatgatctcgttggagccgttggcaccccacagctcgtccacgtccagacgggtaccggattcgcgggccaggtaatcggagaatgcctgacgcaattcgatgtgctcacggtccgggtatcggttgagtgtgggggcgatttcacgcacacgcttggcgatggtgtcgcatacggccgggtccggcgcatacgggttctcgttgacgttcaggcacaccggcacgtccagctggggagcgccgtacggctcctcaccgatcaggtcgttgcgcagcggcaggtttgcaggaatcgagctcatcgcagaccggcttccttctcctgctcgcgcagggtggccttgtcatacggatccttgacgaagcgggagagcacgcactcgccgtgggcgggcaggtcctcggataccgcgaaggcgttgatgcgggcggcgagggccttgaggccttcctcgtcgtattcgatgacttcgaccggcttcatgaaggtgtgcacgccgaggcctgcggcgaagcgggcggtgccgccggtgggcagcacgtggttggagccggacatgtagtcgcccagcggcaccggggagtacggaccgcggaagatggcaccggcgttcttgatgcgcttgacgaccgcatcggcatccttggtctgaatctcaaggtgttcggcggcgtaggcgttggccgcgtcgatggactggtcgagaccgtcggtcagcacgatggcagactgggtgccggacagcgacgtgtggacacgctcggcgtgctcggtacgcggcacgcggtacttgaggctctcctgcaccttgtcggcaatctcggtggagtcggtgaacagcacggaaccggcgagctcatcgtgctcggcctggccgatgaggtcggcggccagcaggctcgggttggcggtttcgtcggcgatgatgccgatttcggtggggccggcaaccgcgtcaatgcccacgaatgcggagaccagcgacttggcggtggccacgaagatgttgcccgggccggtgatcttgtcaaccggatcgcacaggatgtcgccgtcctgcggctcgctgcccttggcgccgtatgcgaacatggcaatggcctgagcgccgccgaccgcgtatacctcgtcaacaccgaggatggcgcaggtggcgaggatggtcttgttcggcaggccttcctcattgtcgcgggcgggcggggtggcgatggccagcgattcgacgccggcggcctgggccggcacagcgttcatgatgacggagctcgggtagacggccttgccgccgggcacatacaggccgacgcgctgaatcggaatccagcgttcggccacgcgggcgccttcggcgaggtcggtgtagaagtccttcggcacctggttggcggccacggcgcgggcgcggcgcaccgattcctcgatggcggcgcgcacttcggggtcgagcgtggtcagggcgtccttgatcgcctcgaccggcacgcgcaggttcttgggacgcacgtgatcgaacttctcctcgaagtcgcgcagggcagcggcgccgcgttctttgacatcgtccagaatcggacgcaccaaatcggtggcttcggaagtacccattgcagcacgcggcatcgcggcaagcagttcggcacgggacaggttctgaccacgcaggtcaatgattcgcatgatgttctcactcataacgccccatcgtagcaatgtgcgaggcctaagcggcgaggaacgcccatgttcacccgtatcgtgagattatcgtgcgtgatgtgggttcgtgatacaggttattgacgcacgccaaatgcccgagcggtctcatcgataatcggcatgtcatgcacggcgacgtgactcacttcggaccatcgcgggccaatggctaattgctcaaccaaggcttgcactgcgtcgctgctgccttgtgcttccagctcaaccgagccatcgcggcaattacgcacccagccctgtacaccaagccgacgtgcctgagtcaccgtaaaataacggaatcccacgccttgcaccagtccggtgaccactatatgtttgcggaccaaattcgccgattgcctcatgatgctcagttcctaatccatcgttcgcagcattgggtagaggctcaggaatcgccggtatgcgtcggcatatgtgcgtgcggtgtcaggattcggctggtatacagtgcattcgcatactgattgcagcaggtctggtacattgaataccaacgaggccattgccactgctggcagaatatcggcattggcgaacacttcaataggatgctccaacacatcggccagaatctggcaccacgcattttctctggctccgccgccaatcagggaaatctcggtgggtttggcgtcaaaactttccataccttgacgaatggagaaggccacaccctcaagcgcggcacgcatcatgtctgccttggtggtgtctggatcgaggcccacataggcaccgcgaatattcggattcataacagggaatcgctcccccaccagatatggcaggcatagcacaccgttggagccgggtttggatgtttcgataagacgatgcgcctctacgtaatcgccatcagcgaatacgccggtaacccatttatgcacgtcaccggcgttgaggaatggtacggcattcacgaagccttcttccacgccaaatgccagattcgcagcacctggcttgtcagtgaacggctcgggcgaaacggtggcgatccagcctgaggtgccgatattgatgttgtattgaccagggtggctgacaccgctggcaagtgtggtggcacccgcgtctccaatgcccgcgtataccgcagttccggcggaaaaaccggtgcgttgtgcagcggattccgtcactgtgccaatgttgtcttgcggattgtgcaggtgtggcaatatggtcatgtcgattcctgcgacctcgcataattcggcattccactggccattacggatattcatggccccagctgtggaacacgccgccacatcgtccacgcattcgccagttaattgggcgatcaagtagtccttggaactgatcaatacatgacgaatgcgcgcgtacgtttccggctcgtgttcacgcagccacatcaacttgggcaacggcaagcagccttcgagccggttaccaacggtgttcaggaaacgttctgcaccgccctgatatgtctcggcgagttgcttggcctgttcctcggctcggccatccgaatacagaatggcattgcggacgggattgagctcgccgttcaaagcaataacatcctgcatctgaccgctgaaaatgatgccacgaatgcgagtcacattgaattctgactcggattgccgcgcctgctcaatcatgtgcctggaggccgagcagaaagcttgccaccattgatcggggctctgctcccgatagtcgccgttgataataaggtcaagttcgctactcgcactagctacaatgcaaccctgcccattaactaaggcacccttcaacgccgtggtccccgcatcaaatgcagccacatattccgtagtcatatcgttcatcgtagcgctgaaaaaagaatcattctttgccagcaaaacgcggcttattgcatcgtcttgtttctagaatgggaaattgaacgaatactacgactagtgaggcattatggcaattcaatcgacaatcatgctgaacaacggcactgtcatcccgcaggtgggcttgggcgtattccagacaccggatggtgatactacagtgaacgcggtgcagacggctctggagaatggctaccgccatatcgataccgcaatgatttaccacaacgaggcttcagtgggtgaaggtattcgccgtgctggtgtgccgcgcagcgatttcttcttgaccaccaagctgtggaatgacgatattcgcgcacgccgcggcaaggatgcattccaagaaagcctcgaccgcttgggcgtggattatgtggatctgtatctgattcactggccagcagacggctggcagcaggcatgggacgacttgcaggagatttatgcctccggccgcgccaaggccattggcgtcagcaacttccaaaagcatcatatcgatgagctactgacccatagcgatgtggtgcctgctgtagaccaggttgagtcttccccacaattcaccaatcaagagcttattggccagcttcgtgccaagggcatcgcaaccgaggcgtggagtccgctcggcggcaccggcggtaacctactcagcaacccagtactggccggaatcggtgccaagtacggcaggtctgctgcacaggtagtgattcgttggcacatccagcgcggcatcgtcgtgcttcccaagtccactcatgccgagcgcatcaagcagaacttcgaggtcttcgacttcaacctatcggtcgatgatatgaccgccatctccgccatcaacaccggcaagcgcaacggtgctgatccggacaatttcaatttctagacctttatcggtccagatacgcaaagtggggactctccgtcattggagggttccctcttctatatgctttcgattcggccacaccctaggtgcgagagcctatgtcttgtcggtgtcttgtcttgttggtttcgggtatgcgaaagccccttggggcgtgtgctccgaggggcttcctgtacgtgtggtgcggcggcgtgctactctcccacaccctgtcggctaaacccgaaaaatcatcgtgactaaacccgcaacaactaattgaacacaaacaccttgatgcccttgccgtggacgagcaggcgcatctcctcggggttgtcctcgatgtcggtcgctatgttgatctgcgccatctccaagcgtcgcaggcccatccacgcgccgaacatcacggccagcaccgcgtcctcgtcctgtgacttgaggtcttcgttgatggcatgctccgggcagatcagcccgcccctgtgtgtttctgcaaattggcgtccacagtatgggcactatttttcagcagtataggcggctggtttccagcagaaactgcgtcgtcgggtccgccgcctttttcttggttatctggtcatgagggcgtgctcgctgcggtaggagcctccctcgaatctgatgagcctgccgtggtgcacggtgcggtcgatcagcgcggcggccatgttcttgtcgccgagcacgcgtccccagccggagaactcgatgttcgtggtgtagatgacgctccgggtctcgtaggaatccgatatgacctggaacaggagcctggatccctcctcgtcgatcggcatgtagccgaactcgtcgatgatcaggagcctggccttggcgatctgccggagctccgtgtcgagccggtcctcccgcttcgcgcggcgcagccgcatgagcagcccggtcgcggtgaagaacctgaccggtatcgcgcgcatgcacgcgagcctgcccaacgcgaccgcgagatgggtcttgccgatgccgacgggcccgtagagcacgaggtcctcgcaacggtctatgaagtcgagcgtctcgagctgcgcgcgtccccagtcggcgggcatgcgcaggttggaccagtcgtatccctcgatgtccttcgcgttcgggaatcccgcggccttgaggagccggacccgtttcgaccgctccctggaggcgatctccgcgtcgagccggctttccatcagatccggctggacgggcgtcgcccgctcgatggcctcggcgagcacgtcccgggtcaacggcagccgtctggccgtctccatgatcctcccgcatctggcgatggtgtcggccctgcgcctgcgtgccgtgttccgtccggtcgcgtcgttcatcgttccgtctcctttccgccgttcccggtgatgaaccggtcgtatccggccaggtcgggcccgtcgtcggtgatggcgccggcatcggtgtcgcgtgcacgcagggcgagggtgacgagcgtggattcgtccaatgccgaacccggcccgtcggctatcgcccggctcgcggccgcgaccgcgttgccgaaaccggcggccgcgcatgccgcgcctatcgatctgaggctctgcgcgaggcgtttggaatcggcctcgtcgagccatgcgcgcacgtcctcggggaaatcggggcgtatcgacgattccctccaggatccgggtttggccgcgagcacgggcatggccagttccggatcccgcagcgtggactggctccgtccgtatacccgggggcaccgcgcgacgatctccccggtaccgggatcggtgatccgcacgccgtcccggcggatggcggccaggagcgtccttccgtgcagcgcggcgcctgcgaggtaccggttcgagtcgatgtctatctgcccgtacttgtcggccctgcggctctcccatctgatcgggtcgaacgtggtggaaggcagcggcatcagcgccgcgcgatcctccccgaacacgtccccgatggcggtgcccctgcggtaatgcctcgacgaggcggccagcgcatcgcatctgtcgagcatgatccgtccgagctgcgcgtgggtctcggcctccagcggcgggaccatgaggttgcggcggaggaacccgaccgcgttctccaccgcgcctttctcccaaccggaataggggtcgcagaacctcgcgtcgatgcggtggtgcgcgaggaacgcgtcgaacaccgcggcgggcgtcacctcgcccctcgcgttcctgcgtcccgcgccggtggcgttgtccatgacgatcacgggagggacgccgccgatgtgctcgaacacctcgaccagcccgtggcacaggcattccgcgttctccccgggcaggctcgtcacgtaccgcatgttcgaacgggggaacgtgacgaccaggcagtggtcgtccacgagctcgccggcgatgcgggccttcgccacaccgaaatcgatctgcgcgacgccgggcgcccagacgagctcgccgtacccgtcggaaccgctccggttcgcctcgcgccagcgtctcacgtaccccggcgtcgtcgtgtactcgccgtcgtagccggtctccgcgcggagcctgtcgtgcacgcgtctggcggtatggcgctgcctgcgcggcagcatgcggtcggcctcgagccattcgtcgaccaacgccgcgtacgggtcgatcttggagccccggcgcctgtccatgggcggtttcggggtcatgtcgtccatatcagcgtatctcgcgaccgtggcgcggtccacgtccggtctcctcgcgatctccgacctggacactccctgacggtccagtctcctgatatcttgctgtttgggcatcggtatcgccatcgtcctttccttcccgagcgccgccggctgcaaccggtggattcgttttctggttacgtctcgggaatatacaggcacggcggaccggtgcctgtcctcgtctgggcggtcatatggtgcagttcctgctggaaaccggcagcccatactgcggaaaaatagtgcagaaattgcttaagaaaaattgaagcaaaacacgcccctggggcgcgtggggatgacgggcacctcgtcgatgggattgtggtcggcgatccggtgcgcgaccgcccactggtagaagaccttcacgcaggcgcgcgcgttacgcttggcctcaaggtccatgctgctttgcaggaagaacgcgatcaccgcgtcggcgtccacctggtcgatgggcctgtccacgatcctggaaaagcgcgcgatctgataccatctagttctcagagtctccggcgtgcgtccgatcgccagcatgcttgacagccattgctcgacgctttcgccccagtcatcgcgtggcctgacatgctcgcagccgtagctgttcttgtttgtccagttccttgtcatgatgctcccttgcataagaagagagagggaagcgcagtggcttccctctctgcgaagaacgatggttatatagtcgcccggggccgccgggcggggtcttcaattctatgcgtgcgcctcggcgcggggaatcgggaacatctcttcgaccgaatcagggttcaagtcttccatcagctcggcctcccacatgacgaaatccgcgatggcggtatcatcagaggcaagggtaactgaagcgcctatggcagtgagagctggaactgttaatcggacggtcgctggttcaagcccagccgcaggagctcattggaagccatcggcgtgttgccggtggctttttctgtatttatatccatgagcatctgatcggctttcttgtttccgagcatcatgcgcataatcgcatcgttagacagttcgtccaccgtagtgtcaagatattccgcagccaaaagaacctcttcaaatcgccagtttgcgcgagagatcttgagggacataccggaaggctttatcccgagatagcttgccatctcagtttgatttttgccttctctcgcttgtgcggccagaagctgctgaacgttgaaagaaacgacttttaacttgtatgcggctcgcgccttggggctgacgcccggcattgtttcaatactggtcatttttaacctttacaacaatatgtttacctgttgcaaaatatattacctctcgatttgcgtttagtgcaagtttgtcgtacactttttgcaggtcgtaaaaagtattacaaaaatggaggctggaggtgtgtacgccgatgaatgattggttcaaagaacgcggtatcggccaagagcaggtcgccgccactcttaacgtttccgtctcgaccgtttcacgcatcgtcaactacaaaagagacctcagcatgaggcgtgcgatgattctgcacactgagtatgggattccttttgacgttatgtatccatctcaattgagcgagggtgagggggtgtttgtccgataaggaaatgcccggtctcgatctggtacatcgaaaccgggcgtatgcaacacatccaatgttgaacgattccctagtcgccaaacttttgaatcgttcgcattgccttttagattatggaggctgcacaaatgtctagtgtaaccgaagtcgctgtgccgacttctgattttgatggtaacgcccccgtgaatagttcgcggtgcatggcgtctacattttccgaatccctgtattggcgacgctctgcccggcgctacgagctggcgggtcttgccgcttcgatgctggccgcgttgtcgtgcgtggtttttctggcgattctgcttgccgcgaggaatctgcttctgccgggattcgctttggttccgatggcctgcggcctggcttgtgtgggttgctggtgcgaccgtaactcgcgcgatgcctgggatttcgctttctggtcccttcacgcggaggtgaggcaatgaccatgaccgttggcgcgcgttccctcgataacgaggagcgctcgaatttccgggactacatgtccctgttgtccctgtccgtggatgcgtcgatgaccgtgagggagatcatggcggtcgcctatctgatcggccggcatgacgcgcttcgtgacgtgcggaacgcttcgtcgccggctcggacggtgaaccgtcgtctgatccatggcggtccgtcggattgcgtgttcaatcgcggctacgaggccggtgcgggcatggtgtccgacaagatcgacgcgttgatgcgcgacgtggaggccctcagcggcgatgacgcggtgttctcgatgctcaggcatccttcggtgagcgggggtgatgaatggtggaattggtgatcctgctgttcgtggtgctcgcagtggcctgtttcggcctgctgctgccgttcctgcgtctggcagtcggcatcgtgcttctcgtggtccgtctgctggcctccctcgcgcgatcaatgggggcgggccgatgatgcacctcatactcgtgatcgccgtcgtcatcattctcgccgcgtcctatctgctgacgttcgccctgtgccgcgcggccacgcgccgcgacatgcttgaggcccgttggcgtgaggagtcggccggttccgtgagtgaggagagccatgagagcgcatgaaacgcatgagcgtgccgcgcgtcatggcggcttcccggcccgtggttccgcttcgggcctgttggcggcctgcccgtcggacggcagccacgacttctacctgtcgatgatgctcgacgttcccgtgccgcgcgtgcccatgctgcgcgcacgtctgcaagactcccgccgagggggtgccgcatgagcgtgaacgcggtcgattgggcgctcaggttcgcgcccgtggacgccaggcacaacggtgccgctcgcgtgctgatgtgtctggcgaacgtggccgacgacgaggggcgcaacgcgcatccgacgcacaggaagctggccgcgtggtgcaagtgcagcgtgagcacggtcaaacgccacctgtcatggctggaagcgaacgggctgatccgtcgcggcgaccaacgccaggccgggcatttcagcgagtggcaccggcccgtcgtgtgggatctgtgcctggggaaccgtctggagctcgaccccgacttcttcgactcgaacgacatcgactcgacccgaggcggacggccttccacggaaaacagggcgaggggaaaccccggctcacatgtggaccgtggttatggcgacggggacacgggaaaaccccagctcacgggtgaaccacggttcacagctgtgaccccacccccagctcacctggtgagctacagtacgtccctagtacgtaataacccctctgcccctacggggcatctccccgcaagcggagagacctccccggacgatgacggaatccgcgaggacggttcatgggccgacgccgccggagccgaacccccgagcagcgaatccgccggggctggttccgacgcggaggcggtgtgccgcacgatggcggacgggctgcgcgccatgccgccgatgccggtgcccgaaccgttggcccggcccggcaaacgcgaactcgacgccgcccgacggctgatcgcccgccacggcatgccactggtgctggccgtggccgaatgggtgtcgctgccgccttccaagaccgacaagggcgacgcttccggcaaaccgtatgacggtttctggcgtcgcacgctcaccggcccgcgttccctcgcacggcactgggaccaggtatgcctccagatggccgacgacccccacgggcgtcgcctgctcgccggacacggcatcctcgccgacaagggcgaaacggcgcagccgccgagcgcggaatccacgccgaaggtgccgaactacgggatccccgacaacctggaccggcgcgtgtggaaactgctcgacccttacgacttcgatgcgggcaatgacgggttcgaggcaccgcgcaccctgcgccggctgttgaagcgcgtccccgcgaacgatgccgaaggcgaacgcaatgccgtgctggaggcattgcgggcgggccgcgccttcctggacgcggtatccagggagaaggacgacggcttcgggcagcggaagccggccgagaccgggccggcgtccgtccgtttcggcttcatcggcggccgtgggccgaaggaggtgccggcatgttcctgaagggagaatgcgcggatttccccgactcgtggtcggaccgcatgtgggggcccgacgacctgcccaaccagcgaacccaatacgagctgcgccgcgcggcggtgcggatctgcgaggcctgcccggtcagtgccgaatgcctcgcgttcggcatcatggtccgggaccagtacggcatctacggcggactgccgttgagggcccgacgccaggtgctgaagaccgcgcgggaggccggattccggttcgatccgaacgacccgaacgccgaacagcgtcttgcgcgattcatccgcgcgaaccccgagatcgtggcggcggcacgcgaacgcgaatgcaagcgccgcaagaccgatcagcgcaacgcgcgccagcaacgatggcgcgccaccacacgctcgaccggcaaggcgaaggccccggccgccacacacaccccgcccttgcaggacaccctcttctgaagacaatccgatacagataaccggtccggccccataaggacgaaccattccggaaaccggtatacgcggcaaaccgtggaaccgtgcacccgtggacacgggaagccggaaacccgaatgaaaggaacaatcccaatgaccacgaacacgaaaacggtggccttcgtcaacctcaagggcggggtcggcaagaccaccagcgccatcggcaccgccgaagcactcgcccgactgggccataccgtgacggtgcgcgacgccgacccgtccggcgcggcgaccctgtgggcgcacaaggccctatcggccggccgcccactgcccttcggggtggaggtcgtcaaccggttcaccgtcgccgcgcccgccgaggaggaatcatggagatcaacaagccgatgaccacgaggaacatgctggcatcgaccctcacggactatcggaaaccggtcaagctgctcaagatgcgaggagatggagcgccggctctccgacatacgcaaggcgaacggcgggcacatgttcgccggggcgagggcgggatcatgacggcccaggctccctgcgcgaagatcgcgcggcaagacccggacctcgcggatcgcatgtgggcgaccattacggtgggaggccgtgaggtcgtcgatgccgagaagcgcgcgctcgggcgcagggtgtgcgagacgtgccccctgcgaaccacctgcatcgccgacagtctcgtcggcggatggaaggaccgcaacctcataggaggtcttgactacaggcgtcgcacagtactctcgaaactggtctgccgagacctcggcatcacggcgcgccagctgcacgacatgcccgcgcaacgggtgagcgactggcttgaaaggcatccggactgggccgaccgaatcagactggcggactccagcgactggcggcagcgcaagcgcctgcaacgtcgcaaacgtgaacgcctgtctgtcgcgccgagcttcaccgacgcgacgccggttccgccggccatccaaggcgtcctgttttgaccacgccagaattaccggaataccgaaaaaccggaataccgaaaaaccggaataccgatacgaatccaacaccgaaataccgataggagaaacaaccatgatcgtgaccatcgcaaacgccaagggaggcgtcgccaagaccacaagcgccatctatctcgccgccgcatacgcgcggcgcttcgaggagggggccacggtgctcgatgcggatccgcagtccagcgcgagcctgtggagggacatggccgaggaaaacggcgggtggcccgcaggcaccgatgtgatgccggcgaacctgagcacgctccagcggctggcccgtgccgggcatggcggcttcgctgtggtggacgcgccgccgcagggccggctgttcgaggaaagcgtcaaggccgccgacttcgtggtcgtgcccacctccgattcgcccattgatctgcagcaggcgtgggcgacgatgaacgcgattcccgatggcaagcccggtgcggtgctcatcgtgcgcgccgaaccccgcacccgagccttccaggcgaccgtcgccgctcttgacgaggccggcacgccccgtttcgacgccgttgtgtgcaagcggcaggacatcaaggccggcatggggcactcccccgacaagctccacgagtacccccaggtgctcggcgagatcgtcgaagcgatgggggcgcgcgcatgaggaacctcgacatggctttcaggcccgcagcccgcacccgcagcgtctccggcatggccgacgtcttccgctccgatcagacgggggaatggtccaagaccagcgtgagcatgaggcccgaaacgcggcggcggctcaagacctacgccgccgcgcacgacatgcgcatccaggaggtcatcgacctcgcgctcgaagcctatctcgcatgacgcgagacgccgtgcgaaacaagcaggtgcccgaaccggaacggtgcagagcgccaccggcggcggcatgaacgcgcggaaaccggcaaccccggctccgacagagaatgaccgaaataccgaaaccggtaaaatcggtgcataccgaaacgaacgatgaaaggacacgaatgaaaacggaacaggaaacggaaaccaacaccccgccgcccacgaacggagaaaccgccgccgtcgaggagtcgaggcgtgttcggccgaagtggctggtgccgctggtcgcgggcctgtgcgcgctggcgcttgtggtggccggcggcatcggatggaaaatatggtcggaccgccgactggccgaggcgaaggccgcgtgcgccacggcctccgacgcggcgcgcggcgcgatgaacgactggaacacgctcgtcaacggcgacgcggccgacttgctggaggtcaaggccgatcaggtgaaggacgcgaagaccatcgacgcgctgaaaaccgcgctggacgtggaagcgccggaatacgagggctgcgtggccgacggcaaggacgggcttgaaacggcgatcgacgaactggacgatgcggccgcatggtacgagaagcacaccgggagcctgaagaaggcggtggacgcggtgaacgactcgaagctggcgaagaccatcgacacggcgaaaaccctgttggagtccagcaacggcaacgtgcaggatgacaagacgcgcgaggaactgtccaaggccatcgaagccaaggacgaggccgcgatagccaaggcatccaaggcggtgaacgattccatcgcggcgaagcagaaggccgacgaggaggcgaaagccaaggcccaggccgaggccgatgcgaaagccgccgaggaagccgccgccgctgcgaacgcccagacgcaacaacagcagtacagctatcagcagtctcagccccagcaatcctggacaccctcatacccctacggcggaggctccactggtggcggaagcggcaccacgggaggctccacaggcggctccgccggttcctcctacggcgggagcttcggctacagcagcagcgataactttggaggtgctaggccgggcggaacttgcccggagagcgtgtgcggcgtctgacttgctgacatgcaggcatgaaactcgtccgattcgttcgggcgagtttttttatcattcgcttcggtatgcaccgattttaccggtttcggtatttcggtaaataccccgaatcatgcgttttaggcgtttcccctcctcgtggtcaatatctcgcgtaactgatcggaaaaaatgtccaaactggaccggccgaaatggggttctaatggtttgtggccggagttttccggactccggctaccggcttttaggccggtcggaaacaagaatctaacaggaggaaaccctatggttttcaacgaaaggaaacgggctgatgcccgcaacgggaaggggctgcgcgtggcagtggccgctttgactgcggtggcgacgctggccggcggcggcatggtcgcggccaccgcgatggccgacggcggcggcggctgggctcccggctcggatggcagtatcggcggcgcggtgatcggctgggcctatgaggacaacaacaacggcggtttcggcggcgctacccttgacgcgttcaagaaggccgtggcgaagatgggcgcgacctataacaactacaacggcgtggccgatgagaaggcgaacaccgcgatcacgatggccaacaatgaatgcgtggcccgtttcaacgacaagcatccgggcgagaccgcgaactgccgcatggtcgccgtcggcgtggtcgccacgcccaccacgcactcctattccggcgaaggcttcgccaccgcctcctattggagcgacgcatggaacaaaaacatcgcaccgggtgtataccgcaataatggtgtgtcttatgacactaatgacggtttctctgatgctcctgagcgttcggtggactcgatcgcggcctcccagtggaataacaacccggttgcgatcgtcatcatgttgaaccaatacgagccggtgcagccgaactatcacttgagcgtgagcacgcaggctgcggagatgtcgggccagtcgggcgacaccaaggatgcttcggacacgatcaccctgtccagcgacgggtcgaagaccgagaacgtgaacggcaccgcgaccctgcactggcgtggcattgacggcaccgagaagacggtggcgaagcggttcaccgcatccaacaagggcagcgtcacagtgagcgcgtccttcaaggacatggacgcctcgtgggagtcgtggcctgcgggcaagcgctggtgggacgttgacgtggcgaagcagggcaacatggccgaggcggtctcccacaagggagagaacgacggcaaggagtccggcgagaagaccaccaccccgcccgagaaatggctgaccaacgaggccggcgacacgctgacgcaccgtcatgacgtgcccgtgccgtcccatgacgtgccgtcccatgacgacaacgactacatcgacaactacatcgcctccggcagcctgtacacggctcacatcaaggcgcattccaacgcctccggcaagttctggatctatgacttcatcgtcacgaaggacgtggtgatcggcggcaccgacaaggacgacgtgagcaaggtcaacgtgaccgacgcgaacggcaacgtcgtgccggcggacatttccatcgacgattccatcgacggcatgcgcgtggtcaaggcgcacgccaccgccccgcactccggcgaatacacgctgaacgtgccccagtcggccaagccgaccggcggcgactacgagatcgccgacggttccggggcgtgctggaacggcgacaacggcaccggcagcctggccgacggcagcctggccgactgccagggcggcaacggcgacagcgtgggcaaggtcacgccgaccccggacaaggtgtgggtgctggacgagtccggcgctctcgtggccgaggacaaggattggaccaaccagcagggcgtcgatcagaagactttcctggtggacgaccaggtgggcgcggtcgtcaacggcagcatcccgagccacttgctcaacccgctggcatcctattccatcaccgatgatctgaccggttcgatccagtggatcgactggaagtccggcaaggtgttcgtcgacggcaaggacgagaccgcgaacttcaccatcgcgatcgaccggaaggccgggaccgcgaccgccaccgcgaaggcttcgtacatcgccaagacgatgttcaagaacagcgcgagcaaggtcaagttctacctgacgggcaccatcaaaaagggtgccaccgagggcaagaagatccaactgaccaacaaggcgtacgagaagtggaacaacgagacggtgccgaccaacgagccgccggtgttcgtgtggacacccaaccccaacaaggcgtgggccatgaaggttgacggcaagtggcagctgaccgtcgatccggccaagagcgacaaggtgggcggcgacgacaagtactaccgtctcggcgacgaggtggcggcggtcgtttccggcaccctgcccacaggattgggccgcgtgcccgagatcgcgtggaccgacgacttcgccaacgtcgatagcatcctcgacctgaaggacacctccaacatcaaggtctacgagcaggacaccaccgacgaggccaacgccagcgtcaacgacctgaacaagaccggcagggacgtgaccgaccagttcgacatcaccgccgagggcaccaaggtcacggtcagcgcgaaggactcctacgaggccgcgcagaaggatctgaagaccgcgaagcagatcagcgtcgtgatccccttcgacgtgaacttcgacaccgtgaagctgctcgaatcctacggcaagtccgagggcgacgagctcaacacgtgcgcggacccgaagggcgacgacctcgacaacaagggcggccagacggtcggcggcagcacggtggacaccaacacgccgaagatctgcgtgaccgttcccccgatccacaagcaggtcatcgccgaatcctcccagggcggcgaccagtccagcatcgacaccaagaccgtgttccccggccagaccgtggaatacaccgtgcgcgtggacccgcagatccccgcggaccaggcatattcggtgaccgccatcaagctgagcgacacctattccgagtacaccgacgcgaacaagcagaccctggagatcaccgacctgggaaccggcggcatcatcccgaagagcgcctacaaggtgcagtgggacgagaaggcccactcgttcgaggccacgttcgccagggactgggttgccgccaactggaaggccggctccaacccgtgcgtgctgctgcgcttcgaggccaaggtgaacgaggacgcgcccaccgacaagaccgtcgacaacaaggccgcgctgaccgtcaacaacggcgtcaccccgtccaacaaggtcgagaacgagccgccggtcatcaagccctccaagcaggacacgcagaaggacccgaccatcaacatcgacggcaagaccgcgctgctgggcgacaaggtgtactaccgcgtcaacatcgacgcctccaggctcaccgacaccgcctacaaggtatggcgactgggcatggtggacgactacgaccaggagtacctgaccctcgacgcgaagcatgtggagatccttgacgagaccggcagggaccgcaccggcgagttcaacatccaggacaaggacggcgtgctctacgccttcgccaggaccgtggacacccagatccccgcgaccggcgagaccgtgcccggcgacccgcagcccgacgacctgaaggcgtacagcgagaagtccgacaaggattacgacccgctgaaggacccgagcatcgaccagtcgctgctgggccacacctaccaggtggtcatgccgatgaccgtcaccaaggtcaaggacggccacacggtggagaacaccgccacgcaggtcacgaacgacaagcgcgacaagaccaacaccgtcaccaacccgctgaaggagatcaacccgaccaaggacgtgaccgtgaaggtcggcggcgacagcatcgacggcaagagcgtgtatttgaaccacacgttcctctaccgcctggattccagcatcctgcccccggaccgcgcctaccagaccgtcacggactggggcggcacggaccagctgaacaccgagtacgaccagtacctgggcaactgggccgtctacgccagccgcgacctgtacagggacggccagatgctcgcggccaagggcgagaagatcgcgggcagcggcttcgactcctcgaagttcggcggcaacctgttcaccgtggacgccgacgacaacggcaaggtcacggccgacgcgacccaggcctacctcgacctggtgagcactgacaacgagcacgaggccggctgggtgctctacctccagtgcaagcgcatcgccgtggccgacgaggtgcccaacacatggaccgagaccatcaacggccagccgcgcgaatccaacaaggtcgtcaccaagaccccggacatgaccccgagcatccacctcgaaaaggtcgataccccgaccctcaagcaggaaggccaggagcaggcggaccgcgacgactccaagcaggcgctgaagatggacgccgacagcatcggcatcacgttcatcatcacgaacacctccaagaccgacccggccaccggtgacggcgcatggttcaaggcaagcgacctggacctcgccgactccaccatcgtcggcgacgcgcacgtggacatggattcgctcacctatcccgccgactgggacaccctggtgctcaagccgggcgaatcggtcagcgtgaccggcacgctcaagggcgtcaaggaaggcgagacccacacggaccgcgccatcgtcaccggcaccccgctcgtggaatgcgcgccgtccaacggcgacccgttcaacgacaagaccgacggcggcgaagacaccgatccggaatactccaccggcgacgtgaccgagatcgacggcaagcagctgtgcgccgacacccagaccgccagcaacaccgacgactggaacggataccgtgccaagccgttggcctccaccggcgtggccgtgctcggccttgccggcggcgctctggcggtgctgctcgcgggcggctccctgctcgtgttccgcaagcgccactacgcacagggttccggccgccacacggccgtgaacgcgggcaagtgaccccgtggcgttccggcctcgtcgtccgatgacggccgggacgccctccattgacttcacatgccggaaaggggcataaagctttccgaatcccgtgccccggacggcgtgtgaacccccaggcccttcgccagcctctcccccggcgaagggccttttccatgcccggaacccgtgaacccgtggaaccgtggagccgcagacccgtggaaccgtgctcccgatggggcctgtagacggtgcgccccgcagcggcccgcgacccggcgcatcatcgactctgacattgttcgcaccatcatcattcctctggaggttgcacatggctgacaggcaaaccgcattggccgtattcgattttctcgactcgctgcgcgccggacaataccgcgtcggcgctgacgcggaaaaggaccatgccacggcgggactgctggcatcgctgtccggcgacacggggctgcgcgacgccgtgtgcgccaagctgatatcgccgggcctggaacgcgcccgtttcctcatggtcgccgagcatgatccgcgcgccttgcccctgttcgcctcgggccaggtcaaaccgtggtaccaggccgactacaacgtgcgcgagatcgccaacagcgagttccaccaggacatacccgcactgctgtggcggctgtccaacaccatcccggattccgcgcgaagggagggcgcgcttgaggcggccgcgtacatgagcttcatgcagggcgatcccgaggccgcgttcaccggccatctgggccggctcgcggcggtttcacccgagggcgaggtcacgcgctgcctcatggacgcgcacgagcacggccagcatcccgcatgggtcatggaacggcggcagctgcgcgagcggcaggccgacgccgccgacggcatgaccgccaccgcgccggaccgcccgagccttcgccagcgcctcttcccgaaccgatgaacacctccggcacggacccatgggagatgggccccataatcgccgccggcaccgccgtcgccatcgacacggcacaggaaccggaacgccggccaccggccgaacccgagcccgagcccgggcccgggctggagccggatgcgcgatgcgtggacgacgccggaagcgaaggccgggcgaacccggccgtcgatccgtgggagatcggcccgctgccatcggcctcgaatccggtggggaatgatatcccggccgatgccccggcatcggaaccgcagcacgttggcggtgccgtggagccggccgatctcgccgacacgatcgacctcacgccggtcggcgaccgggatgccgccatgcccgtgcgcgaatggaggcgcatggccacgaccgcgggcggcatcctgctcgcggcctgcgtcacggtcgccggcatgtccgcgtggagatcgcatgaatccgccacggccgcacgcgagctggaacaggcgacggcggactgcgccgccgcccacgctgcggcgaagaaagccgaacggaagctggctgaatatctcgacggcgaccggctcgcacaggcgaaagcggtcacggccgacaagctcgccgacccggaaaccctggaaaccctcgacaagctggccgaacaatattccgagggcgagcgaatccccgcatgtgccgccacggacacggaaacggccaacgccaccacatccaagctgcaagccatcgaaaagaagcacacgggaaatctctcgcggctgaagaaggcggcgggcgcggtgttctcctcacggctggcccatacggtcgaacagggcgaacgattgtattcctcctccgaaggcaaggtgcaggacgaatattctcgcgccctgctgcgcgcctccatcgacaagcgcgacgagaaggccatcaccgacgccatggacaaggtgaacgcctccatcgacgcgaagaccaaggccgacgaggaaaggaaagcgcaggaggaggccgcagcggctgcggcggcgcaggcgcagagcacgccggcaccgcaacagtactcgtacacgccctccggctccgcttcgggctcgggttccggcccgacgggcggcggataccattcctccggcggttccgccggctcgaccggtggttccgcgtctccgggctggtcggtgcccgcgaacccggacccctcgcaactgcccggcaccgacccgagcctatgaaaggaccatcatcatgccacaactgaccacgttgatcccgtcgttcgcggcacccgtcaccgaccgcgtgtggctggtgggcgcgcacggcggtgccggatgcaccacgatccgccattcggatccggaacggttcgccgacgccggccgcgcgctgccggtgagccaggatccctccatgccctcgcgcatcatcctgtgcgccatgggaaccgggagaggtctcgaatcgttgcgcgcgctgctcgccgaccagtcggccggactgttcggcgcatcgatcctgttgggcgcggccatcaccgaccccgtgccccgtatgccccggcctttggtggcggcgcgcatccaactgtcatccgccgtccgcgtgtggcggctgccccatatcaaagggcttgaactcgacgggtttccccggcgttatccggccgcgtactcacggctcgtgaaggacgtagacgccatgccccgcgccacggcccatgtcggctgacgatggtgcatgaacctaacacgaaaggaacaacccaatgctgcatgaaacatacgtgatcctcgccgagaccctttccgacccgaccccgtgcctgcctccgggattctcgggcccggtatccaccgccctgggctgggtgaaggcgctgagcctggtgatcggcgtggtcgcgctggtgcgcatcggcgtgcacatcctgcgccagcagggcgacggcgtgccagaccgcgacgacacgttcgacaagctcgtcaactgggtgatcggcatcttcctcggtgcgggcgctgtcgccatcctcgccgcactcggcctgtccgtcaccgcaagctgctgagaaaaagccatgaaagggattcgacgcatacggcagcgcctgtgcgcgctgccgctcgccctcgcctgcctcatgggcctcgccgcctgcggcggacccgacttcggatcgttcagcaaggagctcacgttcggcgacaagcaggtcagcgacacccagaccacctacgtgatgaagatacccgaaggcaagctcggcgacctgatcggccccagccagatccaatgggtcatcgaccagtacggcgacccgcccgcccataccggcgcggtcgcggtcggcaccaagaaggcggcgaaggatctgctgaggaagtctccggaactgcaatgcagggcattggagaacacgtatcaggaggagtcgtccgacgagggcaaatgggagtacaaggactcctcgtgccggaagcagcgcaagctctcctggctggagaagaccctgtggaacatgtaccaggtgcagtcggattccacgatcgaatggctgtccaccagccgcaacacgctggtcgccgcggacgacacggtatctacgttgcaggcgaacgccaccccgaactacgattcgtggttcgcaccggtgaaccggtacctgcgcatcgcgcagggcgtgctcgtcgcagccgccgcgatcagcctgatcgtgctgagcgcgcgcatcgtgtggaacatcggccagggcggcgagggccgtctgctcgaccgcatcggctggatactgctcggcgtgctgctcggctcctcgtgcgcgagcatcgcgctcacgttcttctcccgctcgtccggcggcaatccgggcctgccgtcatggacgccgggcggcggcaccacgttcttcctgtcggactacatccgtatgcaggttgacccgttccttatcatcgcggccgtgtgcggcgtgatcgcggccggctggaagctcgtcacccaacaggagggacgtgacctgatcccgttgggcaaggcgttcatgtgggcgatcctgagcgccgtgtgccttgccggactggtcaacacgttccaggccacattcgacacgtggaccgccgacgtgctcaggtccgcaagcggcatgatgaacgacgcctgggaatcgaaaagcctggccgcgagctcgttcttcaatctcggcgcgcccgtcgccatcgtgctcaccatcgtgatgtggatctgcgggctgatcagcaagatattcgcctacttccgcgccgggatgctgccgatcctggtgggcgtggcacccatgtgggccgccatgagctggatggagaccggcaagcaggctttcgccaagaccatcggctggctggccgcgttcctggcctacaagcccgtcgccgcactggtcatggcgaccggctcggcgatcatggccacggccgggcccggcgacgacagccaggccatcacgctgatgctcaccctgagcgtcatcatcctccttcccgccatgatccgcgtgatcgtgcccgccgtgcaatcctcggtcggcggtggcggcggcggaatcctgccctccatactcggcatgggagtcgccctggccggcggcggcctgcgcaaggccatgggcggcaagggcggcaggaaaggcggcggcgacggacgcggcgaagcgtcaccggacggtgccaaacccggtgccggccgaggtttggccggactgctttccggactcggccgaaacggcggaaagccgcagggagcgaacggcggcggcaggcacgccaaaccgctggaaggcaatcccacgggcggcgaaccacagaacaccggcgaccagccacagggagcgaaccgcaagggcagcgacggcaaaccgcagggaacgaacggcaatggcacgggaagcccggttccaccggcacccgatggcgcgccacccgacccgtcaggcggcaacaggccgcagggaacgaacgatgccggcgggttcgcccgcgagggcgcaccggacggtgccgaccgctcgaccactcgcaagggcaagacattctgacgcattaaggagattcggataatcatggcgtcgaacacgacatacggggattggatgcggccgatgccgggaggcatccgcaacatcggcataccgttgacgatagcgggcatgggtgtgctgacctgcacgctgctggtcagcatggcgagcgtggtcgcggccatcgcgatcctcgtggtcggcatgggcgtcatcctcgtgctggccatccgcgaccgcgagcaccgcaacatggtggatcgcaccgtggagaagcgcacgtggatggccgcgcagcgttccggcgctaacctgtaccgttccggcctgctcgcgccgatcgacggcggcaaggccatgctgccgggcatcctctccagggtgggcctgacctccgccctggacgggctgggcggcgagttctgcctggtgcggcattcgcacaccggcgaatactcgctgctcctgtcatgccagccgcagggcgcgagcctcgccgacgacgacgtggaggactcgtacgtggcctcgtgggccgggctcatggaatcgctcgcctccgagaccggcgtcacccaactggccgtgaccgtggacacggcacccgattccggcgtgcgtttccgccgcacgctgagcaaacgcatcgtcaaggacgctcccgagctggccgcgcgcgccatggcgcagatcatggaccagtacgcagccggcggcgcttccaacgacgtgacgctcaccttgactttccgctacaccgaccgtgacggcaaatacctggaggccggggaggccgcgcgtcgcataagcctgctgctgccctcgatccgcgagcagatagcgcaggcgggaggcggtgccgcgagggccctgggcatggaggagatcactcgcatggtccgcgtcgcctacgatccggccgcgcaggagaccatcgaggaatccgacgagcccccgtacatcgcatgggaggattgcgggccgctcatgcacgaggccggctggagccattacgcgcatgattccgggctgagccgcacatgggagatggtggacccgccgcaaagcaacgtgaccgccgacacgctcacccgactgctcagcccattggcggactgcgaccgcaagcgcgtcaccgtgctctaccggatgctgccgcccgacaagaccatgttcatggccgaacagaaccggcagaaggcagccaaccaggtcagccaggagaaacgcgccacggtgaggtccatgagccagatcggcaaggccaaccgccaggccgtcgaaacgaaccagggtgcggtcatggtgttcttcgggatgctcgtcaccgtcaccgtgtccaggggcgaacaggaaagccaacgactcgaagccgcgtcacgcgccgtggaacaggccgcaggcggcgcgaagatcgacctgcgcccctgctacggggcacaggacacgggattcgccgcaagcctgccccttggattgaacgtcagatcatacactccagccggccccctcggccggctcctgtcctgaacggaggacacatgatgccgatgccatggaagccgtcgaaacggaagggaaccatgccaagcgccacggccacggaccccgtggcacgcatggaatccatgctgctcacaccgttgaaggccaaaccggacgagcccgtgcccccgatgccgtggcgggggaaacgctcgcgtggaggcggctatgcggccctgatgcccacgatagacgagttcttcggcacgtcgaaccaggtgtgcggcgggttctggccgttcggcaccgacatggccctgccggccgagggggtgccggtcgggcgaagcctgatgacgggtgccggcgtgtgctgcgacccgatcagctggttcaaggccggcatcatcaaacagccctctatgttcctgctcggcctgccggccatcggcaagagcacgttcgtgcgccgcgaggtgctgggactgagcgccctgggcatgaacgcgatcatccccggcgatctgaagcccgactacgcctcactggtcaacatgctcggcggccaggtcatccggctgggagcgggcatcggcgtggtcaaccccctggaccccggcgacctccattatgcgctgcaacaactggagggcgaggcgcgcaaggacctgacggactactacaacgacacgcgcgccgcgctcatggaggtgcttttgacgatcatgcgcaccggccgcgagaacgacaccgatgccggtgccaggggcgtgaccgcacgcgaatccgatatcctttccgtcgccgtgcgcgtgctccacgaccggcacggcgacgacccgcagcctcccgtcatcgcggacctgcgagacctgctgcgcgaaggacccgacgaggtgcgcacggcggcggtctgggacgacccggaaaacgacgagctctacagggcgcaggttcgcggccttctggccgacctgcacggattctcgaaccgcatgacgaagttcggccgtctgttcggcgaccagaccaccgcgcgcatcgacctgtccaggcccgtggacttcgacatcagcgccctggcccagtcgggcgacgatgtggtcgccgccgtgctggcgaccacatggacgagcgcgttcgccgcgaagaacgccgccgacgtgctcgccgaggagggattacagccccggcgcaaccacgtgatcatcatggacgagatgcaccgcgctttgcgcgccagccccctcatggtcgaaaagctcgacctgctcacccgtctgaacaggcagtggggcgtaggccagatcatgatcacgcacacgttcaaggacctcatgtgcatggagaccccggcgcagaacaccaaggcgcgcggcttcgtggaacgcagcgagatcaaggtgctgggcgctttgagccgcatcgaggtggaccgctacctgcgcggcgaatgcggactgcccgtatcccggcgcgaggaggacatgctggaggattgggccacgcccgtcaacttcggctccgacgcctcgcacaagggtctgggccgtttcctgatcaaactgggaggactgcccggaatccccatcaacgtggagatgtgcccgctcgaaaaaagcgggttcaacgatacgaacctcaaatggcacgcctagaagggaaccctgcgatgacagaccacctcgccaccggcatgaaacgcatgatccgcaccgtggcacgctccgcatccctctccgaccggctcggcgagcaatcccggctgctgcggctgacgggcaaccgcagcactctcgacttccgccccgccgagcacggcgcatcctcatgggacttcgaaatgtcgataacccccaccgagcccaagccgtacggcaatgcggaaacccgtgaacccgtatggcgtgagacggtcgattccgccacctatggcgaatcgagggcgcgggtcgcgcacgccgtcgaaacgttcagaatatacgacaacaccggcatcctgccggaaacggaaaaccggtgaaaggaccacgatgaacgacgccgcactgctcgactcgctgcacgccgcgctgcgcaatcccgacctcgcatggtacacggaattccatgccggcgaatccatcgtcgccggctacctcgattccctgacggacccgtatgacgacgatgccatacaggttcccgagggctggttccgctactcggtcgtcacccgtgaaggcgaccacgcccttccatggatggagcactggaacgaatacgagtattcgatcacccatcacatcgattggaacggcaaagggttcacgccatacaacctgtactgcacacaggacctcaccggcatgatcgccgacggctcgctggcctcgatccgggaggacgcgcgaaccatattcaaggaccggtccctgacggacgactaccttttcgccaactccatctggcccgaaccggaactcctcggcctcgtggacgacctgaccggccgcacgggacgaaacctgtaagaaccctgtagacgccatgccccaccccgccatggccttggactgatgatcggggtcatggcgggaacagcgggttgccgccgaggattgtcaaggagccgaacatgcctttggagaacaccgatgccgaagagcggatcacacgggagacgatgatcggatggatcgagcattggggcgaatcgtatgacgacgtgcgacccgatgacggtgccatgcggctggcgaaccgcatcatcgaatacaacgcggcgactgaaaccatcgaggcgttgcggaaccccgatgccgtgtacgacgaactggcatccatcctccagccggtgctctcctcgatggacggcacctatttcgcgggctccgaatggttcgccggcgaagtggaccgcatggaagcggaccgcatcaacggggagcagccggaagaaacggacggcctggcctccgaagaaccccgcatcccgttcatcgtggagagcgaggccacagccgccgatacggacgaaccgccgttggacgagctgatcaccgcagccacacacgaatatctggactcaggcatgacctacgacggattctcggaacatgtgcgcaccacctggcgcaacgccgccgcctacgactggtcgaagctcatggccgaaccacgctccacgggcgaatggtggtccgacgcgaaccggctcgccgtattgggcgtgacgatgcagttcgcgcccgaatcaacatgcatgatgatcgccagcgacatactggccgagaacgctcccctatcccttccggcattgcgcgaacgcatcaatacgccggacggcatggtgaacaccgacctgctgttttcccggctgatcgacaacggcaccacgcccgatccggcgcgcatcgacatggcgatggggatcctcggcccgttggaggccaacgcgccgacggacgcctgctaccggatcatcggcctgaaggccatgctcagcctcgccatgggcgacggcgagaaggcgcgggaactcgccgaacaggccatcggctacgacgcctcggaccggttcgcgtcaagcgtgctcgaccgtctgccggaaaccgatcccgccatggaggcggcgaacgtgtgggagaacggcgggcatttggggcgctgacgtagacgccgtgccccgcgatgccaccggtccggccggatgatgggagtcgccgccgccattgaaggcgctggtattccccgaatgaaaggaccatcatcatgccacagtcaatgcaagtggttcgcggtctcctcgccgcgaaccccgattactggccggcgaaaaccaacgcggacggcaccacgagctcggcgtacctgcgcgccaccgtgtatgaggaccgcccgcgagtccgtcagaaggacggcagctatacggacaatccgctcggcccggtgagaaccaccgtgaaattctggggccaggctgccgagctcctgcacggcatggatttccgccagggcgacgccgtggtggcgaccggccgcatgggcgatcccgacgccttcatcagccagaaggacggcaaggcatacgcgcgcccggtcgtgatcggcgattccatgcagatcgattccatcgtgtccaggcgcatccagctcgcccgcgaacgcaaacgccaggacaaggaacaggccggtgccgtggccgatgccgggcgaacggatccatggacggaccaggttgacgcctcgcgcggcgaatacgttggcgacggcgttccccgcactttcaacggcgagcccttcgacccgctgtcgggctatccgacaccgggcgcggctcccgctccggcggaccccgcggcaccggatttcctttccaccccatccgatttcacgacgggcaacgcccgctagccatgacgcaagccctggcgcatcgacggcgggaccgctgcttccatcggttccgccgtcgatgcttgaaaggagaaatgaatcttggccgacgtcgatccgaaactgcaatcgaaccgagtgaaggatctgggcggcacggtccgtcccagccgcaagatcgaactggcgatcatcgtcgcggtgtccctgatcctcacggtgttcgccctcgtgtgctcccatgcggggcatcccttccagatcttcgcgctcctgtacctggtctccggccaatggtcgctgaccgcaggccagtgggcgctggccgtggccgtgctcgtcgtgctggccgtggcgtgcggcgtgggcgcgtggctgatcgccagcaaggccgtgccgtgggcaaccggcgccaaggcacgcacccgcgtggacgtgtacgcgccggcgatgggccatggcgaggccgtggagaaggtgacgcgccagcgcgccgaggccatggcgtcaaggctcatagaagcggaccactggcgaaagggcatgtcgccgggctatccgctggggctcaacatcgtggacaacacgtcgatgtacaccagctgggaggacatggcgatcgttctggcgggcccgcgttccggcaagtccctgtgctacgcgatcccggccgtgctctcggctcctggcccgtgccttgcgacctcgaacaagggcgatatcctcgacgtgaccgccccgatccgcaggctcgaccatccgaacggccggatatggacgttcgaccccgaacgcatcgcggacccgaaccggaagagcgcgccgtgggtgtgggacctgatcgcctcggtgcagtccatcgccgacgcgaaacgcatcgccgactgctggcgttacgcctcgggccagccgcagaccggcggcgacgacttcttccccggcaccgccgcccagcagctcgccgactacctgttcgccgcgcatctgggaggccgttccgtgtccgacgtgttcaggtggtgctccaacgagcgcgacacgtcgccggccgacatcctgagcgaatacccgcgctacgcgggcatcgcctcgcgcgtgtccagcgtgatcgcgctgacgccggaaacccgaagcggcgtgttcggcagccttcagaccatggtcgcgttcctcgcggaccccgagatcatcgactggatcgacccgcaccgggatacgaatgggaacatcgacgagcggcgcggcctgttcgacccctacgagttcgccacgagcgaggacaccctgtacctgctttccgcacagggccgtccctccaccgcgttgaccgcgagcctgacggcggtggtggcgttcaccgcgttccaacgcgcccaaagcgagttcgccggcaacaaccgccgtctgccggtcccgttgtgctgcgtgctggacgaggccgcgaacatctgccgctggcccgaactggcggacgtgtactcgtatttcggttcggcgggcatcccgatcatgacgatctggcagaaccccgaccagggcagggccgcgttcggcgagacgaacttcggctcgctgttcaacaacgcgaacatcaccgtgtacctgggcggcatcaaggacgcgaagttcctcggcgagatcagccagctggtgggccagagggagatcgtgcgcggcagcgtcaacatcgacggcaccggacggcgcagcgtgaacaactcgatccagaaggagaacatcctcgacgtttccgacctgaccgaatggcccgtcggacgcgcgctgctgctcgcatcccaatcccgagcgcagatcgtcaagaccctgccatggacgggcaacaggcaatgggccgacgccctggcgcaggccaaggcgaaagcccgagacgagcagagaaaggccgcataatgagcgaacacacctcgaacaccacgtccggccctgatggggaggaatgggagcgcgcggtcggtgccgccaggaccctgctgtcatcggactgcggatggctggaactgttcacccgcgccatcctggaggagaagggcgtgccttacggcaagggactgcccaaccccgaagcgccgcacatccccgaggacaaggagatcgaggaggaaaccatgccgggccaaggcgagccgacgccgaccgcacccgaggtgccggcaggccggcacgcggcgggacccatccgatccgggattccggccgatgccggggaaaccggcaacggctacgagaacccgccggaagacgcaacggaccgtgacgacacccctccaaaggccggtgcggaggaatccgacacccgtatactgcccgcgccggaggggaagacggatctcggccgagacgaatccggcgacctcgatcccgcgcgggcaagggacgtgtccggccagttcggcgcgcgaatgcggcgcagcgagacctactatccgaacctcgccgcgttcgtggaaaggttcgtagccaacgtgttctgctaccaccagagcgcgagcgtgaacatgcaatgggtgagcgactggtggcgctatccggcgctcgtgttcccgctcgacgccatgtggcgcgcctacgagaacgcgcgcaaggcacccggccagatgatgatcttctacatccaggcggcgtcgatgctcgaccgcgttttcgacaaggaccgtggcatcgtcgccagcctcgactgcaagcagaatctcaccaggaagggcgaaccgctgccctgcgaacgcccgaaccgggcatggcgcgaaccgatcctggaaacgttgtcggtccccgccgcaggcggcaaggaaaacaaggaaaccaccatcacgccaacaaggaggagaaacaatggctcaaactgatcccgaggacggcttcgaccagatcatggtccagagctggaacagcgtcgcccagcagctgcgcaccctgcacaacgagctgagcggcgaccgcgcgcgacgcagggaacgcgccgaacgcgccgtccagaacgaacgctacgagcagaccagacggcagcagcaatccatccgcctcgaacaatgggagatggacaacagggaacgcctcaacaaggggttcgagtccaccctgaacgcgaccgtgcttgccgacggcgacggctggaggaagatgcgcgactcgtccctcttgcaaggatggatggtcgccgaccaactggagggcaacgaccccggctaccgcaggcagatcatcgaggcgaaggcccggctgaaggacgaatggtcgaaacgccacccggaaacgcacatcgacgccgcagccgaccaattgaccaaccacgtgaacatcacctacaccgaccagtcgcccgcgttgcaggccaccctgaacgccttcaacacggccggcgtgcccgtggacctgcaacgggtggaggacgcgcaggcgttccaggccgcgcacggcgacgacgccacgttcttcgtggactcgcggctcaccggccaatggacgggctacgaccacgacaggatcgtcgaagccgtgatgtgcgcgccggtcaacggcgtggacgacgccgcctcccgaatcagcttcctcaaggaccagggcctgccggaatcctcgcacgcggacaacaaggccacaggagacgagcccagcaccataagcgaggccgaacgcaccgagaacgctgacgccgcgcccatcatcgaaacccccacacccgtgcgggagcatacgaagcccgccgccgatgaacgcaaaccggcatccggacccgagcccgagaccacgggaggcggcgacctgacgaccggggagcccgacggatacgaggagatgccactcgacctgaacgaacccgaggaatggaacgggcccgacccgttcggcgaatacagtcccgccatggaatcctccatgaaccccacggaccagccgatacccgaccaggccaacgtctcgacgccgcagatcctgcaacccgagaccaacggcaacgcacgctgacgccggcgcacccctttgccatgaggcgagcggggtgcgccggcatcggatggccgtatcatggtgtcaacggctttcggaaccggaaaggacgagcatggcacacgtgacgttggatctgtcgaaatatgacgccctgaccgcctacaagggtcttcccgacgagaaggaggagaacccggcgcggttcttccccgacacctcgtcggtccgccgttgcgtgcgcgaacgcatgtccgtcatgggtctcgacgccgccgaactcgccaggagagccggggtccccctctcaagcgccgaagagctcgtggagaccggtctgacctccatccgctacgtgtacaggatgttcgacctgctgcacatccgcaccgaaacgctgccgtccgcctacgcggggagactgctgtgagggaactgcacgcctgggagaacgggcatcatgtgggcgtgttctcggaagacgacgaggagcgcatatcgttcacgtacgacgcgaacgagggtctgccgatcagtctgagcctgcccagaaccggcggatggaaagaccaggcaccgcgtaacttcctggacaatctattgcccgacaatcccaacgtccgccaggccatgcgtgagcacctgaatgcctcctcggccggcgtcttcgatctgctggaccgggttgacgccaccggcggactggtgttctccctctccccggaacctccaatcccatcgccgacgcttcgtctgatctccgattcccagatagccaacgaaatcgaccgcatcgagcggaccaggaactactggtgggacgaggacagccactgccggttctccttgggaggggcgcagggcaagttcacactgtcccgcgtggacggcaagtggtattggccggatatgatgctgccctccacccacatcgtcaaaccgaagccccatgaccttcccgaggcgaccaaggtggaactggcgacgatgcgattgtcggaactgtgcggcatcgacacaccggcacgcggcgagatcacggcgcagcgcaagacggcctatatcgtggaacggttcgaccgtcgcctggaggaaggccgaatcgtccgactgcggcaagaggacttcctgcaagcgttgggattgccgacccgcgacaaatacgatccgtcggccgatgactgcctggatctcctgcaacgcatcgatgcgtcgggttccctgtcctaccggtggctcgaaaggctggccttcaacacgtcgtccgccaacagcgacgcacatgcgaagaactattccctgatcctcgatcccgcatcggggatacgcctgtctccccagtatgatgcggtcgccaccaggtattggcccgagttcaattgggaactcaccatgccgttgaacgaggatcacgccttcgcggagcacaccacgccccaggattgggaggatctggcgacacgtcacggtctcgatggttcgagggtggcggatatggcccggcgtatggcggggaaggtcctcgccggcatatccgaatcctgcgagggcctggacgcgcggatggccgatcgcctgaacgcgtgctggacgaaggcgaacgagtccatcgagccgatcatgccgggagacgagccggcgaactctctcgatccggcatcggctttgcccgattcgctcggttttccttcctcgggccataccatctgagctttttccgggaagcgtcctaacggcggggccggttctcctcgtcagaggcgaccatgctccatagaccgtattccggcgcgattccgtagcgttcacgcagcatgtcgaacgtgtgcaggccctcgcgcatcgctgcccggtattcgtcgtcgtccgccgcgttgttgaggctggcggcgatgcagaacgcttcggatacgaggcgttccatgtcgtgcgtggacaggttctccaggtgccgttcgcgtccatcatcgaggaagggcgggcggttctccatcgcggcgcgccattcctgcacggccagggcgcggcttctggcatcgtccgcccagtcgtcgcgcagtcgtttcaatcgcatgtcgtcgccgagctcgaaggcgttgaaccgttccgtccacccgtccgtgctgcgccacgtgatcctgtagccgaccacctggccggggtcggtgaacgagtctttggcggttcccctgcgcagcctggggtcgatggagaagccttccctgcgcacgcggcgtatgaactcgtcctcgctgcgcgatgccttggcgcacgcctccacgatccggccgacatgctggcgcggcatcgttgaggcggcgaccgccgtgacgagccggcttctctcgttgccgtccaacgcatcccatccctcgtcgtcgccgtactcgtttcgcgccttccattcggcccattgacgccattgcccgtactgccagctgacgcgcgtgccggtgtcggagcgtgcgagctcgaccagttcggggcgtgtcttctccatccgcctgcatgatttctgcgcgttgatccggtcgtggtacgggtttatccacccgtcgtcggcggcgagctgcaccatgatgtgcacgtggtcgttgccgttggcggacagtccgtggcggaccgcgagccatgtgacgccctgatcgtcgtcgccgtcgatgatgttcatgcgcgtcagataatcacggatgacggcctcccattcctggtcggtcaggattccctgcccggccttgatggcaagcgagcagtgccacacgcgcttcctgccatgctctcgttcgggattgttcttgcccctcatgtcgggcgggaacggatcgtccttgcgttccctgacgcggtagcgtcggtcgaacctgcggcctatctccgcatacgacgccgccggcttgccatccatgtcaaacgagggaaacatgtcgccgctcgcgcacacgagatgctggtcggtgtgttcattgcgccgtcccttgccgaacaggtagcgcaccaggccggccgggtccgaacccctgacgatactcggtatcatacgatgattctccgcccgcgcgcccggcacggcggcgcatggcgtctatgagagatatgcgccctttgccggcacggccacttcgatagaattatcggaaacggataaggggctttgatggaaccggtgaggaacgatacgacgacggataggcgcacggccgtggaactggcgaagcggctgctggtcgatttgatctggcgcaccgccaagatcgaggttgatggcgtcaccttccccgacacgcaggaaatcttcgacgggcgcgcccccgagggtatgagcgtggacgatatagtcacggtgaataacatcaagcgcgcgtggaggttcctgctcgggaacatcgactatccagtcgattggcagtacatccgcgaatacaaccgcatcatcggcgaaggccgcgtgcgcgacgccggccgcttgcgtgaatacggcgtgaggatcggcggcacgggatgggtgccggagatccccaccgtcgaatcctcacaggaaagggttcgcggcatcctggaggagtcagaaggggaggacactgcgatgctgctgttcggcgcggtcacgcggggacaatggttttcggacggcaacaagcgcaccgcgctgatggtcgccaaccaccagctcatacacgacggcatcggcgtcttctcgatccctcccgaagacaaggcacagttcgtctctatgctcctgcgctactacgagacgggcgactactcccggctctccgattggctctcacagaacgccgtcggccatgtgcccggcgggctgactttggcccaatcgtctggggccgcggaaaagacgaatgatgccgcgaacgggatgggcatcgtgcccggtgttcccctcgacggcctcgatggaggttccggcttactgaggtgacggtcgtggcgtccgggggtgctcccgaactccatgggattatttacggtcggcttgcgtgatgatgacttcgagccggcctataagtttccggcgctgccgcaccgtgtgcgcggccgttgcctcgtcgcgttcgctggcgtgcatctcgcggttcacgttgtgcgtgatctggttcacattgacgccgatacgacgaaccatggcgtctacgcagccgatgatttcgcggggtgtcgggccgcgcccttctcatgtgctatcctgggtttctcgggaatcggaggaaccgtatgagtgagatcaggatagcggatttgttcgccggcatcggcggcatccgcatgggaatggtgcaggcgctgggcgatgccgcgcacgtggtgtattcgtccgagtggaacaagtacagcgtgcagacctatgaggcgaactggcacgacgagaatcccgtggccggcgacatcaccaaggtcgacgagcatgacgttcccgacatcgacctgctgctcgcgggattcccgtgccagccgttctccatcgccggcgtctccaagaaacagagcatgggccgtcccaccggcttcgaggacaagacccaaggcacactgttcttcgacgtggcgagaatcatcaaggcgaagcagccgaaggcgttcctcctggagaacgtgaagaacctgctctcgcacgaccgtgggcgcacgttcaagacgatatattccgtgctgaccgaagaccttggataccacgtcacctacaagctgatcgacgcggcgggcttcgtcccccagcacagggaacgcacgtacatcgtgggcttccgcgaggagaacgggttcacgttcgatgacgtgaagcccatcgcgcacggcaacgtcggcagcatcctcctgcccgcctcccaggttcccgacaagtatgttctgagcgacaagctgtggacgtacctccagaactacaagaagaagcacgaggccgcaggcaacggtttcggatatggcatggtcgatgccgccaccgaccacacgcgcacgttgagcgcgcggtacggaaaggacggcagcgagatactggtctcacgcggcgagggaaagaaccctcgaaggctaaccccgcgcgaatgcgcgcgactgatgggctacccggattcgttcagtatcccggtatcagacacgcaggcataccggcagttcggcaactcggtcgcagtgccggtcatccgagccataggcgaggcgatgaaaccctacctgtccgactgattcgcccgaggcgtttcctgtccgattggtctatgctcatggattatgagcgattacggaagaatcggcgactacatcggcccggtcgcggccaagaaactgtcggccgtcgatatcgacgccaacagcagcaaccagcacgagttcggcggcaacgacgcgctcagaagactgctcggcaccggcgaggatcgtagagcctcacaagggcacggcatacccaccgcgctcatgtacctgagcgacgatgacgcaccggcggtcgccgacctcgaaaccacatggtacgacgcgcggcgcaacaacccgaaccgcagcgccgaatggcgtctctactacaaggactgcgagccaatccgcatggcccgccccggcgacctcatgtgcttcggtatgctcagggacaatcgcctgctgatcatcatcgcacagcatgacagcacggccgaagcccaagccaaatggctcttcggcatcgacgacgaacaggagggcgcgttccgcttccacgacaatacggaacgtgagctggacgccttcggcgcgcagatcttcgaagctctcggcatcaacgtcgaagtgcgggatgacacgtatctccccgagatgatcggcagatggggatacaggttccccagcaacgaggagttcgcggccttctcccaatcctccttgacggacgtggatcccgcgcacgatgaccctgacgacgtggtgatcgaatactacgaccgcagctacctgctgttcaaactctatgagcgggcggtcatccaacacgactacgatgccgcgccattcgtatcggatggcgtcatcgacgttgactcgttcacttcgttctacacttccgtacgcaaccggcgcatgagccgcgcaggcaaggttctcgaaattcatatcgcccacatcctcgacgcgcgcggcatcgaatacgaggcacaggctaggacggagaacggaaagaaacccgatttcctgttcccctcgcaagccgcctacgaggatccggcattccccgaggcgcagctgcggatgcttgcctcgaaaacctccatcaaggatcgtttccgtcaggtcgccgacgaagccaaccgaatcagggacaagcacctgttcacattgacccccggcgacgtgacccatccaaagctcgcccaactcgatgaactgcacatccacctggtcatgcccaaggtggtcaaggaatcctatgacgacctgatccagggagagaccatgacgttctcccggttcatagaagaaattcaaggactgcaagcggaccgtccgcaaagcctgaccttgctctgacccgttcgcttcatcggacacccatgcgtgccgccagttcggcaacagcgtggccgtccccgtcatcgccgccatcggcaaggcgatgctgccgttctgaagtaggattgatagaagcatacgaaaggagccacgatggacgtttcggcaatcagacggccgcaggactggcctttccccattccgcagatcactgcggatagcattgacgagctgatcgatgcgttgcgccgggacgtgtcggactcgactctgagcatctactacgacgccgtggacggatgcagccgcgagatggcgaatgaggatcaggaaatgatggtgcgtgactactatctgcatgacggatgggcggtgaagcatggagcagatgcatgatttctcgccgtatgcgttgaaagtcagcgtatatgacggtgccgccgagaagcggactatgctgatggacggccacctctacatggtcaagttcggctatgacgcgaacccgcggacggagcactccagccgtaccagctatgtcaacctgcccgtcaatgaatatatcgggtccaaggtgttcgccgcttcgggcatccccacgcaggatgtcatcctcggtgattatcagggacgctccgttgtggcgtgccgtgacttcatgtacgacttggacccgaacctcatgctgcttcatttcaagcagctggagatcagcatgcccggagggagcagcaggtcgaaggcccgccccgattgggagttcgtcagccaggtccttgacgagcatgacgctctcgaaggcatccgctctcaggcgtggcatcgctttctccagatgacatgcgtcgatgcgctgataggcaacttcgaccgtcatgcgaataactgggggttcatcgcggacagaagaaacgcggatattctcgggctcgctcccgtgtatgactgcggttcgtcgctgtccccaagtctgtcccgcgagggaatgagggaacgggtcgaagatcccggtcaaatgcgcgaggcgaacatggcctcgccgtatatggcgatgaatgtcggaggcaagcgacgcaagttcgccttcttcctgacctcggacacggcccggcctttcagggcggagctgccggaactgtggccgcgtctgtccaaggaggtcacggaccgcatcgtggagcagactccagggctcgatgaccttcaacgtgatttctacaaggccacgctggacgcccgccgcaagtacgtgctcgaacctgcataccggatggcgctcaaagaagtggaaacttccactgccgggaatgacacccttgcgaccgacattgttccgggaatcccgattccgggtcttacggacggcaccggtttccttcgctgaggttgttccgcagtctgctgtctgcggaacaacccagcttcgccgtcaatcgttcccggaccgttcgagaatggcatcgagatggtcgattagctcccggcattgccgcatggcgtaggacgccgatgcctcgtcctcgatggtcgcgttcatctcccggttcgcgttgtgcgcgatctggttgacgtttcggccgatgcggcgcaactggtattcgatgtccctgagcgcctggacggtgggtgaatcatgttcctcctcctcgacgtacaggcttccctccaacagcttcaccgcttcgatgacggtgagggagacggtctggcctcgtcgtcgcgcggcatcctggagcatccgcttctcgtcgtcatcgacgcggataagcaccgctttcccgcgtggcccgcttggcctgcttcgtctttttctcgccatcggtttcctccttgcgtgtattgctgatgattgagccttcggcactcgggttgttgctccagcgccgcagggcgcgggaggaggcgggctcggattgtatatacaatccgtctagcttgcttaccttcgatttgatgggcatctccatgtgggtgtccatggacatatccatgtgggtgtccatggacgtgtccatgtgggtgtccatggatatatccatctgagcgcataggaaaacgcatgagggtggatgatcgttcggggtgatgccttcttccacgaatgggaaggggctcttcctttttttggaatgtcatcttcccgcatccttcgtcttgagctccttgagcagcatcgtcgcgttgtcgcggatgctcgcgtccgtgagcggggagagctcgtccgcataggagcggcagaggagcgcgtacacccgttcccgcacccaggcgctgcgcgcgatgcccagcttgaatgcggcccggcacagcatctcgtattcgtcgccggtgagcatgacattgagctggcgtccctgcttcagcggatgttcggggtcggggtcggtgcggtacacgtcgttccaatcggtggtgccgggggcgagttccgtgtagctgaacggctggatggcgtatctcacgaaacgggatttgggtatgcccgtcttggcggaggcctcggcaagcagattgaacagctcccggtccatgaggacccggaaggcgtggctgtatcgtcgcatggtttcatcgtctccttggtcgttgccgtgcccggcgcggcatggtgcgtcgggcacggatggttggctttttggtcagcggtcgaagtcgaacgccgtgccgcgtaacttgtcgatgcggatggccgcgtcgaacttcttcccggatttggatgtgaagcccttcagggtgacggattgtcccgcgaggagcctgcgcgcggtctggtcggtgatggtcttgcccgcgatgcgcgcgaacatcttccatccgcagcctgcggtcgtggcccacttgccgtccttggtcttctcggtcttgttcgtggaacactgccacatccggccggttttcctcaccggctggccgcagcgcgggcagtcgccccattcctgcgcgtcggtgttcgcggttcgtgtgacggcatcggccttgaggttcgcggtcgcgtcggcggggattcgcaatgcctcccggtggaacatgtccatcacctcagacgggtcccgtttgccgtgttccacgtcggacaacgcctgttccatccgtgcggtgagcagcacgtccttcagtcgtggctccaccacgtcggtgaggcgttcgccttccgtggtggcgtgcaattgccggcccttgcgttccacgagtttggagcgcacgagcttttcgatggtgtccgcgcgggtggcgggtgtgccgatgccgccggaatgtgattcgtcgtcatcgagtgccgccttgaggtttttgtcctccacgcaccggctcgcgtgctccatcgcggccagcagcgtggcctcggtgaacggtttgggcggccgggtctcgccttcctcgaccgtgaccttcccgaccgggcgaatgacgccgccttccatgaggttcgatgggatcacgttccttcctcccgccgggttcgcggtttcctcgtcttccggttcgggcccgtggccggtttcgacggccttccatcctgcggatacggtctcgtcggaacgactggagaactccctgtcggtgtcgtcggaaagccgggccttcacctcggtgacgatgtgcacatggtcgtcgcccacggcctcccacatgcggcgcacgatgcgtgtcatcaccttgcgctcgtcatcgtccaggccttccagcttcccggcgtccaattgcatggtcggcagtatcgcggtgtggccggccaccttcgcgtcattgacggccagctccgggcgcgggtgtccgggtatgccctcgcgggtgacgaacccttgggcgagacggccggattcgaggagcgccgtgagcgtttcgaggtcgtcatgcgtgatgtaccggctgtcggtgcgcggataggtggcgagtttgagttcgtagaggtgctgcaacgcctggagcgtgcgcgcggcggtcatgccgtgcatgcggctcatgtccttctgcaatccggtcaggtcatacaggcggggcggccggtcgttcacccgcctccggttcacggacatgatgcggaagcggccgtgttcggcctggccgcacagcagcatcgccgcatccttgctgtcgatccgttcgctggagagccgccatccgcccatgtccgcgatcacggtccagaacggcaccggtttgtggttcctgatctgccggtcgcgttccgcgatcatggcgagcgtcggcgtctgcacgcggcccacgctgaaccgtgcgttgtagagcagcgagtacgcgcggctcgcgttcatgccgatcagccagtccgccttcgacctgatctccgccgaccatgcgagcccttggtattcggattcgggtttcatcgcccgccacgcggcctggatggcctccgcctccaggctcgccacccacaggcgcagttccggcttgtgagagccttccatgtccgcgatgcggcggaagatggcctcaccctcgcggtctgggtcgcaggcgttgacgaggcaatccacatccgttcggcggatcagccgcacgatctgccggtagcgggagccggcaccgcgctcctcgctgatcttccaccgccaatggccggacgggtccaccggcagcgtgtccagactccatttcctccaatccctgtccttgtagtcctcgggcatggcaaggtcgatcaggtggccctgcgcccatgtcacgagcagctggccgcactcatagcatccgtccctttggacgggcgcggcgcacaacgcctgcgcgatggccgtggcgaccgatttcttttccgcgatgacgagcttcattcttcgttcgcgttccttccgttttttgggattccttgattcttgtccgacatgcgaggaccggcgcgggaatcccttcccggccggccctggatggaaaggcgtcgccaaggtcaggcggcgaagccgagcagcggcgcgaacacggcggcgatggccagcaccgcgatcagcatgaggatgacgccggcgatccacgcgatggccgtcaccagcgtgcggctccaggtctgtccgccggattccacgatcatcgggctgcccatgcgtttgccgatgatcgcgcacacgcccgaggcgaccacgcacagcagcacgagcaccacctggagcatcccgttgagctcgaccagccacgtccacaggcccatgaaccagccggcgagcatagagagaaacgattccattgattttcctttcacctgattggaacgacgcttccgattctcggccgcaaaacggccggccacggggcacggcgtctacacgccccgccttccgccatggggaatgtagacgccatgccccgtggaacgcgcgacgggaaggcagactcgccttgacggaaaaacgagcgaaaggaagatcgtcgtggcgaacaaccagaacaccatgcgcgacatgaaacgcagcatcctcaaggcggtgcgcgacagccagaggacgaaacaggatgcgatggacgagtacgtggcggcgcgcgtcaacatcaaatcattggaggaacgtctggaagaggcccgcgagaaggccaccctgctgcgcaggaaggcgaaggacgcgggaaacaccagcgccgaactgaaaacggcggacgacctcatagacgcgcggtggacgggggcggaagacgggtcggcggaagacgggtcgcccgaaaacgcggatccgggaaccgtgaaccccgagcgggagcatccggccatggaaggaaacacgcaaggcggcatgccgggtgagccgaaccgttgggaaggcggtgaatcgtgaaccggccggaaccgcgtcagctgccgaaaccgctgcgcgtcctgtgcctgttcgtcgccgcgctcctcgtgtgctcgctgggcgtcatcgtcgccaaccaccagccgtcaacggccggcgacgaccacggttccgcgacggacgcgaaacaggagtccacgggcaaaaggaaaacggattcgggcccgcgacggtacgccggcctggaggcggcgggaatcccggttcccggcgactggtctcagcgcaccaccgcgttccccgttgacacccacaaggacggcacccgcacgctctccgaaaacgcggacggcatcacgctgcacaatggttccggcccgatcgacaccgcattggaaacggtggacgcgctgctcgatccaaacggcagcgacgacgaatggcgcaagaacgtgttcgcgctgctcggcgacgacggtgccggggaaagccatccggtctccgacgcgccgcgctggtggtggacccagcgccgcttccacgccggatccgtatgctcgggccaatacgatgacaagtacgtcaactacgcctacacctgcacctccgacggcaaatgggagggctcggatacggatgccatccagtcccagccgttctggacgacgaaggaaaccagcttcccgatcccggaaggcggcggaccgtcatccacgacggatccgcagcagaccgtcagccaggcgtacaacaccgtgctcttgccgatggacgacggcaactggcacgtcaccgtctactgcccggccgcgctcgacgcgtcattgctggacaaggatgccaacgagctcgaccccgatcaggtgaaggccggcgacgaggcgtacacggtgatctccgccaccggatacggcacggtccagcatccctgccggaccgtggaggtcgtggtcggcgggcagaagcccttctggtcgctgaggaacacgcaatgagccgggccagccgccatcggatcctcgcggccatgctctcggcgtgcctgctgtccctgctcggcggatgcacgccgttgaccgtgctcgcggtcctcggcggctgcaaggacggcggctccaacggatcgtcgggaggcgtcacgggaagcgtcgtcaccggcgaggtgcgtgacggcatgaccatcgcgcagaccaaggcgtggttcaacggatccgacgggcccgacaacgtgtgccaggcctatccggacgggcaatgcacatggtgggcgtgcatgagaggccataaaaacggattggacgtgggctcctactggggcaacggcggcgactgggccgccagcgccaccgccgccggatggaagaccacccgcaccgatcccgtggccggcagcatcgtcagctacccgcccggcgtggccgacgcggacaccctgtacggccacgtcgccgtcgtcgaggcggtcgaccggacggccggcaccgtgaccatcagcgagatgaacgggcgcggcggcctgggcatcgtcaaccaccgcacgcacaggatcaacgtcggcgcggtctacatcctgcccaacggcagtgtgtccaccaatggttccgccggcacggattccacgtcatccggttccgaatcgtccgattcgtcgtcatcgtccgactcgtcgtcctcctcttcggatccggtggaggcggcatggacgtgctccagttccgactcgggctccacggacgtgatggtggactacgacggcgacggcacccacgccacgccggaacaggcccgggccatcgccaggaagatgatcgcctcgtacaaggactggggcgacggcgactatgacgcgctcgtatggctgtggaacaaggaatcgggatggcagtggaatgccaccaacccgagcagcggcgcgtacggcataccccaggcgttgcccgcctcgaaactcgcctccgcaggagacgactggaaggacaacgccgccacccagatcaaatggggattgaactacatcgccggacggtacggcagccccagcgccgccaagacgttctggctcgcccacaactggtactaaggagcgggacacgtaaagggaccgagcatcagatctcggcggaatcatctgacccgtagacgccatgccccgcgcgaccgcccgtatgggctgatgatcggagccatgcccgccggacggcgcggcaccgatcatccaagggaaggaaggacgcatcatgctgatggaacccgacgaatacacgccccaggaacgggccctgaccgacaaggcgaaggagctgatcgagcagcacgagctcgactggggcaacggggaatgcttcatccaacgcgacgccggccacagcgaactgtacatgacgctggaggcccccaaccacgccacggtcacggtcacggtgccggccgaggcggacgagaaggggctgaggcgcgccatggcggacgggctcctcgacttcgaccccgacgaggagttcgacgaatgctggtcccgcgagttcgcggcacgcaacgggttcacgccctccggcttcctgtccggcctccaggaagacaaagcgtatttcggtctccgatccgaggcgttgcttcatcccggtcaaagcaacgccgggcaaggcaacgaaacgattgcggagatccgctggacggaggaggaccttcggcactggctgaaagaccatgactggcccgacaacaacgagaacatggacgcgatgcgcgacatgatctcggccagggaattgcgggaccgcagcatcgaggagggatgggagatcatcgacgcgatggtggacgacggccggctcgcccgcaaagacgaaggcgagaaggccgaaacgtccgaaacctacgatcccgcgaacccggccgacccgttgagcattgccgatacgtctgcctcggccgcagccacacgataaaagacccgagcgaaggagcatcatcatggccggattgaaggactaccagatcagcgtgtacgtcgccaacctgggcaaatacgtggagggcgtgttgcagggcgcgtggatcacgctgcccatgcccgccgaacgcttgcaggacaccctgaagaccgaggtgggattgggcggccggtacgaggagtacgcgatccacgactacgagggcggggaaggactgctcgccaccgtggcgaatcccggcgaatacgagtcgctgacggacctgaacctcatgtgccgcgcgttcgaggcgcgcgaggacgacgacccggacgtgtacgagaaggtgcagacggtccgcgacgatcttgacgcggtcccgcgcaccccgttgcagtacgcgaacctcgcgttgaactcggacgagatcccctatcactcttatgatgcgccgtcctcggccgaatcgaaggaggcgaagtatgcctggaccgccgtgaaccaggggtgggcatcggatgccgtgtggtccatgttcgatacggggctcggctatctgatcgatatggagatgtacggccgggacctcacgctcgacggcgatgtgtcgcttggcgacaacggctatctggaggacgcggactggccgagcgatatcgacggacggtactcgcgcgaggagatcgccgaggaggtcgaatggctggatgatttcgacgcgaagaccggttcgccggccgcgttcgacctcgcctcgctcgtccagccgggcgaacgcatcgcggactacacgatttccggcaccggcacgaactggggagccccctcataccagtgcatcgtggaggagggttccaccgatatccatgccgcgcttgaggacacgatgcaccggatcatcgacgcgcgcgccgctactggcgacgccgtggacgtgctgcgcgagaccatgggcgcaatgcccgcagcgtccgtcggcgaagacgacggcgtgagcccgatcgaccttgatctgggatatgtgctgcccggtgccgtcacctcgttcgcggaacgcgcgcaggcgtgcgacccctcggacccgctgaatatgaccgatacggccggttccggcctttccaagtgagaaagggcgagcgagatggccttgacgccttttgacatggagggtgtgaaccgcgacctgctcgcggccgggaatcccgccaagcccgacatgcaatccatcctgcgcaggaacgcgcgcgatctcgtgctggggaacgcgattctggtctcttccgccgatgccaaggaattggagttcggcgtccacatggcgtattccgacgcggacggcggcttcgacaccgatccgagcgaggacgtgtggttcgaggcgtcctcgctcccgattcccaatgaacgccctgatctgcctcccgacaacgcgctcaggatcagggtcacggacgtgctgaccgaatacgggttcacggacattgacgtgaaagccccggacaggacgccggaaggcatctggatcggtttcgaggccatgcagccagtcaggctcgacgtgacctcggcccaggaagggcgttccgtttccttcaccctgacagcagccgaggccaacgattggcgttccggccgtctcgacgcgcacggcctctcacgcatggccgtcgaacgggttctcgccaggccgggcgacacggtgacgctcgcctacggggattcgctgttccggccggcggtgatgtgcgacggttcgggaaggcttcccgagcatcgcgtcaaggccggtatcggcacgttcgtcatcggccgtgaaagcgaggcggtcatgcccgagatactgcggatcgaccgcactgttgacccacgagacccgctcgtgatcgaaaaggcgttcggaaaggagaacgacatggagaacgggaatgtccccgaatactggaaaggcctgatggacgaggccgatctgccgttggcgggcatcgtgcgcgagcacggcggcgggttgatggacttccaccgcatgaaggacatcgaacgcctgaccggttcgagtgactgggatttctactcctggacggtggaaaattacgacgatgacctgctcgacgtgtgcgaacgggagaacgccgccgacgtgctcgccgacttgcaggcatggtggaaaacgagccagcccgacatgcggcaacacgtggacgagatgatggcgggcatcgacgcggccatggaaccgctcgacaagcgcctgtacgccgccgccgaaaaggagttcaaggagcgcgcgttggacccggatggggaatgctaccaattggacggcggcacgttcatctcccaggaatcattcgacggcatctgcggcgaccaacgcgaccgctacatggcatggaagaaccaggccgaacccgccagactcgtgagcgcatgggacgaccccgcacgcctggaccggctcgtgggcgacctgatcgacgcggacgatggcggcggatgcttctacaccgacgcgcagcccatcgactacacgcagggcatggattacagcccacagcagctggccgcagacagcgggctgggagatacggtcccgctggcgtgtgagtccaacgcttcctacagcctcgcgcaccaccccgatatcaaattcaccgccaccgggtctcccgacggcagaaaggcgctggaggtctcggctcccggttccgcccgtcatgcgctgatcacggccaaacccggaacgttcgacgtgagcctgcatgacgagcgcggcatcgtgtccggcgaatccttcccttacgaggcaaacgattcctggacgtaccggctttccggccaggcgttgcgcggcgcgctggacctcgccgtcggctgggccgacccacaggaaacgtctcttgagaccgcagggctcggcctcgcgttggatgacggcatggaaacgacacacggccgctgacgccgtacggcaacgacgaacagaaccaaggagcacacgatggacatgaattggatcgacgagattcgggatcccgaaccccgcaaacggtacatctacaacgctgacgactacgacccgcaatacggggacccgtattaccgtgaacacagcacccgcgccgacagcctgtggcggctgtacgaggagagcggcacgtcgatcacgttcgatgccttcgcggacgaatcccgtcaaaccgattacaggatggagaccggcgctctgcgtgatttcttcaatggatcccagtcggtgctctcctcgtacaggaacccgatgggaggcaacccgctgatcgcgttcggaaacataggccgatgggacggcgaacgcacgggcatatcctcgttcgagaccttcgatgatctgatgaacggcgatgattccccgttcaaggactgcgagatcgaccacatctgggacgagaacggaatcctgaagatgcgcggccaccaccacgacggcagtgtggaggtggagatacgccagctcaccgaccagggatgcgaggcattggaatcctacgagcagtcatgggctggcgaaccgttcgacgccgcaggccgccactacgacggcggcaaggaatccgtggaccgcttctggaacgacctgaaaaaccgatcggggcctggccgtggagccccggtacgtggaactcgcgttcggatgcccgcccatcgaatgggacatcgatgccagggtgagggacttcgccgaacgcatgggcgacgaatatacgagcctgtacgagcaggacacgaccggcatcaagggcggtgatttcgaacgtttcggcgcgttcgcggacaatcacctcgacttcatacgcgccctgacgaaggccaggggcatggatcccatcagcagcgaccgggagatagccgcattcctcaacacattcgacaagctcgccgcgatgcccgaaccatcaccggcatcacaggaaaaggacgaactgtccgccggagtatgcgatccggccgacccgacgatgggctgcctgcaaccggattcgccggcagccatccgatagacgcgaaaggagtccatgatgattttgacgcaatccgacctcgaatcggattccacgcgatgttcgagaacatccatccattcacggacggcaacgggcgaaccgggcgacagattctgaatctcatgctcatggctgccggctaccggcccgtagcaatcaaacatgatgccggccgcagctatgggaaaagtctggaagcatggcaggttgacggcgatcccaagccgttcatttcccagcttgtccaatgcgttgatcaggaagagcgcgccgtagcggaaatcgtcggcagattaagagagaaccctttctcggaaaacgccatcgacgggattagtctcgaagacggtccggcacgagggcgttccctctgattggaacgcttcaggattgtgataggtgtacatgaatatgcgtttttgcgtatgttcgtgtatactcacaaacatgaaaaggagcgaggcgattgaccagctgcgcgagatggacgccaagtactcgtgctacgtgtattgcaagaacgaactggccgtcgtgctgggtgagcaggggcagaaactgaaccgaaccctgtccagcctggtatcggcgaaggcgttggtccgtgccgcccgtggcgtctacgtgttcgcgtattcctcccatctcggcgaggggacacttcatcaggtcgcaaagcggttgcgttccggcgagctggtgtgggaaagcctcgaaagcgctctgtcgcgctggaacgtgatcagccagattccggtggatagggtcacgttcatgaccacgggtcgcgaaggcgagttccataccccgtatggggtgatcgagttcacgcactgcaagctcagctgggaccgcatcctgccgaacctgatcgcccgcgatgacggactgacgccgctcgcgtcgaaacagtgggcgtatcgtgacctgaaggccgtcggacgcaatctcgatctggtggatatggatgaattggaggacgacgatgactggaactgacgaaccgttcaagtacaaagccatggcagcacagatcgtttccgccgagggcatgggcaatctgcttcccgtggtcgagaaggaacttctgcattatcgaatcctggacgccatgatgcgcgagggtttcttctcctcgctggtgttccagggcggcacgagtctgcgcctgtgccacgggtccccgaggtacagcgaggaccttgattttgccggcggcacctcgttcgacatggacacccttaaagggcttggctcctgtatctccgattcgctctcggggatgggcgatgatgtgacggtccgggtcaaggagccgagacccgacgccgatgggctgacgcgcagatggcgtatagcgattcgcacggccggtcagcgcaaggatctgccgagccagacaatcaagctggaggtggcatcgatccccgcgtacgagccgcagcatcgtcccgccttggtcaactatccgatgttcccggccttgtcgggtcagatcatcctcgatgtggaaagccccaccgagattcttgccgacaagctgctctcctatgcctgcgcatcgcacctgcggcgacgcgacctgtgggacatgtgctggttggcgtcgagaggcgacgtcgattcccgacgggcgatggagcttgcggaattgaaatcatctgattacggcgaagaaggactttgggcagaccgtgctgatcgcgtggcgggggtcgccgatgtaatcggctcggatgccttcgccgacgagatgcgccggttcctccccgccggcctgatgacatccacggtcgaatccccacgttggagcgcatgggcgatcgaacagatcgggacgttgtacggcactccaggcactccatcgtcggccgatgcggtttccggattccctattttcggtgcgtcgaacgactccagtccaacccgctgaacgctaaggaggtctgcgatgtcgaatctggactataagttacctgagccgacaaaggcgcaattggagtacgcgtgtcaccttagtcgtttccaagcgccgcgtgaacgccggactcttttcgcccgcaccgaatcagatatcgcagccgccttccgtgaagagaccgcgaaccattcctggaacgccgacgaccttgcctcccaggccggtatcgatccccggcttgccgatgctctgctccagcggggcgaagccccgattgaagcgatgttctccgcagccgatgcgctggggatagacatagccgcgttgccgctttccagtctcgggaacactcggtgagcggtgttggcatgcgccaatatgcgcaaagaagcatgttggcgtataccgtttgttcatccgatcctcgcggtgctaagggaataggtggcgacgctgccggctgttccgacgacctggttcatgggcatggtcagtctcatgtccgtgcgggtggtggattccacggcgttacgcatctcgtcctgcacgaggccgatgtagcgcatggtggtggcgatgttggcgtgccccagcatacggctgacaagcacgatgttgcagccgttcctgtagtagacgcatgtggcgaacctacggcgcaggctgtgcgacgggtatccggttaccgtcttgatcctcttcgccacgtaatcgacgccgcagtgtccctgcacgtctccggggaacagccatacgccggtgcgtttccgcaatgccgaagcgagctttgccggcacgggaagcatccgctccttgttgcccttgccgtggacgtggagcaccatgccctcggcgttctcctccagatcggtcttcaggttgattctggtcatttcgatgcggcgcaggccgcagaacgcgcccagcatgacggccagccgcgcgttctcgtcgggtgatgcgagtccttgttcgatgttctcctcgggacagatgcagccggacggaagggtcatgggcacggtgggcacttcgtccgccggattgcggcgggcgagccctcgcttcatgctccattggtagaagaccttgacgcagctgcgtactccgcgtctgccttcggttcccatgccggctaggtagaatatgaggtcgtcttcggtcacgtcggtgatgcttttatcgacggctttggagaatcgaacgatctggtaccagcgggtgcgcagggtgtcgttcgtgcgtccgatggcgtccatccagtcgatccatttctcaatggattctttccaatcctcccgtggctcgacgtgttcgcagctcttcctgttgtcgttccaatacctcatggggctccttaagcgcatagaaaagggaagtgacttcttcatcacttcccaaggaatactattgcgcgtttctggccgatgctcttcggaaaaccagctgcaaggcgaacatgcgcgatgacacgccgatttgaaggaacagcaaggctggtgtattgtctactcctgttgcaaaaagccctacggctgcgagccagaaccgtatatcggacggtcactggttcaagcccagtcgcaggagccatcgaaagcctcggttctccgaggcttttttattttcatcgtattggtggccagacacgacaccccatcatcaaccgggaaatccatggcgaagacctcaccactactcacatcaggcagacaggtcactgtcaattcaccgatgagaggcacggtattcccagtatcagtttgggaataccgcgcaaatcttacatcgagaccttggtcaggggcatggcggagtcaatcgggaagtcgggggcgctgggggccacgccggcttcgaccaggttcacgccgagcatggcgaccatggcaccgttgtcggtgcagagcttgatttgcgggatacggacgtcgacgccgtagttctcgccgaattcgagcagtttggcgcgcagctgcgagttggcggagaagccgccgcccacgatcagcgtgttggaatcgtactgccggcagccgcgcatggccttacgggccagcacggtggccacggaatcggccagggatgcgcacacgtcgtccaccggaatctcatggccggcggcctgctcgctttccacccaacgggccacggcggtcttgacaccggagaaactgaaatcatacgggtgcgcggcaccggccttgccttgggtcagacccatcggcaccttgatggcgtgcgggtcgccgttctgaccatggcggtcgatgtgcgggccgcccggatacgggaagccgagcaggcgggcgaccttgtcgaagcattcccccgccgcgtcatccagcgtggtgcccaccacatcgattttgcgcggcatgtcttccacgtgcagcagcgaggtgtggccgccggagacgatcagagccagcgtgtccttggggaacgggccgaactgcagctgagtgacggcgatgtgcccgatcacatggttgatgccgtaaatcggcttgttcgcagcccaggccagcgccttggcgccggacacgcccacggccaggcaaccggccagtccgggaccggcggacacggcgatggcgtccacatccgccaacgtcatgttcgcgtcgacgagcgccttggacacgcatggcacgaaggcctcggcgtgcgcgcgggaggcgatttcggggatcacgccgccgtatcgcgcgtgttcctccatggatgaggccacgacgttggagagcagttcgcggccgcgtacgatggcggctgcggtttcgtcgcaggtggattcaatacccagtacaaccggttcgctcatcgtgcttctccgttcttctccgtttgcttgctggtgatgtcttcaatgtccgccgatgccgtctgcggggcggcaaagcccacgaccctaggtttcaggtccaagctcatggtgtatgcgtcgatgccttcgggctggtagtagcgtttgcgcaatcccatgcgttcgaatccgaaccgctgatacagggccagcgcagggtcgttatccacacgcacttcgagcagcatgcgcgaggcgccctgacgtttcgcctcgtcgaccagtacctgaagcaacgcagcggcgatgccttgccgctggtatgccttgcccacgccgatggtcatgagctcggcgtcctcgccgtcgtaccagaagccggcgtagccgcggacaacagcctgttccgcctctcccagcacatccagcagatacgtgcgggccggtgcgtccagttcctctcgcaccatgttcgcattccatgcgccgcggccgaacagttcgccttccaactgtgcgatggaacgaaccgcaagatcacgacttacggcagtgatgtcaacaatcatcggaccacaacccacttcacgccttatcggcaccggcatggccgagcacgtgcttcagtgggttcggtacttcggcgtccggccggcgcaggtacaacggttcgatcggcacgacctggtcgccgcgcagttcgcggctcaacgcggtggtcgcaaagacggcgagcccggctttcccggcatccaataccgatccgtccaccacggagcccagcgcacgcagtccctgccagacggatgcgtatttggccgcgccgtggccggtcacatccaccacatagctgacgccgtcgcgttcgccgtgttccgcgagcgccgcgttcacccgttcgacgatatgctccgggtagtcgatatccatctcgatccagcgtcgttcggcggcgtcctcgtccggcaggctgatgctgccgtggttgagcgagaagtacagctgcttgcggcgcgcatcgttgacgcacagcgtgacgtggcggtcgagttcgtgttccttggcctcggcgtccgggatgtcaccatccgattggcgcgaactcaagcgcggcacgtcggccaggaaatcgatgccgtcgaacatggcgctgtcacccagcacgaagttcatcatctcgccttgcgggtcgagtacgttctgtccgacgagcttggccccggtggcgaaggccaacgccttggcggccacgatgccggcgcgcaggccggtgaatggcgccgggccgatgcccacgacgatctcctcgatatcggcaggagtcaggccggcctcctcgaccgcgcgcgcgatattgacctgcagtttctccacatgggtgcgcgaatcggtctctacaatgggctcgcgccccacaatgccgaccgtcgagccgaatgaggtgtcaatcaccaacgtgcaacccatgaatcctcctagtcgtaaagcctctagagagtgtacatcgaggagtctatgggcgcatggcttattgcaggtcgaacgcggcccatcgcttgccgactgggacgaatgcgacggtacgagtgccgttgctggtgagttcgccgtctgatccagcggatgcgacatcggaggaatcgagaggtcgatcgatatggatttcaagtcgttctggtgccaaggcggtggccatttgttcgccccactccataagcaccaccgtgttctcgccggggtcttcaagttcttcgtccaatcccagcgattccagctcgtccaacaaacgcccgatggcgtcctgccccggcgcataggctgagccgcccagacggtaggcatccacatgcaccagatgagccggagtgccgtcggcgaaatgcccgtcaagttcgcgggcaatggtgaatgtaggagacacgatgggttcggtaatgtccagccccgccccgaagccttgggcgaatgtggttttgccggcaccaagagggcctgagagcagcaatacatcgccgccgtgtaccattccggccacgcggcggccgagctcctgcatggcctcgctggtgggagccgcaatagtgtgttcgctcataaatacccctttatcgacttttaccgacctttatgactgatgtcttcaatgcagcgttccagcgcatataccgggtcgccgccgttcgttttgctttgctcatccgcccaggcgagcatacggatgcaatgcgcgagtcctgccgaagtccagccgccaagttggcgcatcgcattcttcagcacccacggattggttttcgcttcggcctgtgaaatcgtgccggcccggaccgccgaggctttggcaatggtacggagcttcatggccaacgcgccgatcaacgcgatgggatcggtcccttgttccacagctgcacgcatcatgacgatggcttcggcggttttgccttccacggccttgtctgccacggcaaaaccggtgacctgcggattggcggtcaaatactggttgacacagtcgagccccatcggattatcgtcaaagtcgaaacacaattgctcgcacatggcggcgagttcgccggttttgccgccgagcacggataccagctgctgcgcggccatcggttcgactctacgaccgcgtttctcgaattctccgagtacgaaattgagttgggcatccggtttcttcaaatccggcacgtcctctttgcgagcgccggctttcaccagttggtcgatgatcttgcgccctttgacgccgccctcgtgctggcagatcaccacgctggagccgttcggatccttggcggcctgcttggtgtacgtcaccaaagcttcggcgagcttttcgtcggcattctgcaggttgacgagtttgaccacggcaacgtcggaaagcaacgatgggctgacggcttcatcgaaggcatattggtcggccgatgtggcgtcgagctcgatgagttcggcgtcgggtcgcgccttcaacgcttgtgcgcacagtgccttggtgcgcgcgtcgttcaaatacgagtcgcctccgggcaccacggttaccggtacgttcgctgctgttttcgccatgcccccatctcgccacacaggttggacaatgacctgccggcataacggcccggcagcaccccgcgattaggcgtatgcctcatccaacagggcgtcgatatccgcgaaacgcttgggaccgggacgccataccgggtgaccggccgcgatgaccaatgccgggtgttccaacgcgcgcaggtcgtccagcggattggcattcagcacaagcaaatcagcggatttgccgacttccaaagaaccggtctcggcatcggcgccgagaatggaggcgttgacggcagtggctgcgtgcagggcctcagccggactgaaaccggcatatgcgaccagcagctccagctcacgccatgtggcgtactgcggcacgaatgtcatgcctgtatcggtgccgacgcctatcatcaatccggcctcgtgcgcctgacgagcacctgaaaccatgcctccgaccacgtttttggaattctccaattggatgtcggtgatgccggtcacgtcctgtccaagcaaggtcaatggcaggccggcggacagtgtcggaatcaatgccgagtatccgcgcaacgcattcggattgtgccggaacatgccgatcaattcgtcgtcgagcacgctaccgtgttcgatggtatcgacgccggccagcagcgaacgccgcacgccttccgggctttgcgcgtgcgcgccgacaataacaccatactgatgcgcctcatcgcaaatcgcccgcatctgttccacgctcatctgcgggctgccggcctcgccgatttcctgtgcatcggttacgccgccggtcgcggcgattttgatggcgttgacgccagccttgagattctgcgcgactgcggtacgcgcctcttccggggtgccgctggtcagtgcgataagcggggcgccatggccttcgggaatcgccatcagcggtccggacgccaagatacgcggtccgaggatttggcctgcatcaatctgatcgcgtaatgtcacgacttcatatcccacgtcgccaagcgtgcggatcgtcgtaacgccggactccagcaatgttgtggcgttgtgttttacggttgcggccatgtacggcttgcccaatggcgaatgcgcgaatgtggcgaccatacgttggcctttgggcgtcgccagcttcggattgagcggcttgccttgggagaacagatgggtatgcgcattgatcagccccggcatcacgattttgccggtgccgtcaagatagtggtattcggctgggatactggtttcgatgctgggtgcaacctgttcgatacgtccgtcggctccgaccacgatcgtcatgttacgcagtatggttccggctttatctccggtgacgatggtggcgtgggccaatgcgaatggttcgactatcggattatgagacaacatcatcgccggcactccttcatgcagctggttgaactggtctcaactgtatcgcagttttgccggctgatggtttatgccgcgcggcctatcgcataggttcggctggctattgcgatggttgctgcaccgaataccgcattggctattcggcttgccgccgcgtaaagagacgtctcgtctcctcgcaccagagactgaggcggacacgccaagcggaaccgaagcgcacgccaggcattccggcctcataacgacggacatgctggaggcaacggctgacgaacaccagtagcatgccgataccgatttccaccgccacaatcagcacggcacccgtaacgccgtctttccatgggatgacggccatcgtgctgccacccagccacaacgccacccgttccatcaccagcgtgccccatgacgatatccacgcgaatacgccggccagccatggctcgcaccatgcgcaggccaatgccatcaatcccgccatcgtggccaatcccacaaacggcgacaccaacaggttcgccggcacggacagcaacggcaactccggttccatcaacacctgaatcggcagggtgaacaactgcgcggccacggtcatcgccatcatttcggcgatgccgtgcggcatcgctcgctcaaaggcaccggccagccgctccgcaaacagcacgatacccagtacggcggccgaagacaaggcgaatccgtagctggccgacatatccggattcaccgccaatacaccgattaccgtccagcacagggcgctcaacgcttgcgtacgccgccccatcgcatacgtcaacgcacctatcaatcccatgatgaacgcgcgggtgaccgaatcactggggaacatcgccaatgccagcagcacatatactccagagaccagcaacgccgtcagccgccgatcaagcagcatccacatgcataaccggcgcaccaatcccgccaccagtacaaagtggccgccggatacggccatgaggtgcatgatgccggactggcggaactgattctccaacgtttgcgcatacgtgctgttgaccggcatcggaccggtctcgccgccgatataatcctggccaagcacacccatcgtcaatcccggcaccaacacacgcccctgatcggacaattgttcggtcacggtgaaaaacgcctcctgcacatgcgcaatcgcggcgagatgccacggcggagcccgcacctgtgctaccggctgttttccttccaagagcagccatagtggtatgcgtccatatcgcgcttgctgcaatacgcctgtcagcagatggaccgcgcctcgacgcaactgcccacaatacgattcgtcggcgtatacacgcacagcgaccgtggaacgtacatccgtaccatccacagtgatgccgctcagccgtatgtccgtctgacaatcgtatgtgcgttggtccgaagcgatcacgggcgtcgtcaccgtggccatgacttcgtggtatgaactggattggcgagcttgtgcggaggcaggatcatgccaggcaatggtgtccgacgcgattgccgtcatactgccgatgcacgccaccgcaacgcatacggtcaatgttcccgtccaccggatccgcaggcggaaagacaccacgatcatcgccgccacggcagcacatgacgccactgttataggcaatattcgtgtgacaggccattccatgccgattatggtgacgtcaatgccagctccggcatcggcctttgcctgaccagtgccgagtccatcagacatcctccatgcgaataatgcgtgcgctcccagactcgccgcccacatcactatggcgatcggcagcatcctccaatcgcggctcccctgctcgcgcagtatccaatccctgctcatccgaccgtcacctgccctcgcatggtctccaacgtcttggagccgatgcctttgacatccagcagctgatcgactgatgtatacccgccaatcgccgtgcgatgatcaatgatccgctgagcggtaaccggcccaatacctttgatggattgcaattcctcagcggtagccgtgttgaggttgataagaccatgcgtggaagcgccggcatcgctgccgtccgtctgcatgtgcggagattgcgtggtatccgattcggggttcgctgtggcatcggaatgctccgactgctgcggatccgtgcgtttctcgtccgtggtgttctgcgatggcatcgtctgatctccagcggagccgcccgtggtctgcatggcggtcggttgagacagcatggccatattcatcgactgttggaccagcaatgccaagctgatgccaagggcgacgatcagcagcaatatcacggccaaggcatgcccaatggtgaacgacaatcgcggctgatcccgggtgagtctggctgattcgccgacggcatcggcggaacgtacgccaatcagatccgataacgcacgtttgtcacgggtcgcctgccgcaggccgctctgcgccctttggggcgggtggccagccggacggatccgtgcatggccaggaggcggcggaggcgtcgtgggccgttccactcgcggttggggcatggctgcgctctgcctgctgaatgcgcgcaaacggttggcggcatggtctgcgcgatggttatgagaaacgcccatgcatccacgctgatggattcatgggcgtttgtccagctgaaacggggtatgtggttctagcttatgaagttatccacaattgaggtgggcggttgacgctcccctcagtctcgctacgcgagccagctcccctcaaagaggggagctggctcgcaacaagtcactccgcgggaacgatggagacgatcttcggggccttgacgatcaccttgcgcggctccttgccgccaagacggtcggcgacggcggcaagcgcctgcttctcgagatcggccggatcgatgtcgaccggcacttcgagcttggcgcgcaccttgcccttgatctgcaccacggcggtcacggtgtcgtggcccacgtagcgttcgtcggccaccggccacggctcggcggacagggattcggcgtgaccgagcttgctccacatctcctcgcagatgtgcggggcaatcggcgcgagcatcaggatcagcggctccacggcggcacgcggcacagccttcagaccggtcaggtggttgttgagcacgatgagcttggcgatggcggtgttcgggcgcatgccttccatttccgcggtcacttcggcaatcgtgttgttgagcagcttcagggtcttttcgtccggcgtgtcctcagtcacatgggcctggccggtggtctcatcgaccacattgcgccacagacgctgcaggaagcgcatgccaccgaccacgttgcgggtgttccacgggcgagactcgtccagcgggcccatgctcatttcgtacaggcggaaggtgtcggcaccgtagttctcgtacatgtagtccggggtcacgatgttcttgagggacttgcccatcttgccgaactcgcggttggcatgttcgccgttccaggtgaaggtcggctcgccggaggcgtcggccgggccttccacgacctcgtcggccggcacgtactggccgcggtcgtcggtgtaggcgtaggcctggatcatgccctggttgaacagcttgtggaacggttcggccgagtccacgtagccgaggtcgaagagcaccttgtgccagaagcgggagtagagcaggtggagcacagcgtgttcgacgccgccgatgtacaggtccacaccgccttcatcacccgagtacttgttgtggttcgggcccatccagtagtcgaactcgtccttctccaccatgtgcttggtgtcggtcgggtcgatgtaacgcatgtagtaccagcaggagccggcccagttcggcatggtgttggtgtcgcggtagtaggtcttcttgccgtcgcccaagtcgagctcgaccttgacccagtcctcgttgcggctcaacggtgcctccgggttggactctgcgtccatcggatcgaaggtgcgcggctcatagtcgggcacgtcgggcaggttgatcggcaatgcggaatccggcagcaggtgcggggtgccgtcttcgccgtagacgatcgggaagggctcgccccagtagcgctggcgggagaacagccagtcgcgcagacggtagcttacggtgcccttgcccacgccggcggattcgagccaggcgttgaccttggcgatggcgtcgtccacgcgcaggccgttaaggctcagcgcgtcgcccttggcttcggtggcctcgacggaggagttgatcacgatgccgtcatgggagacgaacggcgccttgccctcgtagttggccaagtcgtcgccggaatccggcagaggcgtgacggtgtagatgacaggcagaccgaacttcacggcaaagtcgtaatcgcgctggtcgccaccaggcacggccataatggcaccggtgccgtagtccatcagcacgtagtcggcagtaaacagcgggagcttcgcgccggtgatcgggttggtggcgtacaggccggtgaacagaccggtcttctcaccggcctcgttcacgcggtccttggcggtcttggcttcggcggccagacggtaggccttcaccgcctcgaccgggttggcatagccgcccttccagtcttcgggtacatcggccggccattcggcgggcacgttctccagcaggtgatgttccggggaaaccacggcgaacgtggtgccgaacagcgtgtcgggacgggtggtgtagatttccatgtccttgtcaccgtcggcagtggccacgatgaagtgcacggaggcaccatgggattcaccgatccagttgcgctgcatgagcttgaccttctcaggccagttgatgccgtcaagatcggcgatgagacggtggccgtacttggtgatgcgcatggaccactggcgtagctcacgctggaagaccgggaagttgccacgctcggacttaccttcggcggtgacctcttcgttggccagcacggtgcccagacccgggcaccagttgaccggggacttggagatgtaggccaggcggaagtcgttcaagatatcctgctgctcggcgtcagtgaggtcggaccactgcttgccatcggactcgtggcccggaatggccttttcgccggattcgaacttggccacgagctcggcgatcgggcgtgcggagcccttggagccggacgggttggtggcgtcctcgtcgtaccaggaatcgtagatgcgcgagaagatccattgggtccagcgcacgtagccggggtcgatggtggcgaacgtacgacggttgtcgaagctcaggcccatacggtgcagctggcggctcatgttggcgatgttcgcctcagtggtcacgcgcgggtgctggccggtctggactgcgtactgttcggcaggcaggccgaaggcgtcgtaacccatggcgtgcaggacgttctcgcccttcatgcggtggtagcggctcaccacgtcggaggccaggtagcccagcgggtggccgacgtgcaggcccttgccggacgggtagggaaacatgtccatggcgaagtaggcggtgcggccttcggcgttacggcccttgccgtccttcaaatcgccgttgacgttggcggcccagaaggtgccttgctcgtcccaaatcttctgccacttgttttcgatgtcctgcgccagtgcggcgttgtagcggaagttgggctcttcggtttgcgtgctcttctcgttgtcactcataaatcagcaaggtagcctcgcaactggacacgtcgtcaatcgttattcagcatccgagacgatggctttggggtcgccgttcagcgaaaccgtgagctttgtttggcttgtgaacgtatccttggcggccgtccagctgccatcctcaaccatgtcttccaatgcttccgcgattttctgcgccaattggctggtgccttgactcacggcgatgccataaccgacctcgcccttgtccgcaatcacgtccatatactggggcccgttggccgcttgaagaccggaaagcaccgccatatcggaggctatggcatccgccgaccctacttgcacggccgtgacgcactgcgcataactgctgcgctcctgaatccgggcctgcgggtggttgccgcggaagatgccgactgtctcgtcacctttcactgcgcacaccgtgccgtcgcctacgtcacccaccgaacctgcgtcattgatgaatcggccacgctcatccgacctgaccagcaaaccgacgctggtcgtgaggtatggtccggcaaaatcaacgatcgcactggacccatcggtgataggccaagaggcgacgaccatgtcgacctgtccattgtccagcatggagcgccggttttcggggcgaacctgtttgaagacgatctgcttgttcgcatagccgagtttggcggccacgtatttggcgatggtgatgtcgaagccctggtatgtgccgtcatgccatgctcccaccgatggctcgtcggctgcgaccccaatggcgatggtgggcccctccggcgctccggagacggtggtgacttgaatttggccgcaaccggccagaccggataatggcaatatcacgccaaaggccgcggcgaatcctgccatcagtcgggagcgaaatccgcgccgcatcggacggcgagcgcggagcatgctacggctggcgaacgatgaccagtggtgcataaccgtcaaacgccttacttgaacatgcgcgaacgtgtgaggaaccaggcaaccgcaccggaaagcaccatggaaatcacgataatgagcatgaaaccccacggcttgtcagtgaacggcatacccatcatgccgccatcgaagttcatgccgtacatcgagaagatcagggtcgggatggacagtgtgatggagatgatggtgaagatgcgcatcacgttgttcaggttattggacacgatcgaggcgaaagcgtcggtcatgttcgcaagaacgccgctgtaaatgttggccatctcgatagcctgcttgttttcggtgatgacgtcgtcgagcaggtcctcgtcgtccgggtattgcttgatgcgttgcagggtggtgagcttctccatcacgatttcgttcgatttcagcgatgtggtgaaatacaccaaagtcttgctcagctccatgagcatcacgatctcgcggttctgcatggagtggcgcagcttcagttcaagcttgtcgctttcgcggtcgatgatgcgcaggtaacgcaggtacatcgtggcgttgcggtacaggatctgcaggatgaagcgcgaacgcatgaaggtgttgaagcctcggatcgtgccttccatgaatgggtggagcacgggcgtgtcctgcatgcagacggtgatgatgaggttttcggtgacgatgatcgacagcgggatggtctcgtaccagtcgcgtccgccacgctcttccacggtgggaatgtcgacgatgatcatcgtgtaatcgtcttcgacgtctacacgtgaacgttcctcgtcatccaaaggggcacgcaggtcggccaggtcgatgccggtttgcgaggcgacggtggcgagctccacatcagtgggttcgctcaaacataaccaggagccgttttccggtttctcgatctgctccacttggccattgattgagctgaagattctcagcatgtcgtctcacccgccttccgcgctttcttactgttctatcgctgtacggttccaaaccgagattagtctagacccaccgttcgaatttgcgagcggggtttcgcatagcgaccatcaccagacgattggctgccaacttggcatgtgcggtcctcgcagatcggtcggcccgttctcccagtcggcgctgtcggcgatggcgggagccttgttgtattcctccaactcccacaggggctgttcgatgggggtgccgttgacgctgtggcgcactttgagccggcaccaacaggcgttgcgcatgccgccgagtgcgttcatgccgtccgggtcgagttcgagcaggttggagatggtggcggtaatccatgagccatgggtgacgagcatcagcgtggtgggcgtgctgtctgaataggcggagtcgatgaccagtgcgcgcacggcatcggcacctcgctgccccacggcggcacggctttccacaccatgcttggtttcgcccccagtgtgctgtttccaagaggcgtagtcgtcggctgccacggctttgatttcggcgcgggtcatgccttcccactcgccgaagctgcgttcacgcagtcgttggtcacaggtgactggcaatcccaaaatatcggcgaaggcgtgtgcggtctgttgggcacggaacaggtcggaggtcatcaccaccatgcgccggccggcggcgggagcctcctcgaactggcgcgtatcagtgcgttcggcggcgtcaggaccgggctgggcgatggcttcgggatgctcggcaagtcggttcaccttggcccagtaataccgtgaagcgagcgcgaatccggtctggtcaacctgccattggcctacgatgtcgagcggcacatcgatctggccttgcaagcgatgttcgagattgtattgcgtacggccatgacgcagcatcatcacttcatcgatcatcggttttcgccacctcgttctcttgcggtttgccatactcatctcagcacaacccctagaatggcggcatggagatttctgagtcgacttgggcgttcatcgccaaacaccgccgtgaagatgtgcgtgatgtggccttgcacgccaagcatgatggcaacgtggatgtgccgttcgcgctggagcaaattgccggctggcagcgcgcttcactcaagctacctgactgggcgtcccatgatgggctgattttcccgccgcaagtcccaatggaacaatgttccagccaattcaccgcacagtacaaggctcggctggcacagcgattgttggccgaagaagcagtcgacgacgactccccggcatccctagtcgatctgaccggcggtttcggcgtcgacttttcttacatgtcccgagtgttcaatcgtgccatatatatggaacaacaatccattttatgtgatatcgctcgccataatttcccgatactcggccttgaccacgccgaagtcatcaatgatgattcaacagcagtgcttgacacgcttggccgagtctccatgatcttcctcgatccggcccgccgtgacgatcatggctcgcgtacctacgcgattgccgattgcatgccggatgtgctgaccctgaaggatatgctgctggccaaggcaccgacggtcatggtcaagctctcccccatgctcgactggcataagaccgtcgccgatttcgccggcgcggtacatgaggtgcatatcgtctccaccgggaatgagtgcaaggaattgttgctggtgttggggcgcggccgttacgcctcaccgctcgtggtatgtgctaatgacgagcaggtgctgtcgtacaaggccggcgataacagcgacaatcacaccactatcagcgattctgccttggctgcacgcaatacttgcaataccgaagattccctgtctgaggaaagcgcgaacgacttcgattcctcgcattggaagtacctttacgagcccaacgcctcaatcatgaaggccggatgctttgatgttctcgaacagcgcttcgccgtgcatcacatcagcccgaatagccacctgttcgtggcggccgaacctattgccgattttccaggcaggtcattcgccatcgaatccatcgccaccatgaacaagaaagaactgaaacagctattggccggcctcacgcacgccaacatcgccgtacgcaatttccccctaaccgtggcccagctgcgcaaaaaactcaaactcaaggacggtggtagcacctacctcttcgccaccaccgacgcccaaggccgtcacctagtactgcgcactaaaaagcgaaaaagtggctccctctgacgaggaagccaccaatacgtcagctaatcagtccttggcgatggtcttgccggcggtcggaccggaggcaaggtcctggatctcggtgacttcgagaaccggaatcacggccggcttcttggtgcccttttcctcggcgaccttgacctgctcgttgtagatgtcgtcgtcaacgtgcagcaccacgttgccgcggaagcggtagccctgcttcttctcgaggttggcgaaagcgatgaccagcggggaaccgttcttgaggttctcatagtgctggccggcggtgcgctcgtggtaggcgatgtgcgtgtcgtccagcacgaacagggacatcttcgggccgaggtccagttcgccgtccttggagacggtggtgatccagccaaggttgttcttgatgaattccttgatttccggagtaatgactgccatgtcgaatcctttcatgattgctacggataacgtatccttactctttccagagtaccggtttcgaacgcgactagcccggatgttcgctgtgagtaacctcaccttcgcacagctttcatccggtttttgcctgcttggcgatgccatgccccggtcgcgcaccagccacacacctgtcacacacccgacacccatcgaccggtcgattttggccggtagttcccgtaatctgtgagccgagagagccacaagttttcctaactgtcctgaggtgcaccatgggtttggtcgaacgtttcagcaagctgcgcagccgctggtcccgcaactttcccccgaatctcgcccgactcatgttgctgggctgcgctgcattatggggtggcagctatctgctcgccaaattcgccatggaggcgattccgccccaatggctgatgggtctgcgcatgatcggcgcctgcctgtgcatgctggccttgttccataagcacatcgtgccgtatctgacgccgaaaatcattgtgccggcgctcgtggtgggcctgacctactggggcacgatggtcacccagaccatcggcctgcagaccattgaaccgggccgcagcgcgttcctgacggccgcctactgcgtactcaccccgttcgccacgtggattatttcaaaaaaccgcccgaaggccatcaatctggtcgccggcgtgatctgtctgatcggcgtcggcttcgtctcgctgaagccgggcggttcgctgtcgctgagtgccggcgactggctgaccatcgccaccgcggtcatcttctcgttcaatctgacctgccttggtgtctacaccaaacgcttcgaccctatcgccgtcacttttgtgcagttcggcgttgccggcgtattgttcatcatcggcgcgttgttcaccgaacccatgccgaacgccagctggctggcaccctcagtagtggccagcgtgctctatctgttcctcggcgccacgatgagtgcccagatcatgcagaacatcggtctggctcacgtgcctgcctcgcaggcgtcaatcatcatgtgtacggaaagtctgttcgctgtcacgttctccgcgctgttctggggcgagacaatcatgtggagttcactggtgggctttgcgctgatcttcgtcgccgtgctgatgtcggtaatcaagccgaccaaacagtcgctgcaccggaactgacgattcagtttcggccatggatggtcatgggttctccattgccctgaaccgttacggtgaaggccgaggctcttgaaggcgtgcaatcggaaatcggacttggcatcgccaaactgcatttcgagttgggtgccggcaacggcagcttcgcttgggctgcatgacgttctgctgaacgtcgttttcgctccaagcgaaccaatttcggttgttctttgcgctactttgcgccactttgcgctgattcccactgctcatcggcaccatatttttgagtcattccacattccgctggctaggttttgaaggtctcgtgtaggcatcctctcggtatcaccgagccttaagcaaccttccagcccgacactttacggtcgtgtcttgtgaagaagtttttcgaaggtctttccctctcatccatcgtggcgggcacccttgccgccgtcacctcattcttactggcatcgaaaatcggtatcgccggctcggtaatcggcgcggcagccagctacatcgtctccgcggtggccaccaaaatctatcaaaacatactcaccgcctccggtgagaaactacagtcggcctcgtcttccggcaatgacgatgacactacggataataagtccgataaggcagccgaatccgagtccgatacgacgatgaccggcatggtcaataccgtttccaccgcgcgcaagccgcgcgaagtcgtgtccaatcgagcgaacggacgaacctattcggtcaatgaactgcgcaaggcccgctcccataattcgaagcgcaccgccattatcgtcacgctggtatccggcctgctcgccgtggcagtaaccgccggcatcgtcatgctggtcacgcagggccgtggcacggaccatatcatcactccgtccaccacgcccacgcaaaccgacaccaaaacgcagaccgacacgtccaatcagaataacggactgccgcagccgggcattaccgacggttcgaatgattccaacaccaaggactccacatccggctcgtccaacgacggcaccgattcaagcacgttcggctcaaccggcaccgactcctcaaccgattccaacaccaatggatccaccgatggttcgaccggcaccgattcctccactaattcgggcacgactggcggttccaccggttccggcaccaccggaggcaccaccggcaccggcaacggttcaaccggatcgggttcaggatcagccaatggctccggttcctcttccagctccacgggcggatcatccagttcaaactccggtaatagcggttcgagcggctcctcaaccggtagcagcagcggaaccggcatcaaattcattggctgacaatcgccgactcgatagcagcgatggcggcaatgccagtcaatgacgtggggcaatgagaacatggaacgtatgactaccatcattatgaatacctctgatgataatcgtggtcagctgtttttggctttattccaaggttttccatttttgggaaacctgccgattaccctcgtttttcacgaggcacctacaggcacccaagaataatctcgactgcccccaccggccgaccaccaccggccggtccatgatgctcattcgagatctcccgccgacgataggcgcccggacccataccgtctatccaaggggaagccaatgaaggacacggagaacaggccgcaaccgagaaaacgcaggaaatggggatcggtgatcgtccgcagggacgcggacggcaacccgaccagtttccaggcgcggtacgtcaacccgctcgacccgcccaagaaggtcggacggaacttcggcctggaatacgagacggaggcctacaggtggctcgacgaggagcgctacctcgtcacactccacaacaaaggcatcaggcaatgggttcatccatcgcagcgaggcgcaaacaccatgcccacattcagggaatactccaaggactacttcgacaaataccgcaaaccggacggcagcaagctatccggccggtccaaccgatgcaacggaatcgtactgcgtcggctcaacgagacgttcggagacaccccgctcgaccgcatcacccggcaaatggtagacgaatggtatgcaaacgccagagacacgttgacggcatggacgttcgaacaggcggcgcgaacactcaaacgaatcatgctcgccgccgcgaacgaacaggcggatggcaccccgccgctcatccccgcgagcccgtgccggtaccgcgtcgtcaaaccgcaatccaaacgacgtgaccaaccgccggtcaccgccgacgagatcaacaggctggccgagctcttccccgactaccagcggctcgcgctctggctctcccttctggcaggcggactgcgcctcggcgaggtatgcgcactgcaactcagggacatcgacctggagaacctgcaactccacgtccgccactccgtcaaccgcggccccgacgacaggggcaaataccaattatgcgagcccaagaccaaaagcagcaaaagggtcgtgcccatcccgaaaccactcgccccgctcatcgaggcccatatcagccggttctgcaaggaccgcaagcccgacaccatgctgtttcactcgcctatgctggacgattggctgctcccgcccacgaccatcgaacggacattccgcatggcccgcgaaaagatcggacgccccgacatcaccttccactcgttgcgcgccacgcacgccaccatgctcgtcctcgagggcgggaccatgcgcgagacgatggacgacctcggacacaccagcctcaccgtcgcggtggacagctaccaacgggtcgtcagagaacaccaccgcgacaccgtggaactcctcgcctaccggtacatgccatcgaacgatccgaccgtaatccgcacggtcatcgatcagaaggaacgccagatcgacaagctccgggacgaagtggaaagactcaggaagatcctgctggaacgggataccggaataccgacggacccggacaccgttttaccgaaaaaccaaaaccggtaaagaccggcatcaaacggaacagcctcacacgtctaagtgttgcaacaagtacagcggcaacgcttaaacacgtgaggcagccacggtcgaagcgcgaggcaatgccttcaaccgactggataccgcgataccggaaccggtaaataccgaaaaaccgagataacgaaaccggttttcagccctcggaatccattaccgtacgacccttgccgaagagatggccgagccattttctgattcgcgggtcgttcacgttgtcgttgtagacccatccctcgttgccggtgttgtacggaggatcgatgtagatgcaatccaccttcccctcgtactcgggcagcagggccttgagcgcctcgagattgtccccatggatgaccatgttgccgcaatcggatccatgcgaatccaaaacgctcttttcagggatgcgttcgagtacacggtacggcacttgacggtggtatgcgaccaccttgctctttcccatccactccaaagtcggcatgacccgttctcctcgctacatcaaatcgatatatccaaagtataggctttcgggctaatggctcatatggcgcccaggaccttcgcgatcaatcccggcactcttgccatccccgtcttgccgagcaagattcttccgcagcgtgtcgccgaatctgtccagcagatccgttttgctgcgaatggcgtccggcttccgacgcaatccctcgaccagatcgatgaacgcgtgttcctcctgttccacgcagtcgaggaacacagaacagaacgccacgggatcgccgtccacctgccaggtctccagactgcgggcatagtcgcgcttggcgtcatacttgatcgccacgggacgatagccgtgcttcagcagcatgaaattaagcagctggcggccggtccgcccgttgccgtccatgaacgggtggatgttctcgaacatcgcatggaagccggcggccctgagcagcggatgagcgccgctcgcgtccagcccgtcgatcagggcccgcaggtcgtcgcggatctccagcgggtcggcggtcttgacgcgggtcgcggtgatcctcgccagataaccgtaggggcggaacgtgccgcgggcgaacggctggaggtccagcgccgtcacctcatggacgcgccggaccagttcctcatccagtctcctcccctcccgggcgtattcgcgtacgtaggccatgccgtccgcgacgccgcgcgcggcgaacacgtaccgtgccggcgaatccgacgggacgaactcgccctccaaaaccagggacgtgtcctccagggtcagcgtggatccctctatggcgtttgaattgtaggtgtagcgcaccagccagtcgcggtcgtaatccgccagcgccatgtcctcgacgccgtccagggggtccagtgcgcgggcacggtccttcagcgcgtcgattcgtcgcaggcgttcgacgattcccggctcgcgttcaaggccgagcagttcctcgggcagttcctgtatgcgctgcgatagctcgggattggccatcatgtccctcttttcgtgttccggttgcaaagtccattattccagccgcggttcgttccgtcctgcggcctgcatgtcatagggaggcgcgccggccgtcccgggtcgattcgaacgccgcggccacttcttccgataccggcatgcgcatcgtcacccggccggtttcctgcgcggcggcacgtttcatggctcggcgttcggctctggtgggccgttcgagaatccactcggcgaacgcgcggataaggatggacgcgacgatcacgccgatggatccccagaagcacgggacgaagtccggctttgtatggtcggtccagaaccaggcgatcaacgcgaggatcaacgccaggccggcggacagggcggcgagcttgtggaacacgagggcgagcgtgcggatgggatgcgtgaccagtcccaccgccagcgcgacgacgacgagcagtgcgacgaagccggcggcgatgacggcgacgcccaggtatatcgcgagcatgtagagtccgaacatgatcggccttccttccctctcctattccgtttcttcgggcagataggtgtagtcgacggcgacgccctccgcctcaagcagcacggctgcctcgcgcacggcggcggcgcggcgcttcacggattcctcggcccggacccagtcgggcagcccctcgggcaggtcggagacgcgggagaacgagagcacggcccgctcatctcccctgtgccgttccatgatggccgcgacggcgcgcctgtgctcggcgagatagtgttcgagcatctcccgcattctccccgagggttggatccggtatttctccgactcgtatttcttgaccatgtccacggtgaggttcgcaagcacggccgcgtcgtgctgggtcatgccgatgcgttcgcgcgtcgcgcgcatccacgccttggcctcgctccaatcctcttttgccatggtccctcctggatataagaaagccggatccgcctgcgcgaaccgtgattatacttttagtataatcgaggttttctacagggcggacccggcgtttcccgggacgcggccgtggctgcgccccggtttcgtcactcggtcggcatcgatggattatcgtcggccgtggccttgcgctgctggtcgagcatctgctgctggatgagcacgctgttggtctgtgccgtgtactgcttctgggccatgtccatgctttcctggtggcgttggccgaagtcgaaggcgacgcccttgtccttgtcgatgacgagcgcggcgtcaaacgtgccgcccttcctcgaggtgaagcccttgaggctgaccttccggccgtcgagcagcctgcgcatggtcgtgtcggtgatggtcttgccggcgatggtcgtccaggcgcgccagccgcatccctccgtggtcttccatgtgccgtcgggttgtttctcacgccggttggtggagcattggaacaccttgcccgttttgacgacgggcttgccgcagcgcgggcagccgccgaacgattccgtgttccgtgttttcgtctgcacgtggtcctgccggacggtggtctgcgcgtcggccgggatgcgggcggcgaggtcgcggaactccgtttcgacctgcgaggccgcggcctgtccgtgttcgacctccgagaggcgtcgttccatgtcggcggtcagtgccacgtccttgagcttcggggcgaccacgtcgatcagggaccggccctgttcggtggagcggagctgcttgcccttgcgttccacgtatccggtgcggatcagcttctcgatcacgtcggcgcgtgtggccggcgtgccgatgcctcccgagtgggattcgtcgtcgtccaatgcggccttgagatccttgtcctccacgcggcggctggcgtgttccatcgcggcgagcagcgtcgcctcgctgaacggcttcggcggtttcgtctttccctcggacaatgtcgcgccgcattgcgggacgggcgcgatggagaccccggtgacgaggttcgcggggatgatgttgcccgcagtctcgtcattgtcgtcctgatcttcctgtggcccgtcatgttcgatggcgtgccagccgagggagacgggctggtcggaacggctggtgaaacggcattcgccttcggacaggaggcggccttcgtccggatgcttttcgcaccaatgcgggtcgatgttcgcgacgacgttcgtcacgtcgtgcacgtagtcgtcgcccacggcttcccacatgcggcgcgccacgcggacgagcacgaggcgttcgtcatcgccgagttcgtcgagcgccgccttgtcggcctgcatggtgggaaggatggcggtgtggccggcgaccttcgcgtcgttcacggtcagttcgagatgtggccgttccggtttcgcgtccggttcgatgaagccggtgacgaggcgatcgccttcggtgaggccgcgcagcgtgtccaggtcgtcgtgcgtgatgtactgcgagtcggtgcgcggatacgtcgccagttttttctcatacagggattgcaaggcggccaaggtgcgggcggcggtcaggccgtgcagccggctcatgtccttctgcaatccggtcagatcgtacaggcggggcggtgcgtcgtgctgctgtttgcggtcggccttgaagatcgagaaggcgaagtcgtccgagttgacgatccgcagcagcgtctcggcgtcctcccgcttgtccaggcgttcgccggccagtttccatccgcccatcggggcgacgaccttccagtacggtcgggcgacatggccggctatctgccggtcgcggtccacgatcatcgcgagtgtgggtgtctgcacgcggccgacggtgaacctcgcgttgtagacgaggctgtaggcgcgcgacgcgttcatgccgatgagccagtcggccttcgcgcggatcatcgccgaatcggcgagtccctggtattccgtctcgtccttcatggacgcgagggcgtcgcggatggcgtcttcttccaggctcgcgacccacaggcgtcgcatcggcttggagacgccggcatgcgtcacgattctgcggaagatggcctcgccctcgcggtcggggtcgcacgcgttgaccaatgagtcggtgtcgcctcggcgcatcagtcccgcgacgatcttgtactgccggtccgtgcccttctcccggctgaccttccattgccagttgggcgtcgggtcgatgggcagcgtgtccaggctccacctgccccagtcgtggccctggtattcgtcgggcgcggccaggtcgacgaggtggccctgcgcccaggtgaccaggtcgtcgccgacctcgatgtagccgtcatgcttttccgcatgcccgccgaatgcttgcgcgatggcctggccgaccgaatgcttctcggcgatgatcaatcgcatcccgcatcacatccgatcatcagtagctgccggacgcccacgcgggtcgtccggcatccgacgtgtccggtccggcggcgtcctgcggggcgggctcgtcgtccgtcgcctggatgtcggatccggtcgtctccggatccgattcggcgacggtctccggttcggagggtggggtctttcttccgcccggcgcggcgacgagttcgcccttcgcgtcgaacgcgatgttcttctccgttccggtcatcgccagcttgtccgcgatcatcgtccgactcatgccggggaacgcctcctcgaattgcctcgccgcgtcgcgcagcgcctgcgcgcttttgcggaaattgtcgaggcggttgtcgaacttcttcgccgccgtctccttgcgtttgaacgactcgcgttcgtcgcgcaggaagtcgtccacgtaatcggatgccatggtccgtttcctttccagtcttgttttcatcggttcccggttttgatccggctggaaccatggtcacgcgattggacacgcgccggtttggacagtcgggctccgccaggatcacacgcttgtgatcctggcttcgccggaaacggagcgcggccctgggccgcgcgctatcttcgccgacccttccgggatttccaggcgtcaacgcctggaagggaacggccgacccggccatggttcatcatcacagccccgcgcccgcgtcttcggaactgcgtgttccatgctccgctccgggagggtttcgcccgattatcccgaagcgggcacggcccacgcgtcctccaccgcgcggcgggaccgcgaggctgccccatgtccggcgaaaggaaaacaggaacgccggcgggacactaaggagtggaaccatgcagatggaaccgatggaattgcagcacgtcgtcttcgagaccgacgggggacgaatcgacgcgatgtggagcgacgtgcgtctccacgagcacgacatcaccgacggatggcactgctacgccgtcaggggcggcgacggcggatggccgccatgcagcatcgagaaaacagtatgggtcaaccacgcgggcgacatcatcacgcccgacgacctcgacccgctgctcgaaaggaacgggtggatgctcgtcatcagggactggtggttcaccgacgaaccgttcgggcgcgcagaatgaaaggagacatggacatgaaggagaagaacagggccgaggaatggttccgggccaaacacgacgagctcgccgaaacggcgcaggccaacctcgccgcacacgacttggaacccggacaggaggcctaccatctggacagcctccactatgcgaccgccgaacagatggaggccatatgcccgacgggcatcgacttcgaccggtacgcgactctggcgaacggcagcgtcggatacgacgaggccgacgcgcattgggccgacgcggcatggtgggacgaacaggcgcgaaccatgtgggacgaagtcgacgacatccctgacgacggcctctactggacaagcgtcgaagactaaaacgtcatcgccgttcccggccaagtgacgccccgggaccgatgccgcccgcatgacgcgggcggcgcctccggcggccagaggacgactaccgtcctctggactccacgcgccgggaaccgttcctggacccgacaaggcgtcgccgtggcacggaggccacgtctcgccgacgggaaacggagcacggcaccaatgccgcgcgcatcccgaggattttcttttgaccggccggctgacgccttgatcatagcggcacgcggaacccgtcaacgcccgcgcagcgaaacccgtggtttcgacgcgttctcatgacggaacccgctaccaccgctagcgctttcgcttgaccatccggtcaaaagaaaaatatcctagaatggaagacaacgaaaacaaggaggcggacatgccggtcatcagcatgttcttcggaatcatcatcaccatgaacgcggacgaccatgttccgccgcacatccacgccagataccaaggccacgaagcgtccttcaccttcgatggcaacctgctcaagggagacctcccgcgcaagcagcgcaaactggtcgaggcatgggtgctgctgcatgccgaagagctggaagccgactgggagctggccttcaacctcgagcacccattcagaatcgacccgctacgctgacaaggaggcaacggacatgaccatcgactattcaatcaaagtgacccaatgcgagcccatgcccggctacaagctcaaggtcacctgctccgacggcgcgaccggaatcttcgacatgtcccgatacatcgaccgcggcatgttcaaaccgctcaaggacccgcagacgttcgaccgcgtgcgcctcgcgttcggcgtgccctcatggcccggcgacatcgacatcgccgcggaacgcgtccgctccgacatgcaaatcatctagaagcccacgcgcatccgccccgaccgtcatcaagacggccggggccttttcatgcccgtatgcatgacggacatgacgcgccaccaacgacccaccggccccgcgattttttcgcggggccttctcgtttccctgctccaagtgtccaaacccatcgccgtttccacgacggacgattggcgtaagacaccggccgtgccctcaaggccatgggcgaaaggagcaaggagtgaacgcgatcatccttcacggcattgcgcaatcatgccgtgcgaaatcactcccaatcaatgaaattgatatgggagtagcaagtgacgtgaacgtatatacgttcactcgattcgcaccgcgaatcggcttgctcgggagacccagaccccatggtcgagcaagctctccagaccgcttcgcggcatcacggacgtgccgtccgcacacctccacgggaggtgcgaaatgagctgggcgaacaagcgccgacgcaccgtgcagaagctcgtcacgttcactcccgacgagtgggaacgcgtcaattcgctgcacaaaaaggtgaacaagtacacgacaagataccgttcgttcaccgtgttcgcacgcaaaatgctgaccgatggcgagatccgcgtcaccgagatcaggccgctgacagaccccgagccgctcgccagagagatcggccgcatcggcgtgaacgtcaaccagatcgcccactgggccaacgcgaacgagcacatcaccgccgagcaggtggccgagctccgcgcgtcgttcgaccgcatcgagcgtctgctcggcgacctgttcgccaacaaacgcaccgccgggaaggacgtgtgagcatggccgtggtcaagctcggcaagcccgtgaaatcgaatctcggcggccccaacggggcgatggcatacatcatcgaccccgccaagaccgacggcggaagactggtcagctccaactacgagcggaccggaacggactacgacgcgctggctgatccaatgctcgaagacaacgagaactcacccaaaggcatccaaaagaacagccgtctggcgtaccacatcaagctgagcttcagtcccgatgaccccgtgacgcccgagcgggtgcacgaactcggtgtggagtttgcgcaccgcatcaccagtgatgaatacaagttcgtggtcgccacacacaccgaccgccaccacctgcacgaccacatcatggtgtgcgccgcctcccgatacgggaagcatctgaaggcggaactacccaaggacatcatcgaacagtggcgcgtcatcgccaacgagatcagcgagagggaggggctaagcgtcatcttcaaccccgccaccgagcgggtcgcacgcaaaatgcgcggcgacgaaaccacgccgaacgaagacccgacgacacaggcacgcgaccccaaacatgtcgaagagacttccgaaccgggcacggcggcgacggcgcgaacgacgcgacgggccgaaaacgaggagccgatggagcgtcgctacggcatgtcgatggaggagatctacgcgtccgcgaagggcctgggcgtcaaggaccagctccgcatgctgatcgacctgaccctggccggcgcggagaacttcgaggactggaggaacatgctcgacgtgcagggcgtggacgtgacggtccgaggacagcacttcacgttcaccatgaaggacaccggcttcaaggtccgagacacgaaactcggctcggcgtacgacatgacgaacatcatggccggactgcaaagcacgcccgtcatccccatcacgttcaaccgtcggctcgtcgccaaacagaccaggaagacggtcaccgtgtggctgcccggcacccaccggaagaaaaagatcacgttcgacgcgaagcgtctcgtggacgacggcggatccacgctgcgcgcgttcctgcccctccaccgcgaccagatcatcctcgacccgtccaaccggtacgccggcaagaccaccacccacggcctctaccagtggttcggcgagcccgcgaaccgactcgaaccactggcctcgcccgaacggctgcccctgcgctacggggtaagtcccgcccagcagcgctactaccaggcacaggcgcgacgcctcgaccggctcgccggcgaggcgaaggcgctgaacgcggcgatccgctggaccaggctcgcgggcggcgacagcgccaagggactcaagctgctgcgcggaaaggtccgcgaatcgcacgacgaactccaggccgccgtcatcgcgttgcatgacgcgatccaacagggaaaccccgacctcgtggccgagacgcgcggcgagatggaacgtcgcgaggccctgtgcgaccggtacgagggcgagctggccgccatcgaacgggagatccacacgacccgcgaccgcgagcaaacggagactgagcagcgcgaacagcatcagcacaagcgtggacggtccatctgaaccgtcccaggaaacaccaaccgacaacagaaaggaaaccgcaatgccaatcgaggaacaggctgaggagaagatccagaacgccgtccagaccatcatcaccggaggcgcgaagctcatgctcagaatccccaagggcgtggccatggcgctgctccgttccggcatgaagctcaccaagaccggcgtgcacgccgcgggcgaggccgtcaagaacaagatcgacagcggcgagatgtccgagaaacgattgcaaagaaagaaggacggcgacctgcacgagctgcaactcgacgactcgaccatgcgcgaggtgcagcgcagcctcaagaccgccggcatcgactaccacctcgaacgcaccgaccaaggccagttcatcctgcacttcgccggcaaggacgaagaccatgtccgccacgcagtgcaacgcgcgttcaaaggcatgggcctggacgtcaccgacgacgacttcaccgtcgagcagacggaacagacccgaaacgagccagaacccccggcgcgggagaccccggccgaaccggcctcgaagcccatgccgacgcagcgcatcgcctgggacttcgtggatccggaggtcatggagatggccgcgaacagcctcgccgcccggcatcccgaactctcatgggacaagctcatgggcgacacgacatggaacgagcaggccggccgcgatttcgcggaccggatcatcggcaaggccgccgccgacccgagcctgcgcgacgagctcgacgtcatcctgcgcgacgactacgggcagggcgcgcaaacccaggagcagacacgcaggcagacgaccgagccgaaccgggagaagccggcaccggagccggaaagcgaaccggaacccgcgccggacgaagcccggacaccggccacgcgacagcagacgcaggccagagcagacaatcccaggccggccggcaaggagcggaaaccgaagccgatccggtcgaagaaggcactgctcgaacggttcaagacccggctcaacgagaacctcgccgaacaaaagaaccacatgccacccacccagaacagggaccgcacgccccgcaagggccgctgaaaggaaaccataatgaaccagcaggaacaggcgacgaaacacgccgcgatcttccaggacaccatcaacggaaccaacgacccgaccccatggccggtgaccatgtgggcctcgtccggcgacacgatatggacggccggcactgcaaggacggccggcgaggactcggtgggcatgatctacgatcccggcgacaccatcgtgcaccggaacacaatcgccggcgacgtgacccgcgccaccgaatccttcgccatcagaccggcggacgggcagagcccgatggacgcgatgctcgcgggcatcgaacaatggaaccaccgccatcccgaccggtgggacaccgtggccacgccgggccagtaccgcatgacggatccgacgacgggccggcagctccctatgggatggagcgccagcctcgccgccgccgcgtccgcggcgggacggctcgaccccgacctgctccaggccagcctcatgcagaacgcggtcgagcacgagccgcgcccctgcgtgttcttcctggaggataacgggtacgacctcatggtcttctcctggcatcggaaccagcagggactgttcgacgcgatgagcttcaaacacctgcaatacgacgacctgagcatgcaggtcaccaccatcagccacagcgaggacatgagcgagcccttccccgccaagaccatgagcgacggcgaactgctcacacaaagccgcgtctaccgggacgaataccagcactggcgcgaacaggacggcggaaccgtcgcccagggcatgaccggccgcgtcatgcgcagcggactgctcaaaccgggactggagcagaagccgctgctgaatctgaacgacggtcgacgcgccccggactgggacgagttcaccgaccaggccgccatatccatcctccagggccaacccatctcgccgacgcccgcgctcccccagcaggagcagccggagcgggacaccgaccccacagccgtgacacagacgccggcccggacggccgcggcgacgaagcaggtctggccgaacgcgtgggtggcgaacaggctcgcgcacacctatatattgcatgcgaaggacggacgcgactggccgaagatgatcgtcggactcccccgcggcaccgccatcgatggcaaggacctgaccggctgggcgaccgacatgttcatgagcgcgaagaaccagaggcagaagaacgagggacgggccgtcaacatcaggttcagacccggcaccccggtcgagctgttcaccggccgcggagcggaacgccgcaccatgcaggtcgacccgcagacgctcgtccaggcggtcatcgacgcgcagaaacgcaaccgcgacgccgagaagacgctcgacacggcatcggtggagctcgcctcgaagaccgtggaggaatcctggccgcagatcgaacgcatgcagggccggttcacggaataccagcgtgccggcacgtacaagccgtccgtcgcaatgaaatgggcgcgcagactcgtcgaccggaccgccggagaggacgagggacggtggaccaaccgccaacgccgccaggccgccagactgctcatccaggaactcaccggcacgcaggatccgacgcaggccaggagcaaaacaacggatcgtccgaccgtcgaacagtacgtgccggaaggcggcaaaacgcccgacgccataggcgatgagacacccgcgccgccacggaaaacagagacggacatggcgacgaaacagcggcaagaccccatcgttcccgcctcgcaatccccggccgccggtccggaacgacggcacacggacctgaagtcaacgcttgaccggttccggaccaggctcagggagaacctcgacggactcaacacagccatgcccgcacccgggctcgaccagaaccgcgggcagcggaaaaccctataagaaaggagagaaccatggtgagaaaacgcctatacgcgaagcggacggcctcggccgaatacgagcagctggacctgttcggccttctcgaggaggagcagcgacaggccgacaggacggcggaacaggtgcgcggatacgagataacggtgagccacgtcgcggtgcaacgactccgcgcacgcggcgcggacgacgagacgatagccgccgtggcggccgaataccgggagaaccggctccgtggactcggccgacgggacgcgcggatcgccgccgagaacaagctcggcgtcggtgccgccacgcccggcgaaaccacgccgcaacctgtggtaaaacgtttcacacaatcctccggcacggaaaacaacactgaagaaaggaacaatgatggacgagatgacatggaccgacccgcagctcaaggcgcgctacgagaggaacctcaaggcgatggagcagcgccgggcggcgcatccggaactgttcaacaagtgggcgctgccgtacaaggtgttcacccgcagcagcctgcacgggatccagaacatgcgcatcaactggctgatggacaaccatccgcagcggttcagggagatgatgatggccaacgtgctcgaggagcatctgcgggacatcgagaggcggacgagggaacgccaggcgcagatcatggaccagctgatggagtccaggcacctgctcaaccggacggactgcctgaaggcggcaccccagatgaccgacctggaccggctcaacgggatgaacgaggcgcaagcggagtcgatgagcatggcgatccacgagatcgtggaaagcttctagcatccctcgactcgcaacgcgcgcgttcgccccgcgaacgcgccgaagcgaacatcgccgccattcggacactcaagacgctcgatgggaacggcgacgagccgctctccgcggagcagctggacacgctgcgcggatactcgggatggggcggatgcgcggacgcattctccgacaagcccgaatgggccgacctgaacgccgagatccgcgaactgctcgacgacgatgagtacacgcaggcgcgcgcctccacactgaccgcctactacacgcccggccccgtggtcagggccatgtgggacgcgctcgacatcggaagcacaccgatccaggtgctggagcccgggtgcggcaccggcaatttcatggccggcatccccgaaaacatcaaagcgaacgtgtcgggcgtggaactcgatccgatcagcgcgcgcatcgcggccgcactgaacccggacgccacgatcctcaacgcggacctcgcggactgcaccatccatccgggattcgacctggccatcggcaacgtgccctattcgggcgacatcagcctcggctaccggaccatggacggcggcacgtcccgtcttcccctgcacgactacttcatcgaacgctcggtggacgcgctgcggcccggcggcgtcgccatgctgctgaccagcagatacacgctcgacaaacgctccgagaccatgcgcgccgacctcgcgagaaaggccgagctcgtcggcgcagtgcgcctgccgtcctcgacgttcgcccgccaggccggcaccgaggccgtcaccgacgtgctcgttctgcgcagacgcgaacggacgctcgaccgcacgcccgacgaggcgtggatccactccaatccggtcgccgtgcccggataccaggacgtgaccgtcaacgtcaaccaggcggtcgccggcgacatggccgcgcacgcggtgggcgacatcagacctgtgatcggacggttcggcggcgacttcgacgtcgtcttccagggcgacgcggaacaggtcggcgaacgactccaagaactgctctccacacagatcacccacggcccggcgctgtcgctgggcgaggcggaaccggccggacgggcggagatcacggtccggccggaccatgtggcaccgttcgaatactccgtcgaccagcgcggagtggtctggtacggcgacggcaccaccgtcaccgagatagcccacggccagggcgacgaggcgcgacgcctgcgcggcatgatccgcctgcgagacctggcgcgcgagctccaacggctcgaactcgaccccgcccgcgtggacgaccctctcgtggaggacaagcgcgccgagctcgaccgggcatacgaccggttcgccggcgagttcggccgactgtgcgaccgcgccaaccggcgcgcctacagcggcgaggaatccggctgccatctcgtcatggcgttggaggagaccgacgaaaagggaaggttcgccggcaaggcgaaatgcctctcgcagcggaccatcagcccggtgccgcccatgcccgaccatgccgacagcctggacgacgcgctggacatcagtctcgaccgcgccggcggggtcgacctggaactcatcgcgcgcctggccgacaccaccgtcgaggaggccgaggccggtctgggcgaccgcatcatccgtgacccggacaccggcgaggtcatgcccgccgaggactacctcgccggagacgtgggaacgaagctcgaccacgtcacggccatggccgaacacctcagacgccgggcggcacgcgaggccatgacggagttcgcggcatccacctacgcgacatcggaggacatgctcgccatagagcaggcacgcgaatggatcgacaccgcgggaacggacgtgtggcgcagcctcacggacccgtacgccgccgaatcctacagggatccgacgccggtcatcgaacgcatcaacgacggacggcacggatggaccatgggctggaaccgcaacccggaactcgtcctcgccctcgtctggcgggcggtggaggaactgcccgagcgccactcacgcgtcaccctcgaacgatccgacaccggagagcggaagccgtggcacgcgccggcatggcaccgatcgcacggcaccagcccactgtgggacgcattgtgctggacatggcgcgacggcgacgcgccacagcactacgcgccgatcctcgccgaccggcgcatgcccgtcagggacctcgccctgttcgtccacaagatcgcccacaccgaccggctcgaaaccgccgacaagaccgcgatcctctccaacctgttcgagagctattcggcccacgacgagcatggcagcacgatatggacggacacgaccatcggcgcgatggcacgccgtctcatgcccggcaccgacgaccccacgcggctcgccgaacggctcgccaccgacatgtcggtcagcgaatggatctggggcatcgcccgcgacctgcccgacctgcgccagggagcggcacacgacgcctacggcgcgccgccacgcgccatcgacgcgcgccccgacgactaccaggcgttccgcgcacgccgcgaggaacagctcggacaatggcgggagcagccggagcacgccgaggccgcgcgcgccgaccagacggacgcggaacggctcgaacacgtggccgatctgctggaacgcgtacagcccaccccgctggagaccgagcagatcaaggtgccgttgggggccccgtggatccccgccagggacgtccacgacttcatgatggagacgttcaacgtgcgcggccacgggctcacgcccggcaagctctcccagtactcggtcgactggatcccccagctcggacaatggcgcgtcggctactcgggcggcggcgacatcgactacaaggcagcaaggacgtacggcaccgaggaccgcaacccgttccaactgctggaggcgtgcctggacaacgcgcagatcaccgtcaccaaggactcccccacggagaccacggcgtccggcaagcccaaacgggtcaaggaccagaaggccacgatggccgccatcgagaaggccaacgcgatccgcgacgcgtggaaccaatgggtgttcaaggaccccgaccgcgcgcaaaggctcaccgccctgtacaaccgcagattcaacggcatgcggccccgccacgtcgatggatcctacctgaccacgcccggcatcgcccacggcgtcgccctgcgtccgcatcagaaggacgcggtggcccgcgccctgcgcagcgacgagggcaccctcatcgcgcacgtcgtcggagccggcaagacgttcgagggcgtcacactctcccacgaggcgaaacgtctcggcaaggcgtccaagccgatgctcgtggtccccaaccacctcgtggaccagtgggccggcgacgtgctcaggctctatccggccagccgaatcctcgtcatggacaaggacgcgcaacgcaaccccgaatcggtgagacgcttctggggccgggtcgccaacggcgactgggatgcggtgatcgtgccggagagccggttcagccagctgcacgtcagcaaggaacgacggctgaggaacatgcgcgcccgcgtcgacgagttcgcccaggccgtcgaggccgccgccaaggccaggggcgacaaggaccccaccgtcaaacggctggaggcggcgcgcaaaagcgccgagaccgccatgcagcgcctgcgagacggcaaggagtcgcgcgacgacaaggcactggcgggcatcaagttcgaatcgcttggcgtggacatgctcatcgtcgacgaggcccaccacttcaagaacctcggcgtgcccgtcgcatccgccgacctgggcatgcaactgtcgtccgccgcgaaatgcgaggacctgctcgacaaatgcgaatggctgcgcgaggccgggcacggaggcaacatcgcgttcatgaccggcacgccggtctccaactccatgagcgagctgtacaacatgcagcgctacctcgcgcccggaaccctcaaggcccagggcctcgacacgttcgccgcatgggctggcgcctacggccaggtagtacccaccgtggaactgaagcccgaaggcaacggattccaggtcaagcaaaggttcgcgcgcttccagaacctgcccgaactgatgaacgcggtgaagcagttcaccgacatgatcaccaacgacgacatccagctgccgctgcccgaactggagcaggtgcccgtccccgtgcccatcaccgaccgccagaagaaggagatggaggaactgtccgacagggccgacctcgtgcgcgacggcgacgtgccgccggaggtcgacaacctcctgcggatcactggcgacgggcgaaagatcgccctcgaccccaagctcctcaaaggccacgagaacgaccgccccctggagaacggcaagatccaggcatgcgccgagaacgtcgcccggatctggcaggaggagacgccacgcctgggcacgcagctcgtcttctgcgactcgagcacgcccgcgtcgggcggatggaacgcctaccaggacctcaaggaccgcctcatccaattgggcgtgcccgccgagcagatagcgttcgtgcacgacgccggcgacaaccccgccagacgcgagcaactgttcgccaaagtcagatccggcgagatccgcgtgctgatgggaagcacccagaagctcggcaccggcaccaacgtgcaggaacgcctcgccgcgatccacgacctcgactgcccatggaggcccgccgacctggaacagcgcctcggccgaatccaacgccagggcaacacgtacgaccacgtgcgcgactaccggtacgtgaccgagggcacgttcgacgcgtacagctaccagaccgtggaacgcaagcagcggttcatcagccagctcatgagctcgaagagccccgcccgcgaggccgcggacctcgacgccgacgtggtgaccctcgccaacatcaaggcgctggccaccggcgaccccgacatccaacgccgcatgacattggagaacgagatcaaccagctgaagctcctgcgcgcctcatgggcgcagcagaaggccgacacccgcagggacatcaaccagcagctccagccacgcatcgaggggatccgccaggcgatccgcgagaagaccgacgacaagccgctcgcgtccaaggccctgagcatccaccagaccgcacgcatgaacggcaagtgggagggcatgaccatcaacggccggccggtcggcgaccggcagaccgcatgcaggctcctccaccaggccgcccaccaggcgcacgacggggacacgatcgccgaatacgacggactgcccgtcatcgcacgcagggcggccaccaccggacggatcaccctggccgtcaaggccgtccacgagcacgaatccggtaccgagatgcccggaccctacctgaccggaccttccagcatcgtcagccagctcgaccggatcgtcaagaacatggccaccgaccccggcaagctcacggaacggctggcggacgccgaaagggaactcgccgccgcgcaggagacgctggccgaaccattcgcccacgaggacgagtaccggcaaaaacaggcagaactcgaacggctgacgtccaaacccgacgaaccccgggagacggaaagtagagaccaggaaaccaaggaaaggagcgcaggaatgccattgacaacggaaaacgccagacgactgctcgaacaggaccacgacgtcaccgaagtcacccagggcggcaacgccatgggccactacctcgaagcgaggctcacggacggacgcgccgtgcagatcgacttccacgacaaccccgcatggaaagacacggaccgtctggccggccggatcgaggtgtcctacgccaaccgcccacaggcggaatggcaatacgacgacaacgacatggccgaccgcgaacacaccgtcatcgacccggccgacccagccgccgggaaaacactcgccaaggcggtggagggctgggaacgcgcgggcggcctacacacggcccgcgcagccgggacgagccatctggccgcgaaccagccgccggaggaatacgcctaccggtggcggaagcccggggaccccgacaggcacatcgcatacctgagcaccgccttcgaccgcgaccaggcgatgaaggcgagggaggacgccggatacgtcgtgacgaaggtcgatgaggatccggccgtgctctacgagcagcaccgcaaggcgtcctgcatgcgcgcgagccacatcctggaacgatacgaatcccccgaccaggacgcagtcagaatcctccacggcatcgtgggcgaggtcaacgcgcacgaccccgagaacgacatcgccacctacctcgcctacccatccgacaaggcggtccagatcgacggagacggcctcacctccgcggacatcgcggagaaacgcgagatgggcggatgggacccgcgaaaggacccgctcatgcgcatcaacgcgcagggcgactggacgggcatcacccaacaacaggccgaccagatcgtctgggacaaccgcgatgagatcctcacccgcgcgtcatacgacagtgaactgtccacgtggacgctccaccagcttgaccagttgaaggagccccagccggcccaaagcctggaccgtgaccggccggaaccggatcacaaggcgcccgcacaggccgattccacgacgaagcgtcacgggccaagactgtagtcctctccagccacggggtggcgcgctttccgcgccaccccgcattcattccatacgaaggagcagaagacacgcatgacaacagaaacaaacgaccagccggaacccatcatctggttcgagggcacactcatcagcagcccacggcaaaacagaagcgcggaagactggctgcttgaaaccatggccatgggaacagccacgaggaaaatcaccatccacgccagcggcagggagcattcggagaacatccgcgaccacgcgcgcaagggatcccgcctcatggtcaaaggcaccgcgggcgacgaaggatcaggcatcgacatcgaagccacaagcctcgcgttcgatcccagccatgacgaaccggacgggaatcgatgacacggaccaccaccgtcagcggcatcagaccggacaaggccggcgacggcgaatggatcgacatcaacggccacgtcggccgactcatgtccacgctcatggccgacggccggccattcagcatcgacgtcacgccgggcggcatgaccaccgtcacgcccctcccacccccgaaggacgcggaagcggccggcggcgacgcccaggccgaaacggagccggccgacgggaggatcaccagcaggaagacgctgtacgaccggttccgcgccaggctcaaggagaacctcgccgaaagaaaacaatagaaaggaacaatcatggaacaagcaagaggaatcatcgtcaagacgctgaccatcctcgcgggattctggctctccgacctcgcggccgcccgcgtccaggccggcctcgccgccggcgaaagcatcgaacggatcatggacggcatgacgaccatgctccagcatccgctcgccctgggattcgaccggaccagcctcctatgcggactgggcggcgcgtgcgccgtcggactgttccacctctaccggtggagcatgaaacgcaactggcgcgacggcgaggaatacggctccgcacgctggtccaccagccgggagatggccccatacaccgacaacgacacccgtcagaacctccagatgacggccaccgagggcctaagcctcgacgcccgggccacgcgacgcaacctcaacaccgccgtgatcggcggatccggatccggcaagaccgccacccacgtcatccccaacatcctcaagggcagcatgaactacgcgtgcaccgaccccaaaggcgaactctacgcgcgcaccggcaaggacctggagaagatgggatacacggtcaaacagctcgacctggtggacctgaccagcgagacgaaattcaaccccatgcgatacatcgaccccgacaagcccgacgtggcgatcatgcgcctggtcaccaacatcatggacaacaccaacggctccacacccaaggagcaccagaccgacgacttctggaccaaatccgaacgcagcctgctgaccgcgctcaccgcgttcgtctactacctgcccgacgacatcctcaaggactgcctgcacatcgacgccggacagaccctcaacgcggtcgccgacatgcgcgacctgctcgaagccagcgaacaggacgagaccaaggaaagccaggtcgacgccgtcgcccggaccgccacggaaatctacgaggagacccgcgccgaatgggagcgcgaagacgcggaccacaacgatccggacctgcgcgaggcatggcgtctcgcccagggcctgaagttcgccgcccgccagtacaggcccttcacccagggcgccggagagaccaagaagggcatcatcatcagcctcggcgtgcgcctcgccccattgacagtcggcccggtccgggagatcctctccgacgacaacctctgtatcgaccggatcggcggatacgcggacgagcacaagggcggatacaggcatcccaacgggaagacggccatcttcctcgccctgcccgacgaggacccgacattcaactttttggccgcgatcttctaccaatgcctgttcgacagcatcatccgccgctgccgcacctaccccggcgaatgcctcgccacgccattgcactgcttcctcgacgagttcgccaacgtgggacgcatccccaacttcgacaagctcatcgccacaatccgctcgcgcaaggtcagcgtcagcatcatcctccaaaccatcgcccaattgaagaccatgtacaaggactcgtgggagacgatcgtgggcaactgcgattcggtgctgttcctcggcggcaacgagcagtccaccaccgaatggctcagcaagctgctcggcaaggaaaccatagacatccgcaccaccagcgactcgaagggcgtgtccggcagccacaccaccaactaccagcgcaccggccgcgaactgctcacgcccgacgagctcgcgcaattggacaacgacaaatgcatctacaacctgcgcggactccacccgttcctcagccgcaaagcatggcccaacaccagcatccccaaacccaaatcaaaactcaagcactccaaaggatggaggaaagcagcatgaggaaacccgacaccgacgaaaccatagggaacaacgtccacggcataaggatcgcacggcgcatatcaatgcaagaggctgtgaacggcatgagggaactcggacacagctggagcaaaaccactttgttcagcattgagcacaacacccgccgcctactggcatcagaagcatttgatcttctcatctgccttggatatgaccccgaaaaagacctcatgctgatctttggtgagccgccgtccccagctgactattccatgcaacgctgcggccgatgcgccaccaaggtagaagacgcctggaacgtttatctcggagctctggaagtcgccgaaaagtcgctcacagaagaaacagaaaaaggagaaatcaccaaagaatatgccgatgcacaacggaagaagctgcggacttgggaaaggtcgatgagcgaggcaatcaaaaaaagacgctctgaacacggcacaggcacgatagcgctcaaaacaagttaatcattcatatgtttctctcatatcatgcgacggatacgagttagatgccgacaatggacaaacccgaagcatccacataattatgacaaggtgttgttaccctcgtcacttatttgactaagagtcacgttggcatatgattgcatggtcatctttctcgatgcaaacatatattcagaatagtagcctcttttattcgctgaataagctatctgatattcatattgtttaacgttcttatcggaatacaacctgcatatttgaggcgctttgtcataagtgagtatccagttccaatccggctcagcgacgaggcgcttcgcaaccagagagtggatggtttcggttgcatatgaattataaagattccgtccctgcacatagtaaggaggatccgcaaatatgagactgttcttcatatcgcagaatttgccatcagaaagcaatttgaagaaatggctggcctctaggttgctaacagtgattctctctttttccgctgctattcgctctatcctctttttgagtgtgcttttgttaaatcgagaagaaatgttgtatttcccgtcttgggcggcacctcctatcggcccacctttgatgacaccacttacgttcatgcgattaagcatgaagaagtcgaatcctttccgtcgaatatccgaataatggttgaaatcgtatcttttcctgatagccttccagtattccgagtacttcgaagattgagccgtgggcttttcatccgaatagtcaaaggggacgcggtcgatttcacgtagcagatattcgggttcgttgacaagagaataccaaaacgaatatacgccgtcatcaaggtcgttgataataactgcatctacacgacccgacaacaaaagattgatagcaacgcctgctccgcctgcaaaaggctcgatataggttccggttatatggttagtctccaacacgtttgccacgaaacgtgtgattttgcctttcccgccggggtatcgcaacggggtattggaaccatttgtcagcttactttgcgccataaacatgaatgatattagaagattcccattttggccagttcgttcgagtcatacaccctgttttttgaactgcacatattgctgacagagcatagcaaacaataccgcatcattcgacagcctcatgatggtatctatgtcgtaatccttcatagacttgtgcgacccaagcgatgagtattcaacggactcgccgaaatcggtattttcgattacattatgagcctcttggtaggtgtcgaatacaatcctcccggcctgcagatagtcttggaatttgttgtttttaaacaggctatggacatatgagacgttctctttatgctttgcgctgacccctgtgttgggaagatgaatctcattgcaggatttgtccaatgcaagaagggacagttcgaagatcacacgtatcgccggcgcaatcaagaatgctttcgcccatcttttggtgctgtcgtcctccagtactccatatgcgttcaaagcggaaagcataaagttcgtgtcttcgaattccggcgcgtcggtcatccattccggattgttgtacatcgcaccaaggtgccggtctcgatttgtggcgaacttgctggcgaaatcatgattgaggcgtttcgcggcaagtcttggcgacctgaccgttccttgtcctttttcctgaagaggaatgattatgtcctgcttgatgacatcgttattgaggcgtgaaataagggtgccgttctcttgacaatatcccttaacctcatcagccagttctttgactttgtccagttgctcgggggttattatatccggattcttgatatcaagatattccttgaccggagccgagttgaaaacccttctcgtgctggtcgtagcgttcgaacctccgagatagcttgtcaaggaatctccaaactgattctggaacggcgtttcaagcttgtccgaaaacgtctgccttcctgagaagcgggctttggcctcagtgctccatggaatcgtgccggcaccgtcctgagggccgttgtgctttcgattgaggatttccctcagcttatcctgttcattgtcaccgaaaacaacgatgtccagactgctcggaatgttctgcggatattccgcaacaaggttcttcaatctcttgtaatctcggtcatcaagaagttcacggtaacaatctgggttttgcagcaatttgattgcagacaatctcctattcgcatcgtgaatcacatacttgtcgccggcccttgtcgcaaggatcggctcaacatcgttctgatagccattctccgctattgacgatgcaagattcatcaattgccgctttgatgtcgattgagactgtgcactgaagttatagattttattgagttcatccatctggtcgattgatggttcaactctcgggttcgtctcccagagacataaatccgatacattgacatttatacgttccataaatagttcctccgctccaccgaaacaaactcaattcattaccttatcccatgtccaatgatatccccagacctcagtgttatcctctccccgttatctaattgaaagtacaacacacccgttagattcagcttgatgatcccgaacaccgcgcacgcttggaggagctgtgccggcggttgagagcacccatgcatgagtcagtgcagccaacatgcgaggaggtcaccgactgggtgtgtaacctcgcgttgtccgtctgccggagggagcatgaagtctttggctttccctgcgaacggcctcgcattggctgacgctcatgaaagagcgcgttcccgaatcagtttcgatgaagctcccgtcacccatcaccgttcacgaatcagagccccggatcgctgccgggcaagccggtgcccccgtctgatggcgtgggcacggaccatcccggcgaggctccgcccgtattggtggaggacgacaagcctcccgaagacgggcgtcgtccggttccggaaccggatccggaacttccttgggattgcgattggcttcctcccgaatatgagggcgtttgccgctgtggagccgattgggattgcgatgcctgggcctgctgctgcgcggcggcggcagccgcggccgcttcctgttctgccctggccttcgcctccgcgtcggccttctccttcgccgccttcgattcgttgacctctttcacggctttcgcgatcgcgtccgcgtcacgggtcttgaccgccttcagcagggtctcccgggtcttgtcgtccgccaccctgccgtcggtctccttgtacagcgcgttcgcgtcgtccacggtcttgtcgagcttgctgtcggtgacggccttggttgcggccttgaggtcggtgagacggttcttgagctctttggtcgttctgtgcagcgacgccgtggtcctgtccaagtcggatgtggcggcgtcggacgcgcaggaaccgctgatggtggtcgtctttgcgcccaggagccgattcaacgcatcaagcgtcttgggatccgcgacctggccgcgactggtgtccttcaatagtttggaggctttggccgtggtcctgtccagttcggactggatggtcctgcgtgtcgcttcggccgagtcgcatgcgctgattgcggtctcatgcgcctcttgccgcatggcggcgacgtggcggtttttgatttgcagtccccaggacacggctatgaggctcgcggccatgacgatcgcgacgagcgctttcccgaccgggaagacgcggcgaaccttcagatcgtcgaggtcggccgagtaggtgacggccgccgacagccctcctgatctctcggttttcccggtttccgtcggttccggttccgatatgggcgggaggctcattgtggttggctccgggtcggcgacttgttcgagtgccgcgaaatcgccgtcggcgtccttcagggccttctccgcggaatcgtcgggaggagactgctccgccggcgcagacacgggttcctgccccggctcgtcttccggcggcagcggcgcggatggtatggcgacgcgacggcggccgcgcatggacgcgggcggcagcggcgcggcaccggccgtgtcaaagccttgctcctgcgcggtatgccaccattcggcgagctccggccacgcgtgtggatgttcggcgattaggcgcatccatggacgccaaccgggctcgttggccatggcgtacagctggtcgaccgtaagcttggggctgagaatcggctcacccgtcttcctgtcgatcctggtcattcctctccgccctcgtctttgatgaggactggctgatcctgttcgtttaccttcatcacttttgttcctctggtttgccttcatgcacccggtatccgccttccaatgggcccttgaccgccgcgcatcgccagccgtcgtcagtgagcgtgtagtcaagcacccaggatgcctccagcccggtggatacggcgcatgtcgccacccgccgccccgtggacacggggaagccggtgaactcggtctcgggcaatggctgcggggctatggatgatgccggtatgtcgaggccggcggcatccggcgtgaagtattcgccttcgagttggcctcgttcgccgcccatgtagacgccgagcgctttcggcgcgaggtcggcgcacggatcatcctccgtcggcgtcgccggctcggtctcttcgtctccagccgttttttgtccgggttcggttttcgttcgcggccgggcgacggtgctttgcgtgtcctccgcggttccgttgccggcgcatatcaccgcgacgtttcctcccaggatgaggagcgcgaccgcaaatcccgtcgcggcgatgatcctgttcctctttggttccatgcttggttttcctttcagtggatgtagcggacgccatttccggctgcggccagttgggaggcgctgatttcgcgtgtggatacgacgccgaggccaagcgcgttggactcgctgatcaggatcgacccgtccccgcggacctcctcgaccatggcgacatgcccgtagtcggcggacgcgcccaatactcccggttggaacacgatgacgctgccggcggatggggagccgtccaccgtgtagccggccgacgccgcggaacctgcccatgtggcggcgttgccccaccctggtatcggttttcctatgtcggctcttctggtcgcggcccaccaggtgcactgcccccatgggtatctcgtgtccggcgtgatgccggccgtggacacgatgccgccggagaccgtcagtttcggttcgagggagccgaccgtgccaccctcggcggtccccgttgcggtgtatttggtcgctgcgagttccttgatccgccgcacatagttgatggtttcctcgaagggcggcaccatgccgtatctgagcacgctgccgaggccggcgttgtacgccgcgagggtcagctccaacgtgtcgccggtcagtttctcggacttcttggccgtctcgacctgcgaggcgagaccgcacatgtagttgccctggctccagatcgcgtcgtgcgggttccagatgtcggccttgccgtcgccgtcgccgtccttgcccgcggacgcccatgtggacggcatgaactgtgcgatgccctgcgctccggcggagctgccggccttcggattccaattggactcctggtcgatctgggcggcgatgatgctcggcgtgacgacctggcagatggatccggcgcggatcacgtcggcctcgtattccgcgggcacgcccgagaccgtggattcgctggcgctggatcccaggaacgcgcccatgacggccaggagcacgccgagcaccgcgagcatggccgcgatgacgggcaggatgggaaggctgatggaggcggctcccgcgatgacgcgggacgcggccatgcgcacgaagttcgcggcggcgcgggcggcgcgcatggcggcctgtccggtggctttcacgctgcgtaccgccttgacgggcgcgcggcggtgccgccagatgaatttggccgacgagttgacacctttcacgcctgtgcgtgccgctttgaaggtcaggtcgcgtgtggtgcttcccagcttggacgcgaagtcgtcgtcagccacggtgagcctcgcgccggcttcgtccatccagcccatgccggtggttcccattcgtttgacgctacggccggctttcccaaggcccgcgcctatgtgcttgccgatccgcttgctcgctttgcctttcgcggcgaacttgccgatcttctcgctgggcttcgcctcggacagcgccttgggtttgccggccgtcttgcgcattcccctgcccgaccgcagggcgcgtttgccgcggttcatgatgcgccgcgccttgccggccgtccagcccacgccgtgcatggtggaggacatgccgtgcatgcctgtgcgtcccgccatctcggcggcggtgtggcccatggagtcggcgatgtcggtccggtccgagccgaattgcgcggcgctggacaccacgccggtggccgcgcgtccgatgcgggcgcgtgtgcctccggcgtggtgggcttgggttccgctcatgcgtttactttccttcctggaaggtcgtggagtacagccggtagaggtcgccgcccgcggggatgcgcccgtcgaacggcacgtaggcgctgccgatcttcatgagtccctggccgggcagcacgccggtgaagtactggcgctgctcctcgctcagggtcagcagttcgcacaacgcgtccgcgtcggtgctgttctggctcaggagcatgaggaagtccgagttggacagcatctcgcgcgcgtcctggaggtcgaggatctcctcgacgttctgcgtgatgccggtgacgccgagcccgtatttgcgggcgcgcttgtagatgtccttgaactgggcggcggcgtactggttggagaagaagcggtggaactcgtcgacgtacagccaggtgcgccgcccgttggccttgttgcggatgacgcggttccacacctggtcgatgacgaccatcatgccgaacgtgcgcagctcgccggacaggccggacacgtcgaacacggtgaaccggttggacaggtccacgttggtctgcccgttgaagccgctcatggagccggtgatgtacgggttgagcgcgtcggcgaggtaccggctcacctggtcgccgcccgcctgcaattcgtcgtgcaggtcctgcaatgtgggctggaccactcccccgccctggttgcggtaacgcgtgtacaggttgctgacgcactggtcgacgagtcccttctggagcgggtcgaggccgtcgatgccgccgatgagcgcgccgatcatggagaccacgttgttggtcttgtccttgacggggtcggaggccgagtcgtcctccaggacgatgtccatcgggttgacgcgcgtgccggtgccggcgctgatctggatgatctgtccgccgaacgcggccgcgagggcgaggtattcgcgttccgggtcgatgacgatgacctcgtcgtcacggttgaggaacatgccggcgatctcctgtttgacggtgaaggatttgccgccgccggacgtgccgagcacgaatccgttggagttcatgtggctgcgccggtccgcgaggatcgggttgccgctcctcgcgttgcttccgtagaacaggccgtgcggctcgaacacctcctgcgtggtgaacgggatgaggatggccgcgctgttcgtggtcagggtccgcttcatgggcagggggttgttgcccagcggcagttcggccgtcagtccctccatctgcatgaacttgaggctctcggccgtgcaggactgcgcgttgaccttggccttcacgttcctgcacgcgacttccagctcctcctggcttgccgcggacacgccgatcacgatgatcgagtccacgagcctctggttggtggagcgcagctcgtcgcgcagctggccgagctgttcctgctggtcggcgaggtcgtcgggaaggtcgtcggggtcgaggccctgcttgcggttcttgcgccgctggtccatgacctgcatcttgacctcggcgttcttgcggcgcacgagcgtcatgctttcgccgcggtccatgggcgccaggtggatgctcacgtcgacgcgggcgcgcaggccggtcaggtcgttgaccagctggtcggacagttccggcggcagactggacacccacatggtgcggtgcaggtatttcgagtccagggattcgatgtcgagcatggtcgggttgcgcgcgtcgatgctccacgggcacacgaggtccttggtgtcgggcttgccgggctgatgctcgaaacggcgttcgtcgaaccggaactcctcgccgggccggagcacctcggccatgaggcgcagccggtgctcgcggtcgagccgggtggccttgcatgcgtcgatggagcgcatctggctgacgaggttgttgcacagggcgttcaaggtcgcgacggcggcctgctcgtcgctttcgcggacggtgacggtcagggtcttgacggtgctggtgttgcggctgacggattcgagtttgccttgggcgaggcggttgtagtcgagccggtagtggtcgaggctgtcgccggtctcgtccatcatcacgtcggcgaggatttcgcgtacgccgcgtgagcgcgtgtaggaggcgatctgcacgctttgcccggcctcgaagctgttgatgagcttggcccaccggtcgatgatctccatctgatgggattccgggctcagctggtagttgatgtcctggaagaggatggtggcgctccaccgtccgtcgcccaggctggcgatcccgctgcgcagcatcgcgtcgtatccgatgagctgtttgacgcctttcggcagacgcgtcgccttctttctccgtgccttcgtcctggcttcggcatcgtcttcgtccggcgcgacctggggtttcttctttccgaacattcctcacctttccttgatcgttggtttcgcgccggtgcggtatggtcttcccggaccgtcgagcaggtagacctcgcgctgcgtgtagtggcgcaggatgtatttcaggtatttctcgggcatgaggccctttggcctcacccatccccatacggctatgggcaggccgggcgggaagatcaggtacatggcgaggttggggtccatgcccagcccgagccacagtccgacgtatcctcccccgcacacgatggcgaggatgacggcggcgaggcactgcctccagctcattcccatgaacaccttcgattcgatggtggtcagttccctgtagacgggcatctgcaacgccatgattgcttcctttcgtggattgcgttgtgtttcattcgccgccgaagagcttcttggcgacggagttggccgccatgacgatgccgatgagcatgacgctcgccaggagcaggccggtgaagttgtccatcacccagccggagaggctgtcgccgtccttgaacttgctcgggttgagcgtgccgcccacgagcgtgcggtacatgaggatcgccagatacagggtcgcgcattggaacaccagagacgcgtactgtttgaagtagttgatgccccactggcgggtctcctcctgggcgatgaaagcgatcggcagcgggttgaacgcggtgagcatgtatatctgcacgaagcgcaggaggatgacgacggtgacgacgatggtcgcgcccttggagacgaggaacgggatgagcagcaggatcaggcacggtatctggcccatccagccggcggagtctatggcgtcgcgcatgctgtcgccaaggccgaggcccgacgacgcgccggtggtgggtgccgccgaatggatgccgccgagcacgctgtcgccgatctcgtcgatggcctggagcatgagctcgctgtgctgggccgcggtgaacacgagcgtgagcttgaacatcgccatggcgacgagcttgacgcccagctctcggtcgccgtccgcccgggtgctgaccctggcgagttccaggacgcacatgatcgccagtatcgtgctggctatgggtttgaccgccgagcgggcgacggtcaggctcagctggtacatgcccgcgttgtattcggcgggggtcttcagcaggtcggccacgaggtcgtcgccgacgccggaccctatcgagttgaggataccgacgatgaaatcgaccatgcgtggcctcccgtctacagggcgatgttggagaacagggccgcggccgcgatgatcaggccgccgccgacgacctgccagacgcccgactgggtggcggggccgttctggtccttcagtcctccggccagggtgatgacgccccacacggcccacaggccgccgccgatgatggcgaactggctgaagagctgcaacgcgctggtgacgacgctgccgctgtctgccgcgatggtgattccgtacatgatgttttcctttcgatgttttggatgacatgaccacggtatggccgtcgagaaggctccggtttggacgttcccgacgaacccgaagaggctcggacgatggtatggaaaagggcccgccgaccgttcgccggtggggccgggtcccgccgccgcgcgccgggtttcgagtgccatggttcccgtccggcgttccgcgggccgcggaacatggaaacggacggcatcatgcgaaaggaagacggaccgatccgccacaaggagattttcaaggagtcggacggtccggtgcgcaagggaaaggggtggccggccggatccgacctcattggatccggcctgccaccccgttctggtttccatggtgcgcgggaaggggttcccgcggcgtgcccccgccgggagtcgaacccggcgccgtcacaaaggagaaaacaaagacggtaccggtgggggcttgggcgcgtccgggaaggaaaggatctgggcgcgcccgtgggccgtgcggcggatcatggggaacggtccgccgcacgggcccggggtcaggttcgtcggatcactcctccgagccctcggtgtcggccggggccttcgccttgcggcggcgggagacggccatgagggccgcgcctccgccgagcacgacgaccgcggccagcgcgatcagcgcgatgcccgcgccggtctgggcgagggtcctgcggtagccgttccagtcgtcggtggcggactccaccttggtgtccgagcagtagtccttgccgtcgatggtcacgacgtcatcggacttgctctcggtctcggcctcgggcttggagccggattcgtcgtccgaggtgccgtcaccgaacggggccgacgtgtcgaccggacattcggtcaacggggtgccggtgaccttggctcggtcggtgtgggtcttggtgacgcccttgagcgtgccggtgacctcgacgctttcgccgggcttgagcaccttggtgtcccagtcggccgggtacttgaggtccacgacctcgccgtcgccgacgatggtggagtcctcgagcttgatgtccttggtgcggaacaccgcgccctgcttcgtgtcggggtcggtcttgctcgtgttcgtgatggtgaacacgatctccgtgtcgccggagacggtcaaagcgtccttcgaattgtcgcggtcgccgttcggccagccggacttgcggtcccacttctggacgtcgatgctcggggtcatgtccggggtgcgggtccacacgacgttggattcgagagtcttgtcgttgtagtgctccgtgaactgattctcgtggcggtcggtcacggcgaggcgcttgcactggatgtaggcgcgccagccgacctcatgggagtcgtcggacacgagggccctgtagcggtcggtcgcttcgatggtgacgacgttgcggccgtcgacggtggccgcggagagggtgaagaggtcgccgccgagcttcgagctgtcgaaaccggagccggcgatcctgtcgcccttggacgcgagggcctcgccgcctgaaagcaggtcgcgggtcgcgtacacggcccattggccggtgtattcgtcgaaggccggatcgagggagtcgacgatgtcccacttgtcgacctgcgggtaggcgcggttggccggcaggatggagctgtcgagctggtagaggaagctgcggcccttgtagatgctcttgccgttggcggatgcgccgccgaccttcacggtgacgtccttggccgggttgatgggcttcagggggttcgtgacctcgttggtgtccttgcggatcttgttgagcacctgcgtggccttgttcttcacggtgtagccgtcggtgaccttgatgacggtcatcggcatggtcacggtgtacgtgtggccgaggagcgtctggtcgatggcgggctgggtgagcgggtcatgctcgtcggactcgctgtaggtcttgaggtcttccggctgtgggtcgcccttgacggtctcgcccgtcgcggggatctcggtgtcgaccagcttggcgtaggcgtagagcgcgccgtccttgtcctggatgttgaacttgtcggtgacgtccttgccggtctcgtcggtgatctccacgttggtggcgtcgagtttcaggtactcgtcgtcgtagtcgtcggtcatgccgagcctccagaccttgtatgcctggttgtactgcctggcgtcgatgtcgacgcggtagtagatctcgtctcccagcagggcggtcttgccgtcgatgctgatcgtcgggtccttctgcgtgtccttcttgacggggtcgagcttcggcgggatgttgaacacctcgttgctcggggtcagcgagttgttgagggtcagcacccacttgttgccgaccttgtggtcggtgggggcgtcgtcggcgacggttccctcgaagcggacctggaggcgggggctggtgccggcgcgccactggctgatcgtctcctggtcggtgacggtcagggtgaacatgtgcttggaatcatcccacgtggtcgtgtacttcttcttggacaccggcttgccggtgttcaggtccatcatctccagggtctgcttgtccggtttcagataggcgtcgtaggagtcggtgaagctcacggacttgacctcgtaggcgaggtcggccggcagttgcggctgggtgttgagctggtattcgaccttctggccgggctggacgactttgccgtccaagctctcctggtcgccgccctggctcgcctcggacacgacgtccttcttgaccggcgggatgtagccgcagatctgcggttcgttggtcggctcggtgtggttgttgacggtctcggagccgccgttggtcaggttcttgccgttcggggcggtgcagaaggtgagctcgtcacccgcctgcttgccgaagtccttgcggacctgggccgcgcccttgccgtccgcgaagttgatcctgccggggatgaggagcgtgacctgcttcgggttcttcagcttcttcaatcccttgaggtaggatgccttggcggtggcggtggccttggtgccctggacggtgatgtcgaactgggcggtcacgtccttgccggtgttgacgatgtcgctcacgctgctttcgcggtcggtgccggccgtggcctcgtacacgcggatgttcttggtgtcggcgtcgaaaatgtagtcggcggcagtccagtcatcggtgagggtgaactgtttcggcgcctggatcaggttcctgccgatggtgccgttgacgacgctgccgaccttgtctccgtcgaggtaggtgtgggagtcgccgccggtcttgttggtctcctgcgggtcgatgacggcctgccattcgccgtcctgctcgaagatccagctcttgtcggggttgggctgccaggtgtcgaattccttgctgccggcgtcggcctcgggttcctggttccacttgccggtcgcgtggtccttgaccttcctgaagtccttcggcttgctgacggtgatgtcgaagctgaattcgtactggtggtcgaggggcatctcgcccttgtcggcggtgcgcacggccgagacggtgtccgtcttacggtcccaggtgatggtgaactcgccgctcacatcacggtcgttgtcgctcttgtcgacgagccggtagctgtcgacggtgtagtcgacgccgttggccgtgatcctgtccgtcagggtcatctcgtaaccgcccttgccggtgccgtagctgatgacggtacggttggtcatgccgtccgcgctcacgccctcgtcgatggtcttgaccggcggggatggtggttcggcgctcacgttccaggtctcggccggatccttgtcggccgtgtcgacggccgcgttcatcctgccctgcttggcgacctggatatcaatccagtactggccttcctgccagtggctcatgccgaagtcggctggcgtggcgaggttgtcgagccgggtgtcaccgttgttggcgaaggtgatcggcttgctgaccgtcttggctgcgacgtagccgttcttctggccctcgtagtggatgatggccgtgccgttcaggttctccttgatgccgctgccgttgttgctcgcgtgcaggatgtcgccgatcgggtcggtggagccgaccttcaggtcggtcctctgctgatgcgtggtggtgaccgtcagatcgtagttcggcggggcgggctggtatttgtcaagcgcgatgatgacgatgctggccgtactggacacgtaccgttccatgagcttgtccacgctcatggacggatcgtcatcaaacgcggtagaggtcttatagtgacgagatccggcgtagttgtagtcacctggtgcgacgtacttgttccagttgtccaaccatatactcacgtcggcgatgccggatccgttccatacgctggtggtggacccattgccggagaccgcgccgaccgcgacgacgcggcagtcgccgtcgccctcgcccggatggcgctgatggaaaccggcgacgcaccggctgttcgcgtcggccaacgcggcggcggccttgccggacgaatcatccatcgtcacgcccacggccttcatggcccgggccacgctgttcaagtcggtcgaactgccccatgagccgtctgccgcgtccttgtatgcccagaactgcgtcgccgcgccgctgccgccggtgccgggcctattgccaccctcgccaccggcgtatgcggtgcccgaggtcagaccgccggccagggtggccacggccgtcagcagcgccaacgtcttccgtttccgtttgctgttgttggaacccaacgttcctctcctttcagagattctgcacttgactatgtcggggcggggatcgcgatccccgcccgataccattgcaacccggtttcactgactccggtttggacattcgcgcaggagacagaaaagggccgtcccacggatgttcgtgaaacggccctgaaagagaaacggagtcgaccggcttaatgttggattgggatggaacaatcttccaagctacaggcacctggatcgccccatccgccgctgattggacccgaaccgctggaaccaccggccgaaccggacgatgagccagccgatcccgaggatgcgcccgccgaaccggcatttgtgtaggagcggcccgaactcgtgccggtgttcgtataggacggcgtgtacgactggacctgccgttgcgcctgcgcggccgcagcggcggcctgggccgcggcctcctgttcggccttcgcctcctgttcgacctccgcgtccgccttctccttcgccgtcttcgattcgttgaccgccttcacggctttcgcgatggcgtccgcgtcgcgttttttgatggcgtccaacaggctcgcgcgggtcttgtcgtccgccaccttgccgtcggtctccttgtacagcgcgttcgcgtcgtccacggtcttgtcaagtttggacgtttcgaccgctttcaccagcctgttcagggacttcccatgcgtccagtaccatgccgtgttcgcggtgatggccttcgtggccgtgaccacggcgtcccttgaatccgctttgcaggacacggtcttcggcgtggatgccttcatggccttgcccagcgcgtccagggtcttcgcgtccttcacgcttttcatgtccgtcttcacgacgcttgcggcccggccgttcaacagcgcgttgtacgcggtcgtcgcgacgtggagacgttcgctctcggccgcgcagtccgccttggcttcggccatgagacgatccgtgtgggtcttccacacgatgccacccgccgcgagcagcgcaatgacggcgacggcgataatggcgacggcccgtccgcgatgcggtttcttcgtcttctcttccataggctcggacgaaagttcgacggtctcctctttctctgtcatttgtcctccttgtttcttagcttcacagcttatcgaatcggcggagccatccgcatcaaggatcatgatgcggtccatcattcccctccattcaagcccaggtacgtttcgagggcagaatcgaccacctcctggatgcgcatgtcgtgctcggcggcgaaggtcttgagcctgcgtcgggtagaggcgcgcaggctcacgctggtcttcacccactcctccccggattccggtttttcgttttgccggtttttcggtattccagtctgcaccgttttcggtttttcggtatttaccggttccggtcttccggtatccgccggttccgtccggtcgctgttgagcagcatggtcagatcgcgcggtcggggcgtcaggttcatgttcctcacaggtcctcctccttgtccttgagctgtcgcatggtctgcttgagttcgccggccaagtcgcggtactcgtgcagtcgcgagccgcgcggtcgggtggatttcgcgttgaggatgtcctgacgcttcggaatcagcgtctcgaagcacgcgatgtccgaaccgtcgatccacgccagcgcgtcgcgcagggcggtcgtgttggcctcggtgcggcacaggaggatcgctgcggggacgccgcgccggtcgcacagatccttcacgccggcggcctggtcaaggtcgatgcggctggggctcgaggggatgaccacgaggtccgcgttgttcaccgattcgtccaacgcgcggccgtacggggcggagtcgatcagcacccagtcgacgggatcgtcgagccggtcgttgatcccgtgcaggtgcgtgatgtcggccggcgcggcggacatcacgtcgaacggcagcgggtcgtccagctcggcggccctgtaccaccagtccttcgcgtcgccctgcacgtccgcgtcggcgacgagcacatgctgctcgccccgggactggtccacgagggcgcaggccaggaacacggccgatgtggtcttcatgctgccgcccttgccggtcgccaacgcgatcaccatcggctcgcggttcttcttgtcgttcatcgttctccttatttcggtatgtcggtatccggtttttcggtattccggttagttggtttttcggtatttcggtttatgccgcgtcccacgcggatcgcgacgggaagcggtcagaagaggctgccctggaccaggcccttcggcacgggttcggtcggaaggaacagcggatcgtcggtcgcgtattcgcggcgcgagcgttggcggcgtttagcccgtcgccagtagtcgcggccatcacggcgcatgcgttcggcccagtccggatgttcggccagccagtcacggacccgactccgtgggatccggtgcaggccgccgtcggcgatgtggaggtcgcgggcgatcagtcgggagaggatccaacggctcgcatagtcgagcccgccgtacacggccttgtccttccaaccgttgacgagagcgcggctgatgcagtcgaggcgcatggggcacgcggcacacagcacgcgacccttgccgcgcatccgttcgtcgaccaggtcccggccatcgtcgtcggtcgtcgtgttccacatgcgatccgccatggccgggtcggccgcggcgatcctcgcgcaggccggcatcatgtcccgcccgttcatggccgccgtccttgcgtcatcggcgtcttgcgggcatggaggcgtcctatggcggtttcgccgggattgcgggcggcccatgcccgggcgtattggatcagcagaccgacggccttgggatggccgaggcgcttgttgcgccagtagacggcatgcagctgccagatcaggtccgcgtgcccgtcgagctgcgggttggcgaggaggaattcgttgaaacccgcctcggaacagtcgatgcgcgtgatcatgccgtcgcctcccctccggccgtcgcgtcctggccgtccaattcggccagcgtctccacggcccagtcgggcagccatggcgcagcatccggctccgacacggccgccggaaccgtctgcgcgtgtgcgtcgccgtctgtgcggccggctgcgaggatcatgtcgtcgttgagttcgtcccagtgtctggcgagggcccggccggtgcggatgcgtttgggccaccaatcgccgttcatggcaaagccgatcgcgtcgaccatcacgagggtgggccattgcgctccctggtcgacgagcctgcggtacaggccgatgatggccttgcggtcggctttggtcggtgaggacgtggccaggccgagcatcgagcgctgcgcaccgagcgaggcgaggacccgtccggccgcttcggcgatctcggtgtcgtcctcgtcgagttgttcgtttttattcttttcggcggcggccgccccgcttgcggggagatgccccgtaggggcagaggggaaggagggtttactcggagggtttacctggagggttttatccttatatagcagccctgcggcatttgcagtgctggaggtgcagctctcgcagtgctggaggtgcgagatttgcagtgccggttccggccctttttccagccctgcgagatttgcagtgctgggaatcggcttggttccaacgttttccggcagcacgtcctcggattcgccgttttccatgatggtggaggcggcgggatccacggtattgcccatggtcttcgggtcgtgttccgccgtgtgcgtctccttgatccattcgagggtcgacgggtcggattcgaccgcgaggtcccacacgatctggcagtactggggcagacggttcctgccgcccttgccgaggcgcgcgtaccgttggtcgccgcggcggatgaagccgcgttcctggagcgtcttcaacgcggtgcgcacggtccgttccgagagttcggtgacgttgacgatggtcgcgatcttcggataggctgcggtgccgtcgtcgtccgcgcggtccgcgaggtagacgagcacggccttcgcgctggcgttgcccacatggcatttgaaggcccatgacagtgcgatgttgctcacggccgctcctcctcacgctgctgggcggcacggcgttcgtcggccaatctggcggccatctcgtcgccgagacgagccgccctacacagggccagcgtcatcagccatgagaacgcgacgaacacgatcaatacgattgcaagccagttcacgcgagtctcccttccatggacgggtgcgccatcatcgacgccaggcgacgggaatcgacggagcccggaccgttgtggcgggcgaatgccgccacgaccgggaacgtccaaaccggcgcctggaaatcccggttacactcgggaaacacagagcaagacatgcggaatgctttagtaaagtcgttcatgtgtgatcactactccaagacaatgcattgggcggccacggaccgggatccggcaagatacaggatccgcggccgctcggaatattggttgcaccgcccgtccccgacgctccaacatcgggaacgggcgtttttctttcagttgcagagaaagagagaaaatcgaatgaaatcagaccatcgcaccacctccctcgccgtcgacgggccacgcgccgccgcaacggatggcgaggcaaaggcaatcaagagcctgctcgtcagggacatcaaaggcttcgatcaaagcgttccagcagtcgtcagacacgatgatggaacgatcaggcctacgtacataggcgtatggggacaggaccgtctgataggcgcggccctcatccagccagccctttacgtagccgagacgctcatataccgcaccgggacgagcggggtccatgccgcacagatacgagaagctttcgccgagcatgcagccctcatcgaagggatcgcggtcgtcaggaagcatcggcgtgaaggcatcggattgcagatcaaggcgttctgcgactcctgggcggcagaccacggcgctgagctgatactcagcatccccaccaacgagggcgcgcgcctgctcaacaagaaagccggatacacggtcgtaccgcccgatggatatctcaccatcaaggtatttgacgctcagggacagcctcttcacattccctacgccgaccagcggacccagaacagaggcactagcatgtgggcgtacaagctcgtagggcaacgcacacagcacttcgagatcggcgttctcaccgcctcctgaagttccgaagaccataccgtcgatgaatgttcccgacgggtcgcgggagaagatgagtcttccggcttcgtctctcgtctcgtcaaaggtgcggtcgaggaacatatcggccatctcggccttcacgttgaaggacttgccgccaccggacgtgccgagcacgaacccattggagttcatgtggctgcgccggtccgcaaggagcggattgccgcactgttcgtcgctcatgacgccctcccctcggtcagcagcaggttcgccaccacccgttcgcgggcggagagctgtgcatcgacctcccggaaggcatgcgtgtaggcatgcgtggggcggagccaggtgtcggccagtccgcgggtctcgccgcggcgcagggcgcgcacggcgcaggccgggcagagctccaagatctccgtgtcgcccgggacgcagtagttgcgccagccgttacgggcgaaataagcgtcgcgggcggccgaatcgtagtcatcccagaacgtgccccagaccaccgtgtggcagccatcgcacaccgtgacgcaatcccaccggctgtccggccattcggactgttcgtagattccaccagccatcacgcaacctcctcacaatcggcatcaagccccagcaaatagtcggtagacacatggaagtgctcggacaacacaacgatgtctgaagttgtccaaccaatgcgtcccaagagttttccattcgccgaggttttcgatagaccaagcaatgaaccgagttgggcacaagtaagtccctcaccctttaccagagcacttatcctttgggtcactccattcatagttctttctttctgacttggttcatttttactgtactttactatagcgtacagtttgactgaacgcaaatcgtatgagacacttaattaagaaattctgaactatttttgggaagtgatcatatgtccacatcggaagtctcgccagaaacacctttggataaaggacagcgtgctgaagcggcgatcccgaccaacgtgagagtttatctaggactaagcggaaaaacacaaaaggcacttggagaagcgttgggcattaccaagagtgctatgtccatgaaaatgtgtggcaaagttggatggtcagtaagtgatcttgtaacgacctccgattttctaggtgtcacgccgagcgccctaatggatgacacaattctcagcaaagccgaggccggatatgcaaaatcggccgagtatggagtttttgccgagaagccaggtgctttggtaggtgccggctcccccaggttccttgtcagtcccttcaaccccgacgccccggtcgagggtggaatctcaggtgcagctaaaggtgccctggccggtttcgtgccattcggggtcccgtccggctcgggttccccgtccagcccctcgaagcatgacgcgattggggtttccggccggtctcaagcccatgagacacttgggaccatgactaccatcatcatgcgcaccactgagggcagcatcaccatcaacctgttcgacgacaaggctccgaacaccgtggccaacttcctgggcctcgccaccggcgagaaggaatgggcggacccgtacaccggccagccttcccacggcaagttctacaacggcctgaccttccaccgtatcatcaagcagttcatgattcagggcggttgcccgctgggcaccggtaccggcggccctggctacgagttcgacgatgagatcgacccgagcctgaagttcgacaagccgtacctgttggctatggccaacgccggtctgcgtcgcggcatggacggtaaggtccatggcaccaacggctcccagttcttcatcaccaccgtgccgaccccgtggctggacggtcaccacaccatcttcggtgaggtcgccgatgacgactccaagaaggtcgtcgataagctcgaaacactggacaccgatccaatggatcgcccgctcgagccggccgtgattctctctgtggacgtggcggagtaagaccgacaacatatacggcaaaggtcctgattggtattccagtcaggaccttttcgtgttcttggctcccctctctgaggggagccagagtaaggcaacggcctacttcatcttgcgcagtcgaggttcggcggattccttggcaccagtgatgcggtacacgtcgaacacgccatcaatcttgcgcacggctgccagcaacgagttgagatgctgcggatcggccatttcgaagctgaactggctggtggccacgcgatcggaaccggtggcgatcgtaccggaaatgatgttcacgccatggtcggaaagcacacgtgtcacgtccgaaagcaggtttcgtcgatccagcgcctcgacctgaatcttgaccatgaacaggcccttggtgctggtccattcgacttcgaccacacgctcaggctgcttgtttttcagatcgatcatgttctggcagtcggtgcggtgcacggatacgccctgattacgggtgatgaagccgatgatattgtcaccgggcaccggcatgcaacaacgggccagcttgatccacacatcgcccacgcccttgacggacacgccggtggagctgctggaaaccttgcgttccacgggcttcagcggcaggacttcctgctcgacttcctcatcgacctcgtcggcacccgcatccttgaccagatgcgagatgacgttctgcgtggagacctgtccgtcaccaatggcggcgaacacggcgtccgcgttcgggaagttaagatcgtcggccacacccaccagtgcctcgggcgtaagcaatgtgttgaccggcagattgcgcttgcgcatcgcgcgggtcagctcgtcgcggccctcctcgatggcttcagtacgacgctccttggagaaccactgacgaatcttgttgcgggccttcgggctcttgacgaagctcagccaatcgcgtgacgggccggctgtatcggatttggacgtcagaatttcgacggtatcgccattatcgagcgtggtgtcgagcggcaccaaacgaccgttgacgcgcgcgcccatcgtacggtggcccacttcggtgtgcacggcgtacgcgaagtcgaccggcgtggcgtgagcgggcagggatacgattttgcctttcggcgtgaacacgtagacttcggacgagccaaggtcttccttgagcgagcccaagaattcgttggaatcaggggtttcgctggtccagtcggcgagctgctgaatccatttgaggttatcgacctcggaaagctcctgattgttttcatcacgctttcgatcggacttgtccggcgagctcagggcgcggccggcctggccgttttccttgtatttccagtgcgcggcgatgccgaattcggcgcggcggtgcatgtcccaagtgcgaatctggatttcgaccggcttgccaccggggcccaccaccgtggtgtgcagcgactggtacatgttgagcttcggcatggcgatgtagtccttgaatcggccgggaaccgggttccaccgcgcatgcacggcaccaagcgccgcatagcagtcctgaatggtgtcgacgatgatgcgcacaccgaccaaatcgtagatgttcgcgaaatcatggccgcgcacgatcatcttctggtagatggagaagtaatccttcgggcgtccggtgacgtatgccttgatgttctgctcgtcgagatcctcgttgatctccgccagaatctgcttcaggtacacatcgcgctggccggctcggcgagccaccagcaccacgatctcgttgtagatcttcgggtagagcaccttgaagctcagttcctcgagctccgtcttgatggcgttcataccgagtcggttggccaaaggtgcgtacacgtcaagggtttcacgcgccttcttctgggcggacgtggtcttcacatagcgccaggtgcgagcgttgtgtacgcggtcggcgagcttgaccaccaaggtacgcacgtcgcggctcatggccaccacgagtttgcgaatggtttcggcttgggcggaatcacccacttcaagctgactcagcttggtaacgccatcgaccagaccggccacggtgtcgccgaattcggcgcggcattgatccaacgtatagtcggtgtcttccaccgtgtcgtgcaacaggccggctgccaccacgatcgggcccatgcccagatccgcgagaatctgggaaacggccagcgggtggatgatgtacggctcgccagacttgcggcgctgggcggagtgctggatgacagcacgccggtaggcacggtcaagaatggacaaatcctcatcggggtgatgggacttgcacaccttcttgattggatccagcggattgagcggatcggcactgatctcacaacccaacttacgggcggcgtactgctcgccatcaatctctgccatgccagtcacctccctcgtcatgaagttcattgtagccgcgaaccggagccttgtgcattcacctgttcgccatcattggttccacaaccgttgttgccgtcatcaccttagtcattcaaccggcctaatccggtcaggacgccactcccgtcgaaccgaacccgcgttcggcgcgatcggatccgggcagtgtctcggccgggatgaaccgagcctcaacataccgctgaatcaccaattgagcgatgcgatcgcccggatggaagacggcggtgtgcttcggatcgaggttgatcagaggcaccttgatctcgccacggtagccggcatcaacggtgccaggcgcgttgagcacggtgacgccctgcttggcggccagcccggaacgcggatgcaccaacgccacgtagcccgcaggtagggcgatggccacgccggtgggaaccagtgcccgttcaaaaggcttcagcgtcacatcgacggtggtgatgaggtcggcaccggcatcgcccgcgtgggcatagtgcagctgggccggatgttcggggtcgaggctcttgaccaggacctcggtggattcgggctcgttgtaggtctcgtcgaacgccatcaggcggcgcactcctcacacaccggctggccatcctcgtccgtgtaggcgagctggctgcgatgcttgaccaggaagcactgcgagcagatgaactcgtcaccctgcatggggatgacggtcaccgaggaatcctcgttgctcaaatcggcgcccggcagttcgtagtcttcggcgatggcgttctcatcgtcgtcgatgtcgctcgaggcgttctgcgaggacttccccagcgcctgcagcgattcctcgtcctcatccttgttgcggggggaatcataatcctgagccatcatggtcctttcgtcgtctttggttcgtaagtcgatatatatagcacggtcagcgccgtactcgcccataggatacacgatttgaaatactcgtaaagttcgacacgtggggcatacttaaaagaagtaatgtctttgcgacggaaagtggtgcgaatatgccagatgatcggcttgaaaaagcccgtttcgtgcgcgtgagcaagacgggggacctcgtattctcccttggcggcagggaaatggctgtgagcgtggacgacacgctcgaacgggcgattcttgaggccaagcaggtcagaagcgagatgcgacaggctccccagccgcatcagcagtccactttgccgatttcccagatacagtcgctgattcgcgccggtgccgatccggcccgtgtcgcggagaaatatcatctgagcgaaatgctggtacgtcgtttctccatggctgtggagaccgagaaacagtatgccatcgaacagttccttgccgtggcggcacccaaagacagcagggtgcgcaccatcagcgaactggtggaacgcacgctggcctctgcgggaatcggcatggaatcagtgacctggaaatccacccgacgtggacttgagccttggcgcatcgtggcgatattcacttccgcgggccgtgagatccatgccgaatggacgtggaatatgcacgacaattccgtgatgagcctgaacaatgccgctcgaaaactgctcggcgaacagaatccggaatcagccacggattccaaactcaagccgacgattcccgaactgcccggcgactccgtacgctccgcgcgtatcgagcgcgccgtgtctgcttgggcggctcctacgccttcgattccggccgcacggcctgccgcaatccggccctctgtcacttccacaggttccatgcccccagtggatctatccacgtccatctcaccggccacgacccaggctcatggcactacggcccccagtccggtctcttcgcagaccgccggatctgtttcgccatctgccgcaggattacagcaatcgcctgccacggcaccagagcagggctctgacaatgtttcggacaagaccatacggagtggccccaatgcacagctagtagccaccgagcaggagcgggcggccgaatccgccgccaccgaacatgaggcaccagccaaaccggccaagcgtaaatcaggacgttcggccgtaccaagctgggacgagattctgttcggagactgaatttccgaatcaggccatatcgatcaggcagggaatatccatttccaatgctgtttgggagccatgcacgctcggcaggtgggtggccttgtctccttgcgtacgcgaatcgacgagggtcacggctcccgctgcctgcacgaccacatcgccgagcattggccggactcgctcgcagaccggtccaaacaatccgtccgcgatggcctcatccttggtccgcaccaaggctcggtcttgcagacaatcgcgccaccggcaagctatatcctcaggtcgttcatccggctcggcatacagcatcagcgagcgcggctcccccccgaccagtgacacgcctcgggtgagctgcggttcaacggcgatgtcaatccgctggtccatgtcggtttgcaccatgccgtggtcggctacgatgacgatcagcgtgcctttgggtgcgctgcgtttcaggagcgcgagctgggcgtcgatatgttcgaatgcggccacccagtgttcggaatcccacccgtaattgtggccgactttgtcggcgtcacggatgtacaggtaggtcaggccgggggtgcgggaggcgcgtgcggcggccagcacacgatcgcgtggggtgacgttgccttgatagtcggtgcctcgcaatgcggcttcggtcaatggcgatttggagaacttgggcaaccccgagctcgtgacgcgcacctcttgagccgcaagtttctcgaacaccgtctcctcgcgctgcaggtcgagcggatcgaccatgggcggcacaggaatgtgcggattggctggtttgggtgccagcgcgtctttgaactggatgagttggatgagcttatggctggcgggttcgagctgcgtatagcccgccattgcggtcagtcccgggcaggttccggtaccgaatgcggccatggccgccacagtggtgcttggagcgcaggtagcgatgggacgctgattggcgctttcgttcatcagcgaacgcagatagggcgcgtggccgaggcgcatggcgaggttccagtagcccaggccgtccacgagcaccacgatggccgattcggcatcgggcagccccaacgcgcgctggcatgccttgggatcggcgtggaccttggtgggggccggatgtccgatggcggcggacaaggcgggcagcacggcggacaggtgcagtgctcccccacgccgatcggccggggcgtcgtccccatagcccactgtgggcaccagccgcagcaactcgtccatatccggcgtctcaacactcatagttgcccattcaagtagcacccctccccttggctcagtgcgcagagaacggttctcaataacaactgtgcgctccaacgcacataatcaaacaaacgcacatcgactgaaacactggaatcacgccgttttatcggcaaacatgtgcgattggcgcaccgaaaccagcgcacagttgttatcgagaaccgttctctgcgcactgtttcgcgccctcccgctaatatgggggcgttcgaaagggagtttcatggcatcacaccgcaaaccgtccgcgcaaacctatgatccgcgcacggtcaaggagcatatcgtcgagacaccgctgaacgaggagatgagcaagtccttcctcgagtatgcgtattcggtgatttacgcacgcgcactgcccgatgcgcgcgatggcttgaagccggtgcagcgccgcatcgtctaccagatgggcgagatgaacctgactcccgaccgcccatatatgaagtccgcccgcgtggtgggcgaggtgatgggcaagctccacccgcacggtgattccgcgatctacgaggccatggtgcgtttggcacagccgttcgcgatgcgtctgccgctggtagacggccacggcaacttcggctcgctggatgacggccctgcggcctcccgttacaccgaggccaggcttggcccagccgctctcggcatgaacgcggatatcgatgaggacaccgtcgacttcacgccgaactatgacaacaagctcaaggaaccgaccgtgctgccggccgccatcccgaatctgctggtcaacggcggctcgggcatcgccgtgggcatggccacgaacctggccacccacaatctgggcgaggtggtaaacgccgccaagttcctcatggcgcattcggacgccaccctggaacagctgatgcgttacgtgcccggccccgactggcccaccggcggcacgatcatcggccgcgacggcatccgtgaggcctatgccactggccgtggtacgctcaccacgcgcgccgccacgcatatcgagcatgtcacggcccgcaagcaggccatcgtggtcaccgagctgccgtacatggtgggcccggagaaggtaatcgaacgtatttccgacggtgtgaagaaccgcaagctggaggggatttccggcgcgttcgatctgaccgatcgtcataacggcacgcgtatcgtcatcgagatcaagactggtttcgacccgcatgcggttctggtgcagttgttcaagcacacaccgttgcaagacaacttcgccatgaacaacgtggcgttggtggagggccgcccgcacacgatgggtctgaaggagatgcttcaggtgtgggtggaccaccgccgtgtggtgattcgccgccgcagtgaatatcgcaagaagaaggcgctggagcgcctgcacctggtcgagggcctgctgctggccatgttggacatcgacgaggtgattcaggtaatccgcacctcggatgatgcggatgccgcgaagagccgtttgatggtcgttttcgatttggacgaggtccaggctcagtacatcctcgacctgcgtctgcgccgactgaccaagatgaaccgtatcgagcttgaggccgaacgcgatgatctgaagaagcgtatcgaggagctgacccggatcctggcctccgccgaggcgctcgaccaggtggtcaccgacgagatggacgaagcggtcgccaagtggggctcgccgcgccgtaccgtgctgctggatgccgacccggatggcacgttgacgccggtcgtggcgcagggtgccggggcttcgggcgtgtccaagtccgcgctcgaagcggtgaaggccgccactacgatctcctccgccgaagccgatgtggccgcagccgcagctgcggccaagaagaccggcgaacagtccacgctgaccggagccttgaagatcgaggacgagccgtgcgtggtgatgatgagcgctaccggtttgattgcccgtaccacgccaagcgcgatggacgtgttcaatgcacgatccacttccgatgagcgtttgagagacgatcagatcaccacaatcttcgagacttccacgcgcgctacgtatgggctggtcacgtcggccggccgcctggtgctcgcgcatgtggttgatttgcctgccttgcccgctgccgccacattgtcgctgaagggaggagttcaggccgacgaactgatcggcatgaccgaatccaccgatccgattcgcggtgagcgtgtgattacggcgattgccatggagcagccgacgtccggcaagaccagtgccaaggacgagagcgaggatggcggggccgccgaggccaagccgttgccgtcgctggctatcggtacccgtaacggtgtcatcaagcgttggaatcgtgaggcacccaccaccatggattcttggcccgtcattgatctgaaagatggcgacgaagtggtattcgccgccgtggccgaggatgacgaccgtctggtgttcatctcctccgattcctcgctactgacctttgaggcgaagaacgtgcgcccgcagggtcgtactgcgggcggtatggccggcatcaagctggccaagggcgcccgtgtggcggccttcaacgtggttcccgccggcaaggtggcatggacctatgaagagggcgagaacggcttgacttccggatccggtgcagtggtgctcaccgtggccggcgattccgatgcactgcccggcaccgaaaacggcgcggcgaaggtcactccgctggaaatgtaccccaccaagggtcgcgctaccggcggcgtgcgttcccagcgattcctgaagggccagaacacgctgattcttgcctgggtgggcctctacccgttgcacgcctctacatccgcaggctctccggtcgagcttcccaagcccgatatgcgccgagacggttccggagtagacctcgcctcccccatcgccttcattgcgtaacctcaattaagctccctctgatgggccgagccgtaaagcaaacaccccagtggggtgtttgtaggcgaggagcgaacgatagtgagccaaacaatagagaagagaccctaaacccggcctacactaagcattaaggaggcggcgatgagactactggttgccgtatccaatgaaccgttggcccacgccattcgtggtgccctgcttgccggtcgtcatgaggtgtctttggcaagcaccggtagtatcgcgctcgccgctgtcgccaaggagtcatttgacgcagtgattcttgatgaatccctgctcggcatttccaccgagcagctcatcgaatccctacgcaatgcccgtgcctccgtcaagattctgctgctgacttcgacgccactcagcaaaaccattggtgaaggcagccgctggcgagcgctgcctgacgagtacgcccctatcgaagagacgccctacaactccttcagcgcggattcacgcgcaaacaactcagatgccgaagccgaacaacgctcggacaatgccgccgctagcgcacaagctaacgcacgacacccggatgtcgtgctgagcaaaccattctccgatggcgaactgctctcatacgtcggctcgcttgccaccgactcccccgccatgatcattcgtggcaatctcacgttggacaccacgaatcacaaggcctactacgcatccactcacagcgcaatctcactgtcccgtctggaatacagtttgcttgaagcgctggtcaaggctgatggccagttcgtcaacaccagcgagttggtcaaacttatcggcggcccattcttcgagcaacagggcttactcaagaacgccctctacacactggataagaagctcacccgcgccggcctcatcatgacccaacgaggctccaactaccgcattcgatagctgggctcaatcagtacagccgcatgccttggggaacgggggtgaagccggactggtggaggatgcgggcgaaggggtgacgggcgttgaggggttcgccattgatgtcgctgaatgtcacggagccggtgccattgcgtttgagggcgtaggccagttctgtggcggccttgcgcatttgttcgtcggaatcattgacagcggcttcatggccgaccgattgatcgaacgctgtcaggtgcttggctttggcggccgcgtatagtagcgcgccttgcgcattgagcacgaccgtggctccgatacggcgtgccggtttacccgcaccggcaggcgcgtccggccacgcgatggcggagccactgagatttgcggggtcgagcacactcaatgccaccacggactggccgcgatgctctgacggatgacgcaacgcatccacggtgtcgcgctcggcaaattgggccgcgccgaaaccacggacgaacatgcctcgtaccagtcgaccatgctcctccatgcgattcaataccggatacaacgctgagtagccacccgggatattttccttgtcaatcaccggctgcgcgatgacgccatacctgtccagcaacgtctcgaccagtgcgagtgcccgttcggtctggtcggtgtcttcggcttcagcttgcccgattacggcggaccacaaacctcctaacgtcatatccgtagtggctcggcgaatcggagcgacacgcccacgacgacgtgatgtagtggatttacgcgggcttgctgcgcctgcggttaatgcacgcaccggcgcgaagctggaattggtgaccttaccttgccagaccaagctccacaaggcatccttgaactgctgttcgctccactcttgcggaatgatttcgccggtgtttggattgatgtccggctccgcggtctcattccacgcacgtttggcggcatccatcagttgacgggcatggaacgctccccctgagtccagtgcggtcagaatcgcttccggcatggtggcgtctgaggcgttcgatgtcgtaccatgttccacaccgctgaacaatattgaatccgccggatagaaagcaacctcaccggggtccatcgcactggttcccccggtttttgagccgacccagaccacatcgccgctggtcagcaactcatccagcaatgcaggttggtagtctcgtactcgtgcggggaatactgccgactcccagagtgcagtgggcagtgatatgccctccagctgctcgataacgcgcatgagcccgtcagcaccttcatatcgttcgccgccgaccggcccgataccttgtcggtcgataagaaacatctggaacgcctctgattctactggcttgactgctttacgcgccttggccaatgagcgagaccgaatacggcggaatacgtccttatggagccactgttggccttgctcgtcatcatctacaaagtggccttgcagcaactcgcctttggcagccagcacatccagagtgtgcacggcatccgtagcatcgaggtgtagatcggctatgagctgatcggcggtgaaaggaccatgggttttggcgtaacgggtcacgcgaccagtcacatcatcgtcggcaagctcattccagaaagtgtgctcccccagttcctgttcgacttcgcgaatcacgtccgggttgagcacttgtgccatatcggtggcgccgagcaagcgttcgagcacgtgcggatcgagagacagcagttgcgcgctacgctcggcctgaggttggtcatactggtacatcaccacgccgacgaagccaaagagaatgttctcggcgaaaggcgatggcgactcggtttccacgtccttcacggtaatggtgccggcttgcaatccggtcatcacctcgttcagggcgggcatgtcgtatacgtcttgcaaacattcgcgcgcggtttccagcagcagcggaaagttcttggccatacgtgcggattgcaggagctgtgcggcgcgcagtcgctgctgccataggggtacgcgacggcctggatcggaacgaggcatgaacaacgaccgagcggcgcactcacggaatcgagccgcgaataatacggattcgcccacctgacgttctacatccgtttgaagatcctcggaatcgaaaaggaacagatcctgagcgggaatatgcccgtcgccatccggcagctggatgacgataccgtcatcggcggcatatacctgcccgtcgaaaccgtagcgttggcgcagtctgcggctgatggccatggaccacggttcgtgaacgcggcggccgaatggactcagcagtacgatgcgccatccgccgtcttcatcgcgtgtgcgctccacgataagggtttggtcgctggggactgcaccagtggcggcttgttgttcggagagtaggcgggccaagttggtgatggcgttggcatctaggccatcgtggtggagacgggtgaggattgttgggatgaaggttgggacagctggaccttctgcggcagacctcccctcagtccgcttcacgtctaatccggcggcgatttctcgggtgaagcgggctatggtacggctgaaaccgtagtcacggccagcgccttcaccgtgccagaacggcaggcgggcggtgcggcccggagccggagtcacgaccacacgatcacgggtgatgtcctgaatctgccatgtggaggtgccgagcgtaatgacatcgcccacgcgcgattcgtagaccatctcctcatccaactcgccgacgcgacgctggcctttgccggcgtccgcctcaggcaggaccacggtgtacagccctcgatcgggaatcgtaccgccagaggtaacggccactttctgcgaaccgggacgggcggaaatcaggccattatcccgattccataccagtcgcggccggaaggccgagaattcctcgctgttgtattcgccggacatcatgccgattaccgcatcgaacatgtcacgtggcagttcggcaaacggcgcagcacgatgcactgtggcataccagtcatcagcgttcaaatcgtgcatcgcggcagcggccacggtctgctgggcaagaatatcgagcggattgcgcggcacggccaatggttctatatcgccggcaatcatggcttccagacttgcggccccagtgacaatctgctgacgggtgagcgggtagaacaatgcgtgagagacgccaccgacctgatgatcggcacggcctacacgctgcaatccggaggagaccgacaacggcgtatcgacttgaatcaccaagtcgaccgagcccatatcaatgccgagctccaaactggaggtggccaccacgcaacgcaattcaccacgtttaagccgttcctcaatcattttgcgacggtctttggaaaccgacccatgatgagccatggcgatgacatcatcgccctcatgtgagccgacaagcatggtggtggagccgaccacagcatcgtaatgcgtggagaacccttcgcggccttccggagagcccagatcccgcacagtgtcgggattggtgccatgccgggtctgcgcatacagatcgttcaagcgcgcagtgagtttctcagccacaccacgcgaattgacgaacaccaatgtagtgcggtgcgcgagaatctcatccaaaatactgcgttccaccacgggccaaatggaaccggaggtacggtcgcccgccgctccaaccaacgcggaggaatcgaacgcatcactcgcatcagaatcgtccccagaagtggaagaaacatctctatcatccaccggcacaatgcccctgcgttcagcaagtcgctgcatggccggcgtgacaccactgatatgcggagcggaccgttcagcatccacgccaccgacacgctgcttggcattcacggactgcaaatcacgcatgttttccaacggctcaatcatgcgcaaatccattgcaggccgcccaccgggattcacgatggtaaccggttgcccgccgcccaggaatcgcgccgccttttcaggcggattcaccgtagcggatagaccaatgcgctgcatatgacgatcgccacggccagcatcgacggcggcatcaccgccctcatcagcatctgcatcgattgcatctcgcttgcgcgattctgtgacaaggttctccagccgttccagacttaccgccaaatgtgcgccgcgcttggtgcccgccactgcatgaatctcatcgacgatcaccgtatcgacagtgccgagaatccgccctgccttcgaagtgagcaacaaatacaacgattctggcgtggtaacgaggatatccggtggatgggaggctatgcgccgccgctcctgtgcggtggtgtcgcctgaacgagtggcgaccgcgatcttcggcacgggcagcccttgcgcctcgcattgtgcagcaataccctccaaaggctgttctaggttcttggccacatcggccgcgagcgcctttaacggcgagatatacagcacacgcacaccggcatgccgcgtgcgtggcacggtcatcaatcggtcgatggctgagagaaacgcggccaatgttttaccggaaccggtaggggcgatgaccaagacattgcgaccggaatggattgccggccatgcctgagcctgtgcctcggtcggctgaccgaaggcatgctcgaaccacatcttggtgggttcggaaaacaggctcaggctttcgtacatatgtacgattataggtcagctgaagtaggcgatgacttcttcggcggtaccgtaggcactttgggcaccaagcttggtggccgcataggcggagacgtaggagccgatttgcgcggattgcagcagcgtatgaccggcggccaagccagccagcacggtccccatgaacgagtcgccgcaaccggtggtgtccgctgcattgacttgcgcggcggatacgcgatgccaacgtccgttctcgatcaccaccgatcccgacgcaccaagcgtcactatcgcccggtcgaatccgtaatcggtgaatcgttcggcgacctcataccagtcgagtgattccacgtcatcatccggcaggcccagcagttgagccacttcatgctggttgaccagcagaatatccgtggcttccaccagttcgtgaggcagctcgtccataaatggcgagtcgttgagcagcacggtcacgccagcgtcatgcgcggtctgcgcggcggcgataacggtggcaatcgggctctccaaacacagtcccaataccgcgcattcggcgatggtcgtgcgatgtgattgcacatagccggcacttgccttggcattggaacccggcgaatagacgatggtgttctcgccctcagcgctcacggtgattaccgtggtgccgctggggccttcgacatgcaggatatcggcggtgtcgacgccggcctcatccagcttgcttaataggaagtccgcgttggagtcctcgcccaccgcgcccagcaactggacattgacaccgagacgagcggcggcagacgcctgattcgcgcccttgccgcccggcagcactttcatggcaccaccattgacggtttcacctggcttgggtagtcgtttagtggttacggtgtaatcggcgttcatcgagccgaccacgattaccgagcccggcgcatccttcagcgcttccaatcgttcccgtacgggctcgggcatctgttcatgttcttcttcacttatcaccatgggctccaagcatagtaggcgtcgggcccaaatgcgcatatgatcagccgcgcaacttgcgaagacgctcgtgcatggccaccatcagcaccaagagcaccagcaaataccacgggtagagactgattgtcgcatattgcgcgatgatgccgaacagtggcggcatgagcagtgagcccacataggcgcaggccatctgcacgccgacgatggcctgcgatttgtcttcgccgaagtaggccggcgtcgagtggatgacgcacggataaatcggcgcgcacccgaagccgatgaccaccagcccaacgaccacgccaaggtggtgaggcaatggcacgaacatggtgaggatgccggcgaacaccagcacttggccgaggcgaatcatgaccgggtccttgaatcgcatggtcaggaagccggaaagcgcacggcccacggtgatgcctacgtagaataggctggcccagctggcggcggtgatcttgtcgatgccgctgtgcatcaccatatagctggaggcccacaggcccgccgtagattcgacggcgcagtagcagaagaacatcacgaggatttccttggcaccgcgaatggcgagcacgccggccacgccgagcggtttgcgttcagcaacagacaccccttcagcagtgccaaatctctcggcattgccgtcagatgatgcggtgtcatcggtcgattcgccgaccgcaattgcgccacgtttcttccacagcggcaggctcagcaccaggatgacggtcagcatcacctgcaggatcgcgatgtaccgatagccccacggccaaccttggccttgagagagcgcatagcccatgatgtaggggccgaccgatgcgccgacgccccacatgcagtgcagccagctcatatgccggctttcgtagtgaatggctacgtagttattgagcgccgcatccactccgcccgcgccaaggccgtatggtatggcgatggccaacagcacccagtaattcgaggtaacggagaaaccggccaaggccgccgcagtcaacgccaccgaaacggcggtgaccttgcctgccccgaatttcaatgtcattcggtccgaaagcagcgccgagacgatcgtgaacatggaaatcaccgcggagatgccgccggcccacgccaccggcacgttcagatcctggctcatggtgggccatgcggatccgagtagcgaatccggcaatcccagactgataaacgccacatagatgacggcaagcaacagactggccatgtcccatctcccattcacagtacggcaccggttgtgataacgatgtcatcagtctatcgaatagcgcttcagcaacacgcaaacatcacagtttggagtcttgcccgcagtacaccggcgtggaatcggctacgccgcgcgggtcaaagccgatgatgtcgtagttgtccttgagataatcggcggcggtgcactcgatgaaatcctgatgatataccgcagcaccctctgacgaaatagctgtccgccaaagacggactgaggggagagaaatacgagtagcccgctaccacccgaggcctctcccccagtcagcttcgctgacaccccctcatcagagggagcttgagataggacggtcaggtatcgatcttggagcggtcgaaatcgtcggcgttgtcgacgatgaactgcttgcgcggcggcacgtcgtcgcccatcagcaggctgaagatctcggatgcctgggcggcgtcctccatgcggatgcggcgcagcatacgcgtgcgcggatccatggtggtgtccgccaactggtcggcgtccatctcgcccagacccttgtatcgctggatgtcgtcgttgtatccgatgtgcttcttgtcgaggtcggccagtttgccggccagctcgtcatcggaatacgtgtagatatattcgcccttgtgcgagccggtcaacgcgatgcggtgcagcggcggcactgcggcatacacgtagccgtgttcgataagcggccgcatgtaccggtagaacagcgtcagcagcaggatacggatgtgcgcgccatccacatcggcatcggtcatcatgatgatcttgtggtagcgcgactgttcgatgtcgaagctctggccggagccggcgcccaccacctggatgatggccgcgcactccttgttggagagcatctgcgtgatcgacgccttctgcacgttcagaatcttgcctcgaatcggcagcagcgcttggaaaccggcgttgcgggcggccttggcggtaccgagtgcggaatcaccctcgacgatgaacagttcggccacgtcgtcattgcccggctggcagtcggagagtttggccggcatcgaggcggattcgagcgcgttcttgcggcgcgtgacctccttggccttgcgcgactggatgcgtgcgtgcatttcgccgacgatcttctccagcacgcggccggattgttccttgtacccgcgcttggagccggtgatcatctcgccgaattgcttgtcggtgagccgggtgacgatcggcttgacctgcgcggtgccgagcacatccttggtctggccttggaactgaggttcggccacgcgtgcggtgaccacggccacgagtccggcttggatatcgtcgcgctccaccttcatggcggagtccttcatgttcaccttgagcttgcgggcgttgtcttccaccgccttgcgaatctgcttggtgatggcgttcatgaaaccgtccacgtgagtaccgccgccgggcgtctccacgatgttcacgaagctcatgattgtggtgtcatagccgttgacccatcgcagggcgatgtccacgccgcaggtgcgttcgatttcctgggcgtgcagttcgccgccctcacccacggcctgggtctcctccttataggtgccctcgccttggatgcgccagatgtcggagatcggctcgcctttggacaggaagtcgacgaagtccttgacgccgcctgtgtgcaggaattccacgacgcgcgggtgcgcgggctgttcgccgaacgcgccatcgacgacctggtcgccggccgtcagcgagaagtcctcctcggccgggctctcggcatcgctggacgagacatccaaggccggtgcctggtcttgcgcaggttcgactgttgtgtcatcagtggcctcgacggtgtcagtcgccgccgtttccggtacgttttcgtcgatgatggtgattttgaggccgggcaccaggaagctggtctgacgcacgcggtcgatgagctgttcgtatgagaactcggcggttttgttgaagatctccggatcataccagtaacgaatacgggtaccagtggttttgggagataccttgccgatgatttccagctcggtgggtcggttcttgcgagtgcgcttgaacggggaatcgggagacggattggccgggtcggcatccgtgtatacgccagggtgaccttggtggaaggtcatgtggtgcgtcttgccgtcacgatccacttcgacgtccagtcgggagctcagggcattgaccacggaggagcccacgccgtgcaggccaccgacggcgttataagacgagttgccgaacttggcaccggcatgcagtttggtcagcacgacctccacgccggacaggccggttttcggttccttgtccaccgggatgcctcggccattgtccgcgacttccacggaaccatcggtgtgcagggtgaccacaatgtcgttgcagaagccggccaaggcctcgtccacggagttgtcgatgatctcccacaggcagtgcataagcccctgcgagtcggtggtgccgatgtacatgcccggacgcttgcgtaccgcatccaagccctcaagaacagctaggtccttggcaccgtattcttctttgggcatacagtcctatttttctcttcaaatgcttggctcccctcacagaggggagccagatgatcattgatccaggaagtcgcgcagggtctgcgaacgggacgggtggcgcagcttggacatggtcttggactcgatctgacggatgcgttcacgggtcacgccatacacacggccgatgtcgtccagcgtcttcggctggccgtcttccaggccatagcgcatcttgatgacgccggcctcacgcggagacagggtttccagcacctgcttgaactgttcctgcaacagggagaaggccacggcgtcggacggagcgatggcgtcggtatcctcaatgaggtcaccgaactcggaatcgccatcctcgccaagcggggtgtgcagggaaatcggctcgcggccgtacttctgcacttcctgcaccttctcaaccggcatatccagctcgcgggccagctcgtccggcgtaggttcacgccccagatcctgcagcatctggcgctgtacacgggacagcttgttaatcacttcgaccatgtgcacaggcacgcgaatggtgcgggcctgatcggccatggcacgggtgatggcctgacgaatccaccacgtggcgtaggtggagaacttgaagcccttcttccagtcgaacttctcgacggcacgaatcagaccaaggttgccttcctggatcaaatcaaggaagagcatgccgcgacccgtgtagcgcttggcgagcgagaccacaagtcgtaggttggcttccagcagatggtccttagccttcttgccgtcggcggcggcccacttgagttcacgcttgcgcttgaactccatgccttcgctttcggtgtcgagcaggtgctgggcgtacaggccggcctcgatgcgctcggacaggtcgacttcctgctcggcattcagcaggctcacacggccgatctgcttcaggtagtccttgaccgggtcggcggttgcgccggccgcaatcacacgacgcttcggattgcccgaggggatgatgttctcttcctcatcatccgtgtcggagaccacgtaggcacccttttccttgggctgctcgggtgccttggacttggcttcttcctcgtcctcgtcgtcttccacatcatcgtcgtcggcatcgtcctcatcgaggtcttcgtcgtcggcatcgtcttcgtcaacgtcgtcaagatcctcgtcgaggtcgtcaacgtccaaatcgtcgtcgttgacctcggcatcgtcatcaagctcgtcatcgacctgagtgtcctcgtctttgacgagctcatcgtccttggccttcttcgcggttttcttcgcagcggacttgcgcgtggtctttttcgagggctctgcggacttggacttcttggcggaagtcttgcgtgcggtggtcgtagagctggccttcttcttggtctcggtctcctcgctggactcggctgtctgcttggttgccgtcgtttccttcgtggccaaaactgctcctcctgatctctcgccgtgaagtgcatataccacatgggcccacttctggcaagggcaaatcgtcaactatgtgagtaaaccaccctccacggacgattattcccacatcgttgcccgacgtgttgccgatcaccacacgctttccttccgcgcatcgcgcgtaaaacctcggaaatccgccgtttctgttcactcagcccgagcaccatgccggtgccacgcctcgatcggcggctgagaatatcatcgccgccagcgaacaatcctcatcgagcagcaggcatcgcaaggcgaacaccattgctcgcggatcgcccagccaccataaggtgtaggcgattacggccaatggctgtatgcagtacggcaccggtgaggcttcggcgatatcgagcaacataccgatgccggcatggcaacgctccttatccggcatcatgccttcatcctcgaatgcgcaagtcagcagctcgcccattcgtgttctcgtacgcgccagatgcggtcgcgccgcgaattccataagccatgacttggggcaacggctttcatcaataaccaacgagagaatcagcgcatcacgaatcgataaggtctcacgcatgcccaccgcaaacgcggccatcgtctctcggcctaggtcggtgttcccggcatcaagacaagacagccattcgtccaatggttcggccacccagtcggcattagcctgttgcgcgcctcgaagtcgtcgatcattgcgaaattcctgtgatctcgtctccaactcgtcaaagccaaagggctccgtctgctcggcggcgtgccgtttggcgtgtcggctcttacgcggcttgtgcggcgtgttgttgttcatcatgtcctccttgactaatggtgtgcaatctattggtgttgtggtgcgcgccgagccggatagctcatgcgccgagggggtgtgtgcccactatggctgaaaacgccgtatgacgcaggaaaaaacgaccattgtggttctagcttcaaaacccttgattcccaacgttcttgtgttcttcaaaccctgtggataagttattaggcatgtgcacaactgctaacaaccgcgaaatcatcgagccacgcatcattcagttggtgcgggaactgactgccgcccccgccaccgacgaggttgccgacgccctgaaaccggtgatggaacaggttgtggaccaagccgcctcctccagccaaggaggcaaacgactgcgtgcgctgctcgcgttggacgccttcgatattcttgccggcgacgtgacgcctgatcggcgtgacgccatgatcgacctggcctgcgccattgaagtgtttcagacggccgcactggtgcatgacgacatcatcgacgaatccgatctgcgccggggcaggccttccgcacatcgtgccttggaacaggccgtacacagcggtgccataggccgtggcttgggcctgatgctcggcgacattctggccaccgcctgcattgaaatcacacgccggtccgccagccgtcttcccaacaccgatgccctgaacgaggcgtttcttaccatgcaacgcgaggtggaaatcggccaggtactggacttggccgtcgagatgaccccactgtccaatcccgaagctctggcgaacgcctcattgaacgtattccgctggaagacagccagttacaccaccatcgctccactgctgcttgcactgctggccgcaggagagagcccggatcaggccaggcattgcgcgttggccgtcggccggccgctcggactggcgttccaactggcggatgacctgttggatgtcgtcggatcaagccgcaataccggaaaaccagttggcggagacatccgagaaggcaaacgcacagtgctgttggctgatgctctgtctgcggcagatacggcggataaggccgatctgattgccatcttcgaagaagattgtcgcaatgacaaccaggtggcccgcaccattgaactgttcacgtcgaccggtgctcttgatcgatcccgcgagcgcatcgctgccctatggggtgagtcccgtaaggcgattgccggtcttgagctgaattccgaagcgcaacgccgtctgaccgaggcttgtgcgcgattcgtccccgaatccttgcgatagtccacaatgcgagccgccggaccatgagaccatgaacaccggtgaaaacccgtgaaagctatgcgctgatgctccggccgcgtaaccggggccatgtacactgaacatgtttagtcgtgattaaaggaaccgtacgatacaacatgagtgagaacgagcccgcacagatgattgagggacgctaccgcatcgtgcgcaatatcgccgagggtggtatggccaccgtgtatgaggccatcgatgagcgtctggggcgcaccgtggcgattaaggtcatgcacacacaactcgccaaaggcccgcatcgggagcagttcgtcgaacggttccgccgcgaggccaattcggccgcgtccatcgccaacccgcacatcgttcaggtgtatgacaccggcgagttcaatggacttgattttctggtcatggaatatgtgcatggcgtcaatctgcggcatgagatgaacgcccaaggcacattctccgtacgtgagacgctgcgcgtggtcgcggagacgctggatggtctggcttccgcacatcgcgccggcgtggttcaccgtgacatcaagcccgagaacattttgatcaatgatcgcggccatgtgcagatcactgatttcggtctggccaaggccgccagccaggccacattgagctccaccggcatgctattgggcaccgccgcttatctggctcccgaaatgatcgagaacaatcaggccaccgcgcaaggcgacctgtattcggtgggcatcatggcatgggagatgctgaccggcaaggtgccgttcgattcggataatccggtgacgcttgttttcaagcatgttcatgaggacgtgccgtccgtggccacggtctgtcagggcattgatccgtccgtggcggcgttcatcgcccatctgaccgcgcgtcaggtggatgcccgccccaccgatggcgcggcagcagctgaggaattgagccagttggccgccaaattgccgctggaggcgtggcaataccgtttgcatgccgaacccatcggaggtgatcataccgatgccaccgctgcagcgctggtaggcaatatcgccgagcaggccccgctgaccggcgtacctgccggtgcagcaacgttcaagccgtccgtaccagcgtttttggccgatgatgtcgcaagcaataccgtcgataccggtggcgccgcagacgtcaatcctccggctcctccggtcgcccccaccacggcacttgattcgtcgacgccagccgatgcttcggctccccataagacgcaaatcatggcacagtccggcagcgagacacaagtgctgcctcaggccggcgatgccttcacccgagcgcttgccttttccgatgagccggacgtcgcttccaacggcaccgggccaaagaagcagcgcagcaaaaaaccgctcatcatcgtactggtgatcgtgctggtactggctgcaatcggcggaaccgccggctggtggtggtttgccggaccgggcagctattggagtgtgcccaagccggatgacgtgacctgcgatgcgaatgcaagcaccgaatgctcgttggccggcgcggattgggccacgtatgagagcacgttgaaggctctcggcatcccctacaagacgcacaaggaatacagcgacgacgtggcggaaggcaagatcatctcttcttccgtgaacaagaccaaggccgttgtgaacagccgcataagcaagcgagccaatcaggagcttacggtggtggtgtccaagggcgtgcggatgaccaccatcccgaaggatattctcgacgcgaattcggccaatggcaaggacccgttgaacgcgctcaagaaggccggcttcgataatgtcaagcacgacgagtcgaaggatgagtattcgatggacacgccgcagggtgtggcattgacgatctcccctgatcccggtaccacggccaagcacaacgatgaggtgacggttactttgagcaagggaccgatgccggtgaccatgcctaacatcgtcggtaagacccaggatgagatgcaagccgcgctcggcgagttgaagctcacggccaatgtcaccgaacagtacgatgacaaggtcgaggccggccaagtcatttccgcgtctcaggaagccggagcccagctgaagtggggcgatagcgtggacgtggtgatttccaagggtccggagatggcgacgataccgtccggccttgtcggcaaacaggaaagcgccgtaaccaagacacttgaaggtctcgggttcgaggtgaaaaccgacaaggtgctcggtggcctgttcggcacggtacgtaccgtgaaaagcggcgatacggacctctccaacggcggcaagattcgcctgcgcgacgccaacggcaaccccaccgtcatcaccctcaccatcgtgtgagatttgaatgaggctccctctgtcttcagacgagggagcctcatttgttaattacttttcggcttcttcagcggcctgctgggccttgagctcggccttgaccttctgggcgtattcgttcacgaattcctgaccgctcattttctggattgcggcggaaacacgatcggtcagcgaacgcaaatcatcatgtgtaatctcatcggccggcttcttggcaacttcaatcggcttgccatacaacaccttggtcttgcccttcttgggaatcgacgtgccaatcggctgcagcttgtccgagccgatgatggcggtcggaacaatcgggcaaccggtctcgagcgcaagtcgtgcggcaccggtgtgtcccttgtacagtcgaccgtccgggctgcgcgtgccttcaatgtggataccgaacaggtgcccatcctcgataatctcgcgtgcgtgcttgagtgcgccaagcgacttgctgccaccggaacgatcaaccgggaacacgcccacggacgtgaaccaccacttcttgaacttgcccttcaatcccttgccctcgaagtattcggctttgcccatgaagtgcaccatgcgcgggcaggtaatcggaatcaaagcatcgtcgatcaccgccagatggttggctgcgataatcgcgccgccctctcgcggcacgttattcagtccgctgacagcagggctcaaacgatgatgagcaatagggccgagacctttgacgaagaaccagtagagcacttggcattcctcccgcagacgaactagccattggccggtcgcctgattagagtgacagttatgactgagaaccagaatagcaatgccgacggagagcggccaacccccacgccgggcaacggacaggattccggtacttcatccaagtcgtcgactcccggtgccgccggacaagccacgaatggtgccgatacaccgcaatcgcatgacgcgaacgatttggatgcggcgtgggccgcgttcgaagccgagcatcaggccgacttgcatgacgtggcttcctccaggcaggccaaaaagttcgagaagcaggccaagaaacgcgagaaggaggcgctgctttccgtagatgacttggatatcggctcgttcaccgatgatgctcgcccgagccgtggcggcaaaaaaggcaagcagtcaggtccccgtgatttcaccggctccagctggctggataccgataatgtgatggacgcctatgatgatggcggcttcactcccccgaaccctgatcttggtccggtcaaagcgtctacggtactgctgacggcgttgcttatcattggtctcgtaggcgaagcggtgatgatattcgtccccggcttgaacgcgattcctctcttgggcgcgctgctcaatattctcttcgggctgggcgtcattttgggcttgggtggattggtggccataattctcaaccgcaaagaccgccccggtgatcagggcggctattacgacgacggcgcgagggtgtagctcgcgtaggctgtgtggtccttggctcccctctctgaggctgagccgttaagcgaacagcccagcgggctgtttgtaggcgaggtgtgagagatagcgaaccaatgtatcacaggcgtggctcgtccgtaattgcggccgagccaagataggtcacgaattgaagtcgatcccgttgtctaaatgaaagtgcaacacccgttagattggaaattgcctagaaaacgttttctaggcaatttccaatctaacgggtgttgcactttcatttagacaacgggactcgggttgcaaaggcctgaccctgatagtatggggtcaggcctttcccatcccaagacgccgctaagaattcacctgagagtcgccttcctaggcatggccgttcaatcgacgattctagcgtgactggtgtgagcaggaatatgaagaaccggcggtgggccggcaagcgatcggggatcgcttttggtgcagtagcgcttatccttacggctctggtggttccttatgcttgtgcgggaaccacgggagccgttcctttttccggcgataatccatcttccggcacccgtacggtgaccatcgccgacatcactgattttcacgggcatatcgaacgtggtgcagacaacgccaccgccttcaccgtggccgacagccataatcccggcaatatgattccggtatcgaccggcgatttggtgggaggctccccgtatgagtcggcggtggagaaggaccaacccacgctggatatggccaaagcgtggggattgacgatttcggcggtaggcaaccatgagttcgaccgcggtgtcgccgatttcaacaatcgtatcgctgatcccagcaacggcatcgactggctgtgcgccaacgcgtctgccgccaataagtcgcctgacggactgctgagccacgtacgtgactctacgattcgaacggtgaacggcaagcggatcggtttcgtgggcgcccttactgatgcgctcggctcggtggccactccgcagatcactcgtgatgccgatcttgacgaacgggcggtggacgcgatcaatcgtgtggcccgtgaactcaagcgctccggaaaggtggatgcggtggtggccttgctgcatgccgatgcttcagccgccgccgatattgggcgagatgttgatgtggtatacaccggtcacagtcacgcgatcaagcgtggtacaaccgcgggtggcgcgcctatttacgaggcgggcagcttcgggcggaacatggccgtgcaggatttgatcatcaccggtgccgggcgtcgcgccacggtgcgagtggccgatgtggacctcggcaatggcaccagccatacggcggttgacggcgtgctgggcgtggatgggcttaatgcgcatccggcgcaagccgcttggatgtctgccggtgctgaggagaacgatgaggtatcgcgcgcgcagcatatttaccaggcgtcggcaacatatgcgaaccataccggcagcgcggtgattggcaccttggcctccggcgtgaatttcgacaaacaaggttcggacaagcacgggaatacggtcggtgtgctggtggcggacgcgaaccgagagtcaatcatgaagcatgtgtatgccgggaatcgcttgccggtaatcggattttcgaataatggcagtctgcggactccacggcttgatatgaatggcgatggcaaagtcaccgtgcgcgaggtggatagtctcatggccttgcagttcaaggccgcgcatgagacgctcaccgggcgcgatgtgaagagagtgctcgccgagcaatttcgccgtgacgatgggcgactggagcggcgctggctcggcatctcctcgaacgtgacgtatcggtatgccgaatgcggtacggctggtgagagcggcaatgccgatgccggcgttgatactgattccggcgctgataccaacgctgacgctgacgagtgtgctgccgacgaacatgcggcggttcgtatcgcgaacctcgccgttgacggccgaccgattgcggacgatgacctggtgattatcgcgtccaattcatatctgcttcagggtggcgacagttaccccgccttccgtgccggaaccaattacggcgagctggatatgccatacagccagccgttgcatgaatatctggccgcacatcaagggctcacggcagttgttgcagtaccggtagggactcaggcgtaagacaccaattgctgggtgactgaggaactatggggtgaagttatgagtatagggcaggagaaaacggcataaatatgacgacgctcccctcgctgaggggagctgtcgccgtaggcgactgaggggagcttgcggtataaccgtaaactcccctcagtcagccttgctgccagctcccctctctgaggggcacctggcgagacccttacttgatggcgttcagccactgctccttggtggccttctcggcttcgagcttggccttcttcttcgggtcggattcggccgcgatcttggcgtcgagctcggcgagctgggcgttgagctgctcctcgaagctggacttgcgggcgtcggcctccggatcggtctgcttccaagcggcatcctcgatggccttgatctgcttgtcaacggcgtcgagacggttctcgatgcggcgcatatcgtcacgcggcacgtaaccgatctgatcccactcttcctgaatcttggccagctcctggcgggccttcttggcctcggcgtcggtcttcaccggcaccagagcctcggccttgaccagcagagcctccttggcagccagattctccttctcggaggagttgatctgatcgcgatcggcctgacgagcgttgaagaaggtgtcggcggcttcgcggaacttggcccacagctcgtcgtcctcgttacggccagcgcggccggccttcttccaacggtccatcagatcgttgaacttgcgggaagtctcaccccaagcggtggaatccttgagctcattggcctcggcgataatcgcttccttggcttccttggcggccgtgcgctcgttgtcgcgagcctgagcccacttgcggcgagcctggttgaaggtggtacgggcgacggagaagcgcttccacagcgcctcggcctccggcttgtcgatgcgcacggtggtgcgctggtggttctgccactcgtcgaacaggttacggaacttgtcggcggtggagcgccagttggtgttgtcgcccagagaagcggccagtgcttcagccttctcgacaatggcggtgcgctcggcaacggccttggcctgggcggccttgcgtgcctcggcgatttcggtcttcttggcctcgccggcagccttcagctcctcgtactgggtcttgagtgcggcaagatcgcccacgacggctggctcggaggtttcttcacccaagagcttcacggattcgtcgatttcacgggccttgatgttcggggaagccaggcgggtggccagcagatcgagcttggccttgagatccaggaaacgacgggcgtacagtgccaacgcctcttccttggagacatccgggaactggcctacctcgcgctcggcgtcgccatccttgacgaagacggtgccgttgtcatccacgcggccgaaggcctcggcggccttgacatcagcctcggaataggcggcggtggcggcggccggggcggcagcgcgcggcttggccgccggagtcttcttggcgaaggcggcgggggagggcgcgtgcggtttcggcatggaagcgggggacggagtcggcgccggcgtggccgcgctggcctcgggtgcgggtgtcgttgcctgctcttcgggcgcagcggtgtttacgggttcggtgacagtttcgtcggccatggccagctccttaaagcgtagaatgcataagcgggagcgtctcccatcccgggcgaaccaggaagttttgacgcaaccctcacctattatattgatttcgtggctaaaggtgcatcaatatcaggattcccggagtggctcccctccgaacgtgttgtggagcagcgtgttatcgatacgcttcgtaaggtttttgagctcaacggcttcatcggcattgagacgcgagcggtggaaaccggcgcttctttgctgaaaaaaggcgagaccagcaaggagatttacctgctgagccgtttgcaggaggtcggtcatgaatccgacactccgattgaagagcgtttgggcctgcatttcgatctgaccgtgccgctgagccggtatgtggtcgagcactcgggtgcgttggcgttcccgttcaagcgctggcagattcagaaggtgtggcgtggcgagcgtccgcaggaaggccgcttccgcgagttcgtgcaggccgacatcgacgtgatcggcgccggcgacctgcccgaccactatgaagtggaactgccgctggtcatggtctccgcactggaagagctgcgcgcgtatggcctccccaaggccaccgtgcacgccaataatcgcaagttgtctgaggggttctaccgtggccttggcctgacggacgtcgaaggcgtgctgcgcgagatcgacaagctcgacaagatcggtgccgatgaggtggcccgactgctcaccgagacctgcggcgccaccgaggcacaggcgcgcgcctgcctcgaattggccgagctcaccgcctccgacggtgccgagcttgccgctaagttcgatgcgctgtgcgaggctcacggcatcgtcaaggattccgaggcctacacgctggctcgtcagggactcgataccctggccatgatcgtcgacgaagccgccgccatccgccccggttccgtcatcgccgacctgaagatcgcccgcggtctcgactactacaccggttccgtctacgagaccttcctcgacggtgccgcatcactcggctccatctgctccggtggccgttacgacaatctcgcctcccagggcaaccgcaagtatccgggcgtgggcctgtccatcggcctgagccgactggtcagctacatgctgcacaccgccggcgctcacgccaaccgtgtcagcccggccgccgtgctggtcgctgtgtggaatgaagaggatcgcccggccgccaatcgtattgcgaaccaactgcgtgcgcgcggcatcgctactgacgtggcacccaccgcggccaagctcggcaagcagatcaagtacgcggacaaactcggcattccgtacgtgtggttcccggccaccgctgccgaaggtgcggaaggcgcagagcccgctggcgacgaggtcaagaacatcgtcacgggcgagcaggttgccgccgattgcacgtcgtgggagccggatactgtggttgcccagcaaaccgtcgaaatctgacgtattcgcgcgaaaaatcgaggagaaacaagacaatgagccagacggcttacagaacacatcatgccactgaagtgaccgaggccctggtcggccagaaggtcaccctcgccggttgggttgaccgacgccgtgatcacggtggcgtggccttcatcgaccttcgtgattcgaccggcctcgtgcaggtcgtcatttacgacgaggatatggcccgcccgctgcgcagcgaattcgtgattcagattaccggcgaagtgcgcctgcgcccggatggcaacgagaacacccatctggcaaccggcaagatcgaggttgtggccgagaccatcgagatcctcgccaagtccgacgccctgccgttccaggtttccaccgctcttgagaatgagtccgagaacaagctgcctggcgaggacgtgcgtctgaagtaccgttaccttgacctgcgccgcccgtccatgcagcacaatctgaagctgcgttccgacatggctaaggccgcccgccacgcgctggaagacatggacttcaccgaggtcgagaccccgaccttcattaagtccaccccggaaggcgcccgcgacttcgtggtgccggcccgtctggtgcccggttcctggtacgccctgccgcagtccccgcagctcctcaagcagctgctcatggtctccggtgtcgagcgttactaccagctcgcccgctgctaccgtgatgaggacttccgcgccgaccgtcagcccgagttcactcagctcgatatggagatggcctacgtggaccaggaagatgtgatggccatgactgagaaggtcatcgccgccatctggaagtccgccggctatgaggtccagctgccgctgccgcgcatcacctggaaggatgcgatggacaagtacggctccgacaagccggacctgcgcttcggcaacccgctggtggagctgaccgaatacttcaagaacacgccgttccgcgtgttccaggccccgtacgtgggtgccgtggtcttcaagggcggtgccgccacgccgcgtcgtcagttcgacgcttggcaggattgggctcgtcagcgtggagccaagggccttgcttacgtggtcttcggcgaaaacggcgagctcaagggccccgtcgccaagaacctatccgatgaggagcgcaacggcctacgcgaggccgtcggtgccgaggaaggcgacgccgtgttcttcgccgccggttcccgcgagtcagcccagctgctgctgggtgccgtgcgtgtggagctcgcctcccgcgaaggcctgctggatccgaagaagttcgctttcacttgggttgtggacttcccgctgttcaagcccaccgacgatccggatgatgacgatgtggctgtcggccactccaagtggacctccatgcaccacccgttcaccatgccttccaaggattggatcgacaagttcgacaaggatcccgagcacgccatgtccgactcctacgacatcgtctgcaacggtgaggagatgggcggcggttccgtacgtatccaccgcgacgacatccaagcccgtgtgctcgatgtgctgggcatcaccaaggaagaggccgacgagaagttcggcttcctgcttgaggcattcaagtacggcgctccgcctcacgcgggtctggccctcggttgggaccgcaccgtgtccatcctggccggtgcagactccatccgcgacgtcatcgccttcccgaaggccggcggcggccgcgacccgctgaccggtgctccggccccgatttccgacgagcagcgcgccgagactggcgtcgactacgacccggacgccgacgaaaactaatctacggagcgtataccgcttttcctcagcactcgacgtacttcagtgcgccttcggcttcggacggcggtctccgcacgcgtagattaattttcgaggagtaatgctccggtgctattagccgcaaatggcccttggaataattccaagggccatttgctttttgcgggtggggcccaatgtgccaaatacctgccaaggggtgccaaatactccgcccgatggcacctccgccatgcggcaaacctcgcaccatgcggtgtcccccttggcgtttgccgattatccttccatggggcggtaacttcctcatggggcggtaaacaacccatggggcggtgaaaaccccatggggcggtaggtcaaaatggcttaattccgcggtttcacaatttcttcaaaccgccccatgggcaaattaccgccccatgaggagcgatcgcaactccgtatttgatcaatgttgtgatgctttgttgtgttttgcttgtttccgcctcctgtattcccctttgcgcgcattgatggtaaggctgccgtctattaatacccggcatgaaggttgaggacggccaggaagcggtatttgcatcgcggtggcaacctcttgtgcgaaggcacgttgtttggcggtgttccacaggtcatcggcgaacacctcgatgacggtccagcccaattgccgcagacgtcgacgtttttgctggtcccgcacatattgtttgcggaagcgacggtgatgatcgccatcatattcaatagcgactttgtattgtggataagccatgtcaacggtgtaggtgtatccgttctctgaatcggtaatgccatattgtgtttgcggtatgggcaggccgaaaagcataagcgccaagcgtgtacgagtttcctgaacggaatccgatggttttacgagcttcagcgccgcctcacaacgcgcacggccaataacgcggtgaaaggccgttagtcgttgagtgaattgttcaatggcatatccataacgtctgatgagcgcttcagccagcaccactaattcagtgaggttgagatattgggcaaactgtatccacgcatccatgggatgcatgcaggttacgccgtttgagaaagcgatactgttgaactttgcattccatatgcgatagtcgacattgtccaatgaagagcgggtccccttgctcctcaccgtcacataaaaatccttctgcggcaacgtgctgtgcctcggcaactccacgccgcataattccaatgcggtatacagcgagaaacacaacgtgcgtttcgtgcgcactttgcccagcagattccaacaggccgtgttcttggccgtggctttggcgtcaagatctttgcgcagatagttgttgatttcgccattgtgcggcacttcgctgtatccgttcatgcgccgagcgtagcgcattccacggtggcacaggggcaaaaccgaaaaatggggataacttaagcggcgcgaaccggttatccaccggcatatcgtgtgccgcgcccggttatccaccgcgcttcgggagtgtcgtccaccgtataacagcactcatcgtgtgcgaacagctagccacgctcaaaatgcctagcgcatttatacgaatacgacatgggaaacggcgagaccagccccacacaatacaaagtgaccgccagccatgcgcccgactgcggcatacacggcagcaacgccaacgacaccaaggccaaacatggaatcagcagataggacaacacgtgcccgctttgccgtcgcagcaacgtctcagccaccacgcagcaggcaatcagcgcacagcagacgccgagcgatgcgcgactcagcgagaatgtatgccgatgcccaatgccgccttcacgatgtctgatgcggaaatgagacatcgactgagcaactgtgtggacatactgtgaacacgttggaaacgtcggtgtgctatcctcccactcatgtctgaaacgaacaatgaaacagcagtgcgttcgcgcgcgacaagcacaacatcaccgagcaaggccaaattgaccccgctggttcccggcaaagaggacccgaaccgtccgctagtcgaactgacccacgtcgaaaagcacttcggtgctttgcacgtcctcaaggacatcaacctgaccgtcgccaagggtgaggtgctggtggtcgtgggcccgtccggctcaggcaagtccacgatgtgccgcaccatcaatcgcctcgagaccatcgattccggcgacatccgcatcgacggcaagcccctgccacaggaaggcaaggagctcgcgaacctcagggccgaagttggcatggtattccagtcgttcaacctgttcgccaacaaaaccattcttgaaaacgtgacgttggccctcatcaaggtgcgtcacatggacaagaaggaagccgagcaactggccatggacctgctcgcccgcgtgggcgtcgactcccaagccagcaagatgccctcccagctctccggcggccagcagcagcgtgtggccatcgcccgcgcgctcgccatgcgccccaaggtcatgctgttcgacgagcccacttccgcactcgacccggaaatggtcaacgaagtgctcgacgtgatggtcgaactcgcgcatgaaggcatgacgatgatctgcgtgacccacgagatgggtttcgcgcgcaaggccgccgaccgcatcgtcttcatgtcggacggccagattctcgaagagaacacgcccgacgagttcttcgagcatccgcagaccgaccgtgccaaggacttcctctcgaagatcctcacccactgacgaacccactgaaagacgggtacgcaatccaatgacattcaccaatacgttcaaacggaaggcttgccgcgtgatcgccgcgctcgccgccgtggcctgcacaatgtcgctggcagcctgcggcgcggacgaaaccggcaagatccgcatcggcatcaaattcgaccagcctggcctgggcttcaagaagtccggcacctacgtgggcttcgacgtggacgtggccaaatacgtcgccaagaaactcggctattccgaagaccagatcatctggaaggaagccccctccaagcagcgtgaggccatgattcagaacggcgacgtggacatgatcctcgccacctactccatcaccgacgagcgcaagaaggccgtctccttcgctggcccgtacttcgtggccggacaggatctgctcgtgcgcaaggacgacaactccatcaacggccccgaagacctgaacggcaagcgcctatgctccgtcaccggttcgacctcggccgccaccgtcaaggagaagttcgcctccgaagtccagctcatggaacagcccggttacgccgaatgcgccaccgccctgttctccggcatcgtggacgcggtaaccaccgacgacatcatcctggccggcctggcctccgcctcgcgcggcaagctcaaggtggtcggcaaaccgttcacgcaggaatactacggcgtgggcatcaagaagggcgacacgcagctggccaccaaaatcaacaacgccatcgtggacatgattcaggacggctcgtgggagaacgccatcagcgataacaccaagggcaccaactacacgcccgacgtacgctacaacccgcccaccccggacgaaggagaggaggcctgatgagcggattcctggaactcttcagccagtatgacgtgctcggcgcgtttctggtcaatatcgaactgaccctatggtccgccctgttctccctgatcctcggcgtgatccttgtggtgatgcgcatctcgccgatttcctcgctcagggccgtggccggtgcgtatgtggaactgttcaagaacctgccgctgaccatcatcatggtgttcatggtgctgggtgcctacgcgcagctgaagctcagcttctccgacaccttcaccacgaacttcttctggctcgcggtcaccggcctgagcctgtacacggcggcgttcgtgtgcgaatctctgcgttcgggcatcaacaccgtgccgattggccaggccgaggccgcacgagcgctgggcttgggcttcatgcagtccgccaccgagatcattctgccgcaggccttccgaggctccgtggcaccgctcggcaacacgctgatcgccctgctcaagaactccaccgtggccgccgccgcatccgtggctaccgaaacatcctcgctgatgagcgagatgatcgaattccgtcccgacgtgatcatccagatcttcctgatcttcgcgctcggctacgtgatcctgatcatccccatcggcatgctcaccacgtacctgtccaacaaactcgccgtaaggaggtgacggatatggccgatacttcgaattccgtgctgttcgacgcgcccggtcccaagggccggcgcaccattcgcatcgtcaactggatcgcgggcattctgttcgcggtggtgctcgtgcttatcctcatgcgcctgcacaacccgccggacggcgagaaccagctcagctgggagctgtggaagcccgccgtcgaacgagaggcgtggaccgacttctacctgcccggactgtggatgaccatcaaggccaccatcgtggccgtggtgggtgccgtggtgttcggcttggtgttcggcgtgggccgactgctgccgaacccgttggtacgtggcgtctccgccgtgatcgtcgagttctgccgtgcggttcccgtgctgctgctcatgatcttcttctggcgatggttcgcgttcgcgggcctgcccagcccgtcctattgggccgtggtgctggccttggtgctgtacaacggttcggtggtcgccgaactggtgcgctccggcgtcggcaatctgccgggcggccagcgtgaggcctcgctcgctttgggcctgaccgaaacgcagtcgctgatggagatcgaggtgccgcaggccgtctacgccatgctgccggccgccgtcacccagctggtcgtggtgttgaaggataccgccctaggctcgatcatcatgtataccgacctgctgcaggaatcgcgccgactcggctcgatgtacttcaacatcctgcagacgctggtcatggccgcggtgatttacttcatcgcctgctggctgttgtcgaggctcgccgaatggctgccctcgcgcatgcagcagcgtacggccgcacccgccgaacccgagccgctggcgccgatcgccgccggcgacccgtccaatgtcaaccagatcgctgtggccaaggaggtcgaagagctgccgctgggcggtacgccgcgcaaataccatgtgcatcaccgtggcaccaacgcctcgattcgcaactggcggcgcacccgctacgaacagggatatgacgccacccagcccgagtcacaggttgacccggaaaccggcgaattccaggagtctcaaaagcctgaggacaagccagaggcctgacagtcagctcaatcgccgctaagccggcacgaagaatttactgagtgtttgactgggctccggctacgtagccttcacggaggataggttggaacatatgaagatgttccggcacctatcctccgtttttgctattgcgaccattgcgccgctggcgttggcggccacgctagccgtgacgcctgcaatcgcacaggccgaccagctgcccaacccggattgggtggcattgctctccgactacgaaaagaactattggcaggcccccaccgatgccgaacacggtggcaaggtgctcgacgccgatacaatgaaactcgacgaagatttggccgtggcaattaaccacaaagccgccgaaaatctcgataaggatggcctgaacgcccaacgcaagcgtgcgctcgtcgactccgatctgcaagccgaggaagccatgccggacgcgctcggtccggtgcttggcaaatatatgagcgaagggctcaaatccgggaaactcaacgccgtcgccgatatcttctcctttaacgtggcctccacctacgcctcaaaacgtgcggccatgcatccgcgcccctatctgaaccgtgcggaaagcagctacggcggcactaacgatctcgccggactgcccgccacgcttgacatcaagcaatcaccctcatggctcgaacacgtgcccggctactcgaacttgcagaaaaacagttcctacccctccggccacactaccggcgcctattcgtggggtatcgcgctggccggcatgattcccgaactcgcgccgcaaatcatggcccgcacttcggaggccggcaacaaccgcatcgtgctcggcgtgcattatccgcttgacatcatgggcgggcgcattggcgcatccgcccagaacgggcagtactggcataacgaattcgcttcgtccatcgtgcccgcgtcccggcagctgcgcgactatctggtgtcccgctgcgccgcggacggccacggcactaccctcgccgcctgcatcgccaacaccaaggcctccggttcgggcggctacaccaacgattttctggacccagtggccaccgagccggtcgcggaccaggcctcggccgtgcgcgtctacaccgcacgcctgacctacaccttcccgcaagacaccgcccagtccggcgctgatttcgtggcaccgcgcggggcggcggacgtgctgcgactggcctatcccgaactgcacgccgatcagcgcaacgcgattttgaaagccactgccttggattccggataccccctatggcaatcgagcgacggctggcagcgtatcaactgggccaaagccctgtgcgcccgcgtcaccttggataagcacggcgatgtggccaaggtcgagaccgccgaccaagtggcgcttaccggcccgagtgtggtcaatgcccagtacaccgacgcgggcaatcacccggcgtcggatagctcggcgggtgaaaacagtgccattgcggccggaccggatctcgccaccctccatgccgcgcaacgaccggcgttgatcagcgtagctatcggtaccgctgtaatcgcgattgtcggcggaatacggacggttcgacgcaaatccaagaaccagcttcagcagtaattcagccaaagttcagtcgcgctgctcaccgctgcggtgacactgagcagcatcgccctgatcggcgtgcccgctgcgactgcggacgagcagcagaccactgccgaacagaacacggctgccaaaccatccgtaatcatcaacgaggtctatgccggcaatacgaaagctgccggagacccggatagcaagcgttgcgattgggtcgagctcaagaacaccggctccacagacgttgacgtgaaggtctgggcatctacggcagtgacaagaaagccaagaagcactacaccatcggcaccagcgaagtaacgaatacggacaccgtcatcaaagccggcggatatctggtggcatacatcgaccccgacaaggcaaagcctgccaaaacctgcgatgccgctgccgatatgaaagtctcctcgatcaagagcgacaatctgatagtcacgattctggccacttcgaattgtgatgataagaacgcatccacgaaattcaatgattcggccacccgactcacgttgcaggacagcgacgataatgtcgtggccgatgccgtgttcgatttttcgggtctattccacgtataccgcgcagctgtccagcaagcgcaagggtatggaggctgaaggcaagacctggaactaccgcgatattcttgcgcaattcatcacgatgcacaacaagaattcaaacgtactgcttatctggtcgggtgactggcccgcctacagcagcaattccgacaaatactatgtgattcttgccggtgagggcttcgactcgacagatgaggcttggaattggtgcaaagccaacaattacggtccgaacgactgcatgcctatagatttgcagtaacaggcgaaatgtgaatgtcgctacgttgctaggtctcctgagttacaagacgtacaatcgggagcatggccaaggacgacgacagaaccaacgagcctgaagaggccggcaagtggggtacggccggaaaatcctcaggaaagaacaacaagaacggcaagggaaaggaatacaaaaccgatcgacggatcgacaaggtattacagctcgcggcggatcgcatagacaccatcgactccagtgccagcgtgcctgaacgactggcacgtgcggcgaaatccagtgaactgctcagcgccgtatggtcgttgccgcccgctcaacgtcttatgttccaccacggcatgcaggtcactgatgtcgaaggcgattccactcccggattcgacggcaataaagaggacgccgaggagttcatttcgatcagctcctccgaaatcgcccgataccagcggctcatgtacgcgaatggcgtcaaaggctcgacacggcggctgctcatcgtgctgcaaggcatggatgcctccggcaagggcggcatcgtgcgtcacgtgttcagccaaggtgacccgatgggcatccattaccatggcttcggcaagcctgcggccgaggagctcgaccacgacttcctctggcgcgtgaagcgtgaagtgcccaaggcggggtggattgccgtattcgaccgttcccattatgaagatgtggtcatgccgcacgtctatggcacctatcccgaagacgtatggcgtgcccgctacgaccagatcaacgatttcgaacgtgaactggccgccagcggatgcgccatcctcaagatcttcctcgtggtaagccaggaagaacagaaaaaacacttcctcgggagactggacgatcccaccaagttctggaaattcgacatctccgatctcgaggcccgcgaccgctgggatgagtatatggccgcatggcaggaggtgttcgagaaaaccagcacggccgccgcaccttggtacctcgtaccggccgataaccgctggtattcgcgagcagtggtctccgaactgctgcgcaccaccttgaagaacatgaacatgacctggccgcccctcgaacccgaggtggaccccgacgaggtgcgccgccggttggcgtgagcgatcctcccactggcggagccaagcgcatggcacggctcttcgcacggctccgcccgctggcgggaggcgtcgcatagcgacggagggtggctcgtgccgccggaataggccactgggtagactgagcattatgactgacgagaaggaatacggatccctggggcggctggcccccgaatgggacggtgacgagcgtgaacggaatcttacggccgatgacatctacgaacgattcttcggctgggtggaagacgtcaagggcatcgagccgtggccgcatcaggaagaggccattatggacctcttggccggcgaccatgtgattttgaataccccgaccggttcgggcaaatcgctggtggcgctcggcatgcacttcgccgccctgtgcactggccgccgctcctattacaccgctccgatcaaggcgctggtgtcggagaaattcttcgacttggtcgaagtgttcggccgcgacaacgtcggcatgatcaccggcgacagccacatcaacgcggacgcgccgatcatctgctgcaccgccgaaatcctcgccaatcaggctttgcgcgaaggcacccatgccgacgtgggcctcgtggcgatggacgaattccattattacggtgatccggagcgcggttgggcgtggcaggtgccactgctcacgctgccgcagacccagttcctgctgatgagcgccacgctcggcaatgtggacgccattgccgacaagctctccgatctgaacgacaccccggacgtggatgtaatcgccgacgcgccgcgaccggtgccgttaagctacgaatacacgctcgatccgatggaaaaaaccgtggaactcgccttccgcaacggcgaaaccccgatttacgtggtccacttttcgcaggacgccgcattggagaccgcgcaagcgctcgcctccaccggtgtatccagcaaggaacagcgccaagccatcgcagaagccatcaaaggcgtcaagttcaccacagccttcggcaagattctgcagcgactgctgcgcaccggtgtcggcatccatcatgccggcatgctgcctcgctaccgccgcctggtcgaacagctcgcccagcagggtctgctgccggtgatttgcggcaccgatacattgggcgtcggcatcaatgtgccgattcactccgtggtgctcacggccctgaccaagttcgacggcaccaagatgcgccgcctgcgcgcccgcgaattccaccagattgccggacgagctggccgtatgggattcgataccgagggactggtgatcgccgaggctcccgaatacgaaatcgaaaaccagaaagccatcgccaaggccgggggagacccgaagaagctcaagaaggtcaagcgcaagaaggcgccggaaggttttgtgacctggaaccagagcacgtttgacaagctcatcgacgccgaaccggaaaccctggtcccgcacctgaaaatcacgcattcgatggtgctcaacgaagtggcgcagggcggcgacgcccgtgcccgtatcgacgatctcatcgacgattccgcgcagacccccgaccaaaaggagcatctgcaccagcgggccgacgagatcttccaaaccctgttcgataccgaagtcatcgaaaccgaggaccgcaaggacggcggcaaggactactacatgacccttgatatgccggacgacttcgccctcgaccagccgctctccccgttcctgctggccgcgctcgaactgctcgaccccgagtccgacacctatgcgctggacgtgatttccatggccgaggccacgctcgaagaccccaagcaggtgctgcgtgcccaggagcgtcaggcccgagacaaggcgatggccgatatgaaggctgacggactcgactatgacgagcgtatggataagctgcaggagattacgtatccgaagccgctggaagacatgctcgaatccgcgttcgaccagtaccgccacgatgtgccgtgggccaacgactactggctatcgccgaaatccgtggtgcgcgacatggtggaaaccgcctccgacttcaccggatacatcacccgatacaacatcgcccgctccgaaggtaccctgttgcgctacctctcggacgcctaccgcacgctggcgcgtaccgtgccgcccgaaaagcgtgacgagcaactcgaagacatcatctcctggctgcgcgtgctcgtgcgctccatcgactcctcgctggtggatgaatgggagaacgccggcgattccgccgaccagtccgaggcggcggcctccttggcggcgccgggcaagaagaacgcggtggtcgaggaccgacgaggccttatcgtgctgatcagaaacgccatgttccgccgtgtgcagcttatggacctcgaccagccggacaagctcggcgcgctcgacaaagactggggctacggtgtgcacgaatgggaagatgtgctcgacgactactacgacgagcacgagtacgtgggcatcggcgccgaagcgcgctcgcccgaactgttcatgttggatgacaagcacgagaacgacgagcatacgtggaaggtgcgtcagattatcgatgattccgatggcgatcacgattgggccatcgaaggcatcgtggacctcgacgccacccaagacaccggcgaagtagtcttccacgactacaaggtgagtaactgattcctttcttggctcccctctctgagggaagccagggtgcagctcgaacgtctgttcgaacactggggtactataggacgttatgagtgagaacgatttgtttggggcggctgatgcgccggagtcgatgacacggccgttggcggtgcgcatgcgtccacgcactttggacgaggtgattggccaaacgcaggtgttgggccagggctcgccgctgcgccgcctcgccaatccggccagcaaaggcagtctcaccgcgccgagctccgtaatcctgttcggccctccaggcgtcggcaaaaccacgctcgccaccatcgtggccggccaatccggccgcgtgtttgaggaactctccgccgtgacatccggcgtcaaagacgtgcgcgacgtactcacccgcgctcacgaacggctcgtgtcacgcggccaggaaaccgtactgttcatcgacgaggtgcatcgcttctccaaatcccagcaggatgcgctgcttcccgccgtcgaaaaccgcgacgtgacctttatcggcgccaccaccgagaacccgagcttttccatcatcaaaccgttgctctcccgttcggtggtcgtcaagcttgagtcattggagcctgatcagctcaccgaactggtgcagcgcgcgctgactgatgaccgcggtctcaagggcgaggtcaaagccacggacgaagccatcgccgatatcgtgcgcatggccggtggcgacgcacgcaagagtctcacgattctggaggccgcggctggcgcggtcaccggcgacgaagcccgcaaaaagggcgcacgccgacccatcatcacccccgaaatcgtggctacggtaatggacaccgccaccgtgcgctacgacaaagacggcgatgaccattacgacgtgatttccgcattcatcaaatccatgcggggctccgatccggatgccgccatccattatctggcgcgcatgctgaaagcgggtgaagatccgcgcttcatcgcccgtcgcatcatgatcgccgccagcgaggaagtcggcatggccgccccgcagattttgcaggtcaccgtggccgcggcgcaggccgtggcgctggtcggcatgcccgaggcacgtattattttggccgaagccacgattgccgtggccaccgcgcccaaatcaaacgccagctataacgccatcaaccaggcgctcgcggacgtggatgccggcaagatcggcgctgttccgctgtatttgaggaacgcccccaccaagcttatgaaagagtggggcaaccacgagggctacaagtatgcgcacgattggcccggtgccgtggcgccacaggaatatatgcccgaagagctgcgtggcaccgagtactaccatcccaacgatcgcggctacgaacacgaagtcagccagcgtcttgccaagattcgcccgatactgcatggtggggaacccgaacagaaatgaacataggggagtaaagtgtaacgcaacaataacagtggaaaaaggggaggcaaacaccatggcgaccatcttcatcgtggacgatgatcaggccatcggcgaaatgcttagtcttgttttggaaaacgagggattccagaccgtgacctgcctggacgggctgagggctgtggaaatgttccccatcgtcaagcccgatttgattctgcttgacgttatgctccccgggctggacggcacggaggtggcccgccgcatcagagctacctctaatgtgccgattatcatgctcaccgccaaatcagacacacttgacgtcgtggccggcttggaagccggtgccgacgactacgtgcccaagcccttcaaagtagccgaactgctggcgcgtatccgtgcacgcttccgcatcgccaagccggccgccgaagacggtgccaccggtggcgcaagcggtggcaatgcaaacgtcaaccatctggaacgcggatccatcgtcatcgaccgtttggaacacaccgccaccaaggatggcaaggacctgaatcttactccgatggaattcgagctgctgttcatgcttgcggccgccgccggcgaggccatcagtcgttccagcctgctcaagaatgtctggggatacgagaattccggcgatacgcgcctggtcaatgtgcatgttcaacgccttagggccaaagtggaggacgaccccgagaacccgcaaatcgtgcagaccgtacgcggtatcggctacaagttcgtcactcctgaacaatgaacctgcgccctcgattcagcctcaaacgcttgctgcgccacggacgcgctgaagttcgtcgctcactgcaggcccgcaccgtggccctcaccgtgattcttacgctggccgtggccatcgtcttctctggcgtatcgatggtatcagtgcgcgcctcgctgcttacccaaatcacttcgcagtcgcgtgccgactattcaaacatggtgcagcaggcccaaaccagtctggacgcggccgatgtctccgccgcagtgcagatccaacagctggtcaatgacttggcgtcctcgttgcaatccgaggggccctccaacctgataggtgtgtatttgtggagtcgtgataccaactcgcgtgccatcatccccgtatccaccgaacccagctatcaaagtctgatttctgatgacatccgttcgtccgtggcctccgacttggatgacagcgtgttctatcagccggtcgaaattcccggtgattccggcatgtcgggcagcgggacgcccgcagcggtgctcggcaccgtattggactttggcgtggccggcaacctcgaattcttcgccatttattcgtacacgttccagcagcagtccttgacgcagattcagctcagtctggtggtcatctgtgcgttgctgtccatcgtggtgggcgtagtaatctggctggtgattcgtggcatcgtgcgcccgattgaacgagtggcagcggcctcggaaacactggcctccggcaatctcgatatgcgcgttaccgtgaatcgtaaggatgagcttggtgtgctgcagcaatccttcaatacgatggctgatgcgctcaaccagaagattgatgagctggaggaagcaagcgttttccagaaacgatttgtgtccgacgtcagtcatgaattgcgcaccccggtgaccaccatgcgtatggcttccgacctgctcgaaatgaaaaaagacggcttcgacccctccaccaagcgtacggtcgaactgttggccggccagatcagtcgattccaagacatgctcgtcgatctgttggaaatctcccgctacgatgccggttatgcggcacttgaccttgtggaaaccgatttatgcgaaccaattgaaacggcagtggaccaagttgccggcatcgcccaagccaaacgggtgccgattcacacgtatctgcccaatgtgcaggttttgactcgtatcgattcgcgtcgagtgattcgcatcgtcagaaatctgttggccaatgccgtcgatttcgctgaggaccggccgatcgaagtgcgtgtcgcggccaaccgcaaagccgtggccatcagcgttcgcgactatggcgttggtatcgacgaagacaaagtcgctcatgtattcgatcgattctggagaagcgacccttcacgttcgcgcgttaccggcggcaccggattgggcttggccatcgccatgactgatgccttgctgcaccacggtactatccgtgtacgttcggcagtgggggagggcacctggttcttggtattgctgccgcgtgaccccgaccaaggtgaggtggcggacgctgaactgccggtgaattttgcttctgaaacgcccgatgacctgcgtattaccggtgggtttggtgtggccaccagccaagtcacacatgattatcatgaggttcgccgcgacacgatgatggggaggccgctatgagacgagtgaccagaacgattgccgccgcaggcgcggccatagtctgttgcgtcacgatgacggcatgctcaagtccgttcggtttgccgattagcggctcggtgcagactctggcaccggtggaacagcagactcagcgtgtttacaccaatcctcagggacctgcggacgatgcgcagccggaaaccatcgtcaaagggttctatgatgccatgcctgccggcgtacagtccgatggctaccgtgtggcccgtgagtttctgaccggttcggcgtcggccggatggaatggcgattcctcggcactggtctacagcggtacgccggatttccgccgccgtgccaatacgatgagtaccccgcaaggggcggagagctcgctgattgtagaagtacagctccaagtggtcggctctctggactcgcatggcgtgtatacgccgacagatagcagcacgatcagcaaagttccttatatcttgattaaaagaagcggccagtggcgcatctcctcgttggagaacggcgtggtgatatccaccgccgattttgaacaagtcttccgccaagtatccgtgtatcaggtgagcacatccggcaaacagctcataccggatgttcgatggctgagctggcgcaactggcgcacccaggcagtcggtgaagtactctcggatgcaccctcctggttggaaggagtgctgcgaggcaccggcttgcctaccatcaaactcgcggtcgacagcgtgccggtgaagaacaatgtggtggagatacaccttaacagcggtatcaatgcgttgaatgaggaagaacgaggcctgctggtacatcgcatccgtctgactatgggcgacggcaatgccgaatacgcgctgaagattaccggcgacggagtggactattctgatgccgacgcaaatgtgaaacttactaccgagcagccgacagcgggcgtatacacgttgaccggtgggcatatcgtttccctggccagctccagtccgttgcgtgtaggggaggcccccggatatgacgatgctcggggcttcgttttttcctcatccggcggtgcggtgttgcgtgcggacggtgtcgtcgaatgcctgaaatctgatggtgcgtcctgtggggtgatgttctccggcgagtcgatgcgatcgattaccgaaggtctggatggcgaagtatgggctgtatccgagaacgggcgcgaattgcatgtgtcagatgggggtaaggaaaccgatctgaagcttgattggcttggcgctgccgacagcattgtggcattggcggtttctccggaagggtgccgattggcgttggcagtcgagggcgaggacacgaacggcgtgatgatgaccggtgtggcgcgcaacggtgataaaacactgagcggtctgagcaaagcggccacccaagtgagtgtgctcagacacgtcaccatgctcacgttctacaacgatctgaatctggtgtacgccaccacacctcctgagggaaacagcgaacaacaagaggcatggcgtcaaatggcaccaggcccggccaatgcgcagcgtctgcctaatggaaccataacgtcgatggcatcggggcagattagcctgtcccgtcgcctggccattgtggacgatttgggtattgttcgctccgtttctggctcactcgacggttcctggaccatcgccgatagccaggtcactgccctcggtgcgcagtagatggtataagaaaaacggtgttcataataacctttcttgttgtatgaggcaacggctttgtcgctcggctggcgagcggcattgccgctgcgcaaccaatcactattattggtctgttatcaaggcaaaacagtgttgcgacgccatttttgaaccactgttattaatttgttataaacctgttatcaaactgttatcgcatgcgattgaacatttggcctgtgagcgtcacactagagattgtcgatgacgaacagtcaccaaacaggatgaaagatcatccaaaaaataaacactgctcgaggaggagtatttatgaagaattggaagaaggccattgccctcgttgcttctgctgctgcgcttgtcagcgttgccgcatgcggttccagcaacgcaggtggcagctcggactccggcaagaagacggttggcttcgttgctgtgggccctgagggcggcttccgtaccgccaacgagaaggacattcagcaggcattcgaggatgccggctttgacctgacctactctccgacccagaacaacgatcagcagaagcagattcaggcgttcaacaagttcgttaacgacgaagtcgacgccatcatcctgtcctccaccgaggattccggttgggatgactccctgaagaaggccgctgaggctgagattccggtcttcaccgttgaccgtaacgtggacgtcaaggacgccgaggccaagaaggccatcgttgctcacatcggaccgtccaacgtctggtgcggcgagcaggctgccgagttcgtgaacaagaacttcccggatggcgccaacggcttcatcctcgaaggccctgccggcctgtccgtggtgaaggatcgtggcactggttggggcaacaaggttgcctccaacgtcaaggttcttgagtcccagtccgctaactggtccactgatgaggccaagaccgtgaccgctggtctgctcgacaagtacaagtccgacaacccgcagttcatcttcgctcagaacgacgagatgggcctcggtgccgctcaggctgttgacgccgccggcctcaagggcaaggtcaagatcatcaccatcgacggtaccaagaacgctctgcaggctcttgttgatggtgacctctcctacgtgatcgagtacaacccgattttcggcaaggaaaccgctcaggccgtcaaggactacctggatggcaagaccgttgagaaggacatcgagatcgagtccaagaccttcgacgccgcctccgccaaggaagctctggacaacaacacccgcgcctactgataagtctgctgcgactcattgataactgaaccaaataattgatgtgatggtgtgagaaggatgttccttccacaccatcactcatgtgtggctcaaatatcacaaaacgataacacttcattctcgtttaaggcaaagacatgacagataaaaaccccatcgtcgtaatgaaaggcattacgattgaattcccgggcgtcaaggccttggatggtgttgatttgactctctacccgggcgaagttcacgccctgatgggtgagaacggtgcaggcaagtccaccatgattaaggctctgaccggtgtgtacaagatcaacgccggctccattatggtggacggcaagcctcagcagttcaacggcaccctcgacgcacaaaacgccggtatcgccaccgtgtatcaggaagtgaacctgtgcaccaacctttccgtcggtgagaacgtgatgctgggccacgaaaagcgcggccccttcggcatcgactggaagaagacccacgaggccgccaagaagtatttggcacagatgggcctcgaatccattgacccgcacactccgctgagctccatctccatcgctatgcagcagctggtcgccatcgcccgcgctatggttatcaacgccaaggtgctgattctcgatgagccgacctcttcgctggatgccaacgaggtcagggacctgttcgcgatcatgcgcaaggtgcgtgactcgggcgtggccatcctcttcgtctcccacttcctcgatcagatttatgagattaccgatcgtctgaccattctgcgtaacggccagttcatcaaggaggtcatgaccaaggacaccccgcgcgacgaactcatcggcatgatgattggtaagtccgccgccgagctgtcccagattggtgccaagaaggctcgccgtgaaatcacccccggcgagaagccgatcgtcgatgtcaagggcctcggcaagaagggcaccatcaacccggttgatgttgacatctacaagggtgaggtcgttggcttcgctggcctgctgggctccggtcgtaccgagcttggtcgactcctgtatggtgccgacaagccggattcgggtacctacacgctcaacggcaagaaggtcaacatctccgatccgtacacggctttgaagaacaagatcgcgtactccaccgaaaaccgtcgtgatgagggcatcatcggcgacctgaccgtccgccagaacatccttatcgccctgcaggcaacgcgcggtatgttcaagccgattcccaagaaggaagcggacgccatcgttgacaagtacatgaaggaactcaacgttcgtcccgccgacccggatcgcccggtcaagaatctctccggcggcaaccagcagaaggtgctcattggccgttggctggccacgcaccccgagctgctgattctggacgagccgacccgtggtatcgatatcggtgccaaggctgaaattcagcaggtcgtgcttgacctggcttctcagggcatgggcgttgtcttcatctcctccgagcttgaagaggtcgtgcgtctgtccgacgacatcgaggttctcaaggaccgccacaagatcgcagaaatcgaaaacgacgacaccgtctctcaggcgaccatcgtcgaaaccatcgctaacaccaacgtaaacaccggaaaggaggcatgagatggctgaaaaggcaaaagccgagggcaacaactttgtcaagaagctgctgagcagcaacctgacctggtcgatcgtcgcattcattcttctggtcatcatctgcaccatcttccagcatgacttcctggctctgagctggaacagcaacaccggtggtctggccggcccgctgatcaccatgctccaggaatctgcccgatacctgatgattgcaaccggtatgaccttggttatctccaccgccggtatcgacctttcggttggttccgttatggcagtggcaggtgccgccgccatgcagaccctgtccaatggcatgaacgtgtggctctccatcctcatcgccttggctgttggtctggccattggctgcgtcaacggcgctctggtttccttcctgggcctacagccgttcatcaccaccctgattatgatgctcgccggccgtggtatggccaaggtcatcacctccggtgagaacaccgacgcctccgcagttgctggcaacgaaccgctgaagtggttcgccaacggcttcattctgggcattcccgccaacttcgtcatcgccgttatcattgtgattctcgttggcctgctgtgccgcaagaccgctatgggcatgatgattgaggccgtgggcatcaaccaggaagcctcccgtatgaccggtatcaagccgaagaagatcctcttcctcgtctacgcgatttccggcttcctcgcggccatcgctggtctgttcgccaccgcatccgtgatgcgtgtcgacgtggttaagaccggtcaggacctcgaaatgtacgccattctggcagtcgtcatcggtggtacttcactgctgggtggtaagttctccctcgccggctctgctgtcggtgctgtaattatcgccatgatccgcaagaccatcatcaccctgggcgtcaacgccgaggcaactccggccttcttcgccgttgttgtgattgtgatctgcgtgatgcaggctccgaagattcacaacctgagcgcgaatatgaaacgcaagcgcgcgctcaaggctcaagctaaggcggtggcagcatgacaacagctacggcaaacaaagtgaaggctcccaagaagggcttcaagctcgatcgtcagatgatcccgaccctcgcggccgtggtgatcttcatcctgatgatcatcatgggtcaggcgttgttcggcacctacattcgactgggcttcatctcctccctgttcattgaccacgcctacctgattattctggctgtggccatgaccctgccgattctgaccggtggtatcgatttgtctgtcggtgctatcgtggccatcaccgcagtcgtcggcctgaagctggcgaacgccggcgtgcccgccttcctggtcatgatcatcatgctgctcatcggcgctgtgttcggcctgctggccggtaccttgatcgaggaattcaacatgcagccgttcatcgcgaccctgtcgacgatgttcctggcccgtggtcttgcctccatcatctccaccgactcgctgaccttcccgcagggcaatgacttctcgttcatctccaacgtgatcaagatcatcgacaatccgaagatctccaacgatctgtccttcaacgtcggcgtgatcatcgcactggtggttgtggtcttcggctacgtcttcctgcaccatacccgcaccggacgcaccatctacgccatcggcggctcccgttcctccgcggaactcatgggtctgccggtcaagcgcacgcagtacatcatctacttgacctctgcgactctcgccgccctggcctcgatcgtgtacaccgcaaacatcggctctgccaagaacaccgtgggtgttggctgggagctcgacgccgttgcctccgtggtcatcggcggtacgatcatcaccggtggcttcggctacgtgctcggctccgtgctcggctctctggtccgctccatcctcgatccgctcacctctgacttcggtgtgccggccgaatggaccaccatcgttatcggtctcatgatcctcgtcttcgttgtgcttcagcgcgcggtgatggcggtcggcggagataaaaaatagcgggcttgcccgctcggtctccgcaccgaatacgacacacaccataactgaataggcgggattagcccggctgctgtgatggcaaggtcacagcagccggcactgcccgccaaagctttctttctccttttcttcctttcattagcgtgtggggcgtgccccggggttctcccggggcacgccccacacgtgtttggaaagctgggactctattgatgatcggatttatgcacgcttacgtgccgcgcgaatgcggaacgcggtggccagacagcaccagccaatcaggcagataaccgtcatcgtggcaaacgtccatgtgccgccgacggcagtggcgtgagcaaactcagcggtgccttcttctcctgcgccggcctgagccacggaaagaatcgtggagaacagtgcggtaccggcagcgccgccaaactgaagacacgtgttgaaaatggcgttgccgtccggcttgaactcgggagagacctccgacaggccactggtcatcacattcgcattgccgatggaatagaacagaccgaaaatgaaatagaatccggcgagcagcaagggcgtaagctgcatcgagaacaccagcataagcactgggcccaaaatagcgatgccgatcggaatcagaatcggcttgaccgcgccgaacttatcgtagaaccagccgccaagcggggcacagacagcgccgaccagtgctccgggcagtaccagagagccggccacaaatgccgtggtaccgagcgagagctgtgccacattggtgatgacatagccgtagccgatggcgaccaatggcagcagcagatatgcgcaggcgtgtaacagtacggcgggatccttgagaatgccaaggcgcagcagcggggagaaggcacgcttggaactcatggcgaacacgatcaacaaggcgaggcccgcaatcagactgacaatggcgataatgccggagcgtgtggctgacttgccggacaccgccgcactgatggccacgccaccttggttgagcgccagcaccagaccgaccaacgcgacaacaatggacccaagctgaatcgggtcaagataggcagcctcggtcggtgtcttctgctcaatgcacttcatgccgatgcatgctgcgattagcaccagcggaatggcgatgacgaaaatcgcgcgccacggcagcactgtggtcaccgcgccgccgacggtcgggccgatggccggagccacggtaatgaccagcgatcctacgcccatcaatcggccgattttcgaacgaggagactgctccaggatgatgttgatcatcaacggcgtggccacgcctgagccaatgccctgaataatgcgggcgacaatcagcagcgggaaggcttgggcgacgatcatgatcagcgagccaacgatggccagaatcacagccgcaagaaaaatggttttcagcgcgaatcggcgcttcaaaaacgagctgatgggcatggtagcggccaccgccaacagataaatcgtggtaatccattgcacagtggccgtgtcgacatggaattcgcgcatcagtgcggggaaaagcacggtcatcacggtttcggtcagaatgccaatgaaggcaagtgagccgacagccacaatcgcgccgataagacgtgtgggaatcttctcgttatcaatatgctgctcaggcatacatgctcctaaacgttcggttgcaaggtatggaatgtaaggtttaccaaccggcgtaggtacctgtgcgtgcggataaaccggcaaccgtactgccttggctgcacgctatggaatcacaaaaccacctgtgagtgtacggttcggggcggacgctacggtcgatgcgcaatgggttgtcccttggtttggtggggtttgatggggcggattcggcattggtccggtagcagttcggcattggttcagcatgaggaaaccgcgataatatctgccctgccgcctagtttggtgaaccatgggtattgagaacacgcataagctgattgtcaactgcctgccactcaacgaaggagaacggcgggctttcgccaaggcggctcgcgatgtgccgcaggaattcgtgggcgacgaagcgcaccgcggcgacatggtctggtcggccgctgttcccgaggagcttcgctcccgagctaccgcagtcatcggcaactttccggtctcgcaggcttcccaatacacccgtcttgaatggttgcagaccttcagcgccggtgtggatgcgtacatctgcccgggtgtgctgcctcgcggcaccatggtcaccaatgcgagcggcgcgtatggccaaagcgtgtcggaacacatgttcgccaccatgtgggcattgatgaagaacctcaaccggtatgcctccaatcagcgtgatcatcagtggcaggatgaaggaccggtattgagcccggaaggtggcatcgcgctgattatcggcgtcggtgacatcgggtcgcatttcgctcagcttgcccaatccgtaggtatgcgtactttcggcgtgcgccgtcatgcggacgtgccggccaagggcattgaaaagatgtatggcttcgagcggctggagacgctgttgccattggcagacgtggtggcgatggcggtgccgcgctcgccgcagacccatcatctgctgaatgcggatcgtctgggtcgtctgaaatccacagccatcgtgattaatgccgggcgtggcgacgccatcgatcccgaggccttggctgacgccttgcacaatggacggctccacggtgccggattggacgtcaccgagcctgagccgttgccggcggaaagtccgttgtgggatgagccgcattgcctgatcaccccgcatgtggccggcggcaatcatttggaaaagacttccgaacacatcatccgcatcgccctgaccaacgtttcccgctatgccaaacagcaggaactgttgaatctcgtgcgatactgattcgcctgtgtcgggcggcgggcggccatcgcctgacactgaatacagataaggggcgtataacaccgttgttatacgccccttatcgggcaatccgaaaaagatggttgatagtcagtaccaatcagtactggttcgcgccgataccctcgaacttcacgttgaagccacgctggtaatgcaggaacatgctggcgccatagcggtcgaccggacggtgcgtgaacagcatacgaatggcgaatgcggtctgcacgtccttaggcagcgccaggaatgcttggtgggcgtcccagtacgggtcgtacaccacggcggcaccgggcacgtaggcgtaaccgtagccatcctcgttgacgtatcccatgaacggcagatcccaggcgttgtgtttggtgagttgtgccttgaagtcctcgacctcggccaacgccgcgtcgctcaggccgaagctcttggccacttcattggccttggttgttttcgaatccgggtccttgccgaacatatccgggttgacgatgatgacttttccctccgccataatgtgttcctttcagcatggcgttccccaagcaagcgcctagggaagtactggcattgttcgattcacatatgaattgaacaacatgttaccttctctgtagaaaaggattgtgcactttgttgatgtgctggtttcaaagcctagcatgaaaaatggcggatataagccgttttgccggttattaatctattggtaatgcaattgggaagttatggtagtctgtgatgtctgatgttcatatcttgcaaaagtgaacatgataaatgtttgttttgagggtgaaagcaacaaagaaaacggccgtgtacatgaactcatgtacacggccggcgtgtcgcatcccgctgcgactgcggcatcgagatgatacctgcagaggcgtggttgatcaggggcccaatgaacgtggcccgaggttagtttcagtctgatagttcgtagccgttggcgtctttatgccacggtgagccgggcttgctgcacagaatgatgatgccttcaacaaagccccagatggcggctgcgattgggccaagtccgagcagaatccagccgacaagcgtcagcagcagctgggccacggccttgccggtgttgccgagatagaagttgtgcacaccaagtccgccgaggaagatgcccaacaggccggcagccagcttggacttggacgattgccccaccggggcggcggcatacggagcggcggtgtattgcggctgcgcgtaggcgttcggctgctggtaagcctgtccatagccgggctgctggccgtagcccgctgcgggctgtgcgggctggccgtactgcggctggccgtactgaggctgagcgtatgcgccggcgggctggccgtattgcggttgctgctggccgtagcttccggcggcgggttgagcgtatgcggcgggctgtggggcgccatagccctgcggctgctgtgcggcatcttggccgtaagacggttgtgccggctgtgcgggctgtgccggctgcggaacactgtccgaaccgtacggttgttgttgattatcagtcatgcgggtcagtcccctctcaatcgggaacggcaataccttcttaccgtttctgcacaacatcatctcatgttttgcccaatagtaaaacctgccgcgctacgattgggccatgagaagtttcctgaccagctggttgattatgactatcgccgccgccgtcatggtcgcggtgactcccggcatgaccccggtgggggagcctccgattctcggcatcgccgcgttcgctttgttcatggcgctgattaatgcgtcaatcaagccgattgtgcatctgatcgcactgccgtttgcgattctgtctctcgggctggtcaccttgattatcaattggctgttcatgcgactcgccagctggctggcggtcagtctgttcggcgtgggcgtcttcgtacacggtttctggtggtcggtactggggtccttggtcctgaccattgttgcgggaatcgtcgggtccatcttggatcagtgacggtgctcgctgggcgaatatgagtaatggcggttggaatcagtccgattccaaccgccattactcatatcaagctacgggatcgagcggggcgaacattactcgcgcaccaagcggatatgctccacatcgtcgcgccgggagcgacggaacagcacgaaacgattgccgatggactgcaccacttcggcgttcagctgctcggcaagctcggcggcggcttccttggcggtcaggccagaaccgtcctgcacggcgcacttgatgagctcgtgcttctcaatggtctcatcggcctgattgacggccgactcggtcaaatcgttcttgcccacatagaacaggggcttcagcgagttcgccatcgcgcgcagctgcttgatttgcttcttggtcaatgccatgggaatttccttacatctttcgtataaccacaccagcatagcaaccggtgctgtctgcgctgtttgccgccctacagcgcgatgatggccgcgatgtagatgatgacggcagcggcgaatatgagatctcgcgcggcgatggtcagggcacgccagtgagtgcggcggatgccctcctcgtagcagcgggcgtcaagtgcgaggctcaggttgtccgcgtgacgcaacgtgccggcgaaaatcggcacgataatcgcgctcatcgccttgatgcgctgggccagtgaaccggtttcgatggaaccgccacgcgcggattgggcgtcgacgatggcgcgggtttcgtcggtcagcgttggaatgaatcgcaatgccagactcatgaccagcgcgatttcttgggcatggataccgagccggttgagcggactgatcaaggtggcgaaggcgtcggtcatggcggtaggcgtggtggtagtgaggaacaccgcgcccagaatgattaccaatgcgaaacggcaggcgtacagcacggctatggtcacgccctgatcggtgatgcttagcgggccaagcgccaccaccggcgtgccggtgcgtaccacaaacagattgaccacgcccatcagcaccagcaggatcagaatcggatgaatggattcaagcacccgtaacgggttcaggcgtgccgccgcgataacggccagggtgatggcgatgcccagcgcgagctgggttggcgtgttcaccgcgaacatcgtgaacatggcggccaggaagcccaccatcttcacgcgcgggtcaagtcggtgtatcactgagtgcgcagggccgttggaggatacggccggctcggtgacggtggccgtgacggggccgccggatgcgggggcggcaatcggcatacggaccacgcggtcggcgatttgctcggcctcctcccggtcatgggtgatgatgagcacggtcacgccacgcgatttgagcgtgcgcaacagctcatggatacgcttcttggcttgggcgtccagactcgcggtcggctcgtccatgatgagcacgtcaggattgcaagccagcacgccggcaatggctgccaatcgttgttgcccgccggacaggtcgaagggggagcggtcggcaagatgcccgatatgcagcagttccagtgattcgcgcacgcggtcggctacctcggtctcgccaagcccttggttgcgtgggccgtacgccacgtcctcggctaccgtgtcagcgaacagctgatgctctggatgctgcatcacgtaacccacatgccggcgcaattgcgctaattgcttgcgattcgccgacttcgggcgcacgttgcgaccgcgcttgccggtcgaggccaccggaacaccggccacttcgatgctgccggcggtcggcgcagtcagtgcgcacaacatgcgcaccagcgtcgacttgcccgaaccattcacgcccatcagtgccacggtttcaccgcgcgcgatggtgaacgacaggtcatcgataaccgcccgtttggccgaaggatagcgataggtcagatgcgagacgcgaataatggggttcgtcatatcaccgatgccatcggagagcagcggcagttcggagccgtcttcgcgctcccgctggcgggggctgtcgttcgtagggcgactgggggcggcttctgtgccgatactaccctcagtctcgctttgcgagacagcctccgctagcggggatcgattatcgacggctgcagtgataccaatgattcgcccggcctccatgtgcacgatgcgatcggcatgaacggtttcatctggatgatgcgtgacatgcacaatagtggtgccgcgcgcctgcaaatcatccaaaatgcgcataacttcggcgcgtgcggattcgtccagcatggcggtcggctcatccaataccagcattgccgggttcatggccagcatgccggcgatggaggcgcgttgctgctgcccgccgctcatacgggtcgggtcggactggcgtaagttcgccaaccccacggcctgcaatgaatcaacgatacgctcgccgatgagctcgcgctccagcccgagattctccgggccaaaggccacgtcatcctccaacacggtggtgaccagctgatcctcgggattctggaacaccataccgatgccgtggcgggcagcacgataggcatcggcattcgggccggctgcgtacacgcgttgccccagtaacgtcacttcaccaccgtccggcgcggtcaatcccgcaatcagacgggctaacgtggatttgcccgacccgttcggaccgaccaagcataggcgctcgccggcatggaccgtgagtgaaacgccatccaaagcccatgaggtgccgcggtcatagctgaaacgaatgtccttgagcacggcggcgggggaggcaggctcggcggaagcgtgaggttcggcagaatcgtggaactcgtcggcgtcgaaggaatggggtgcaacggtcatgaaacagcaatccgtaactgataggcgaaaacgcagaatcccggcccgtgccgggattctgcgttctggttctttgagtggtctttgagtggtcgttagtcgtggcgggcatcggcccgtctcaggccagtcactgctgcttggacagcaggttggagatcggcttgtagatcaggaaggtgatcacggcgtgaatcgccatcttagccacgttgaacggcagcagaatcggcagaatcatcgcggccacagcttggtaggtcatgtgcgcgtaaatcggcgtgacaatcaggttgctcaccagcgccaccacgatggccagcaccgcacccaccagaatgccgatggcggcacccttgcgcgtacggatcttacggtagatgaacgcggccggcacagacaggaacagcgccaccagcacagccatcagcgaaccccacggattggcgaacatgtgcggcacaaagccgagcacagacacgattgcggcggcggccgggccatacgcaaagccggcaatcaggcagacgatgccggacgggtcgtacttcagccaagtgaccggcgtaatcgggaattcaatgaagctggtgaccatcgccagcgccacgaacagtgcatacatggcgatacggcgcgtggaccagcggccagaatcggccacaccagtggtgtgtgagccaagtttggcgctggtactggcggtggacgtgctggccgaaccctcggcctcgggtgccacagaacgaacaacttgcatgcgaatacgcgaagatacactcataatgagccctcgtttcttccatccggactataccgttggctccggaatctcaccggatcagccgcttgcgcgggtcgcgggcttcctgccatccccgttatgaaacccggggtgcaggttaccgccagtaaggaattgcaccttccctgaaactgacaggcttattcatacgccatgcgccggacgtatgcaacccgcgtttcactgtgcagaaattcgtcttgtgccggtcaagtgcaacaatgggagccatggctgaagtgaagaaacccaacaacaccatcgacaagcttgccctgatcgtcaccacctacaaacgtcagcagttgcttgagacactgttcgattcgattctggcgcttgaacaggcaccgtggcgcattgtcatcgtggacaatgagcagtccgatcagacggcggacatggtcgctgcgtttgccggcaaggtgaccggccaatggggcaccaccgtggccgaccagtccggtaacgaagaacgtgtggtctatgcgccgcagaccgagaacctgggtggtgcgggcggtttctccgccggcgtggccaaagcctacgagctgggtgccgcatggttctgggtgatggatgacgatgtggccgtgctgccggacgccattgccaagctgtccaagtggaccgacaagcacgaggtgattcagggctcccgattcgactacgatggcggcccgttctactggcagtacgacttcattgtgccgctgggcatcccgaacccgattgcgcccgccgcattcggcccggccggataccgagtgatggacacgctgtgcttcgaaggcggcctgttcaaccgccgtgtggttacggaaatcggtctgccggacccgcgcttcttcatctactgggatgacacgatgtatggctaccgcgccagcaaggtcaccaacccgattgtggtgcccgacgtgatcctgcgccgtacgcgcgaaatcggcaattgggatatcgccggcgtgcgccagctcaactccacatccgacatgaaccggtatcacatcatgcgcaaccgcggatacatggcccggtacttcatgacctatggtgacttccgtccgctggtgtttggactgggtaccgtgctcaccgcggccaaggaagtcattcgcctggtgatggtggatcgcgagcacctcaagaccggtttggtacagattgccaagggctggtgggactcgcgcaagctgatgcacgaccccacctggaagctcatgccgtcgctgaagtagccgtagtagtggctcccctctatgagggggggtcactacaggttacttatggatgaacaggccaccgtcgccccaagcccactggccttggccggcaccgatctggaagtgcagcttggcgatgcccatgtcattgaacgcgtgatgctcatcttccgcactctgatcgatatgcgcggcggcggtatcgtcggccggattatacgagaaggtgattggctgacggttcatcgcgctcggcgccttcatcgcagcctcgacgccggacttgaaccaatccggagcggcctcgcgcccctcatcgctcattgtggcggtgaactgctcataggtcttggtggcgcggtgcgtgcgttgcgcttcgcatagctcctcataggatttcgcctgataatccagatgattcttcggatgcccgatcaccacaccgagatacagctcctggccagaggtgacgtggcaatgcttggccgcctccgccttgtcccatgagccggcgacccataaggtgccgaggccgcgcaacgtggccgtgagcaccatgcgttcggcatagaagccggcacgctctttggcttcctcatcgttcgcggggccgacgatggccagataattcgccgcattggtcagatgacctgaagcattggcttcggcgaacaccttgggctggtcgcgcaccagctgaatgttgagatcgccgagtaagttgatcggctgaagcgccatctcgagctggcgggccgtatcgtcgtcgatcggctcatcatcgtaggcgcgtacggcggtgcggatgttaattgcatcaataagttgggtatgttctgccatacctcccattatcgcgcgcgacacagagtcaggccaccatagacgccgatttttcctagtatgcgaaatcgcatgcattgcccattgtcaggcttgaaaaacgatacgaatagggtacgtagtgaccggcgacgatgcacacgtttgcacaattggtgtgtaatggtttcgtgttgagcgtaattcgcgttaaactgggcgcaaccttacgaactgatgaaaacgtatggaaaggaaggtcaacgatgattgaaactgcacaagctttcggtgttgacattggcggttccggcatcaaggccgcacctgtcgatctgaccaagggcgatttcgccgagccacgattgaagattctcactcccgaggtctccactcctcaggccgtggccaaaatcgtcaagcagcagctcgaccacttcgaagtgcctgaatccgcacccgttggcatcgctttccccgcgccgatcaagcccggccagaagctcgacttcatggccaaccttgaccagtcttggattggcgtggacgttactgaagtgttctccgaagcctgcggccgcccggtcgtcgtggtaaacgacgccgacgccgccggcctggccgaagtccagttcggtgccgccaagggccaggatggtctggtcatcgccaccacactgggcaccggcatcggcaccgccttgatttacaacggcgtgctcatcccgaacaccgaacttggacacatcatcctgagcgccaagcatctggacgccgagaagtatgcctcctccgcgattcgcgagaatgaggaactgggctacaagaagtgggccaagcgtctgaccaagtactacggcctcatggagaagtacttcaacccggacctgttcaccgtcggcggcggcgtgagccgtcagagcgaaaagttcctgccgtacgtggatatcaagaccccgatcgtgcccgccaagctgcgtaaccaggccggcatcgtcggtgccgcctactatgccagcaccaagcagcagtgagccagtgagcgtgggtgtgcagcgctgacccgcgaatatgcttcaggccgtccgactagtcgggcggcctttcgcattgcataggaaaggtatgcgacgcattcccgggaatgttgcgcaaagtgggcgtgtgtatggaggtctgtggcgacgcgttcccgggaatgtgtcgcgtttgagggtgtgattcgggtccagagcgacgcatttccgggaatgttgcgcgtttgagagcggggcagggggcaccacgctctatcgtgggagggtatgagcgtgcatttctcttctcgtgtggatatttctgcgccgaatcccattgcggcggccgaggcggcagccaaggcaaacggcatcgcactcagcaaactcaacgattccaatccgacccgccacgggctggcacctgaattggtgccgagcgtgtatacggccgacccgcgtggaccgcgtgcggcgcgagaagcattggccgcattcctcaatacggcaaaggcggtagacgcaagcagccctcagtcgacttcgcccgccgccagcgagggcgggaacgagcgccatgccgctttcaacaatgcgaataccgccatcgagggcgttgacccggacgccctgtacttgctgagctccacgtccgaggcgtattcgtggctgattaagttactttgcgatgccggcgacgcggtgctggcacccaaacccggctatccgctgattgagtcgattgcacggcttgaatgcgttgacacggtcgaataccagttgcaattcgacggctcctggttcatcgacatcgccgaactcgagcggctgctcagcgagcccggtggcgaacgcatcagagcattggtgctcatcaacccgaacaatccgaccggttcgtacgtaaaaccaaccgagcgtgcacgtatcgtgacattgtgccgtgagcatggcatcgcccttatcgccgatgaagtgttcttcgattactctctcgaacctttccccggcaacgcacggctcgcaggggagcgcggcgtgctcaccttcgccctagacggattctccaaaatgctggccgcgccgcacgccaaagtcgggtggattcaggtgtccggacctgccgaggacgttgccgaggcacagcgtcgactggacgtcatcgccgatgattatctgccgatgagtgacatcatcgccgaacggattcccgcattattgaacgccgcgcccgcacagaccagacgggtgggggagcgcgtgcgcaataacctggccaagttgcacgagttgcttgacgccgatcccaacgggctggtcagcgtgctacgggccgaaggcggctggaacgtgctgctacgagtgccttcagtcatcgatgagaacgagctggtgctgcggttgattgacgagcacaaactgaccggacagcccggctacttcttcgacatgacttccaatggacacctggccgtttccctgctacccgaaccggacgaattcgagcgtggcatccgcgccgtgctcaataccgtcgccgctttgctgcgataggccggtgtttgccggcaccacgcctgtactccacgtacaatagcggcatgggattcttgtttagaccgaaagaactgccacgcccggcgtcgctgacgttcactttggatcaggccgggcatacgtatgatgatgggcacgtgggacttgctcccacggacatcaccatcagcgagctgcgggtggctgtgatcggactgaacggcgcaggcaaatccacattgctgggtctgctggacggttcgttgaaggccaacgccggcacggtgaccattgcgggcggtgaggaacgtcttgacccggctgtgaagaaggacgcgaagcgcatcgataatctggtcggcaaagttcgccgcgaggagattccgaacagcttttaccaagcggcgaatatttccgaggctgtttccgaagcgctgaaaaagcacaaggtgcccgagtcagaacgtcatgcgcgcatcggcaatctgttcgcgcattttgatttggcgcaggtctccaaggccaaggccagcgaactggactccgagaaacggcacctgctggctattgcggccgcgctgagctttgagccgagtgcgattgtggcggatgagccgagcaagggattggatgagattggcgccgcgcatgtggccaaggcgttgttcagctacaacaagcaggtgattttcgccacgcatgacacggatatgatccgccggcccgaatacgccatcgaccgcgtactggtgctggacgagcacgcggtcgcgtttgacggagcgccggctgaggctgtggcgttttatgaggatctgattcgccgcaagtatgaggctgcgaagcggtagcagataggaatcggccgttggaggattggcatcggccgtgaggtcgatgccaatcctcacgcgaagtagaagccgcggaagccgtactggtagacgcggtagatgtatcccgaactgagcaccatcttgtactgtgccttgaggttgccgtcgtcatcgtagacgccgaacaggccctgcatgccgatgtccaccaggttcaggtcatcggacagttcctgtgcggaggagacatacggcgaatacggcacatcgaagtcctgcacttcggtgtaggttccggcgttctcgtcgaccaggtacttgcggaactgggagttcgagttctcatccttggagctctgcgcggtcgaaatgccatcgatcatggtccaatcgaaatcaggacgggtcatggcataaccgaagtcgttatcgaacatgtagatgtagtactggccgtcctccagcgaggaatcgtactgcacagtgattgagtgctggccgccggtgtcgccggaatcacccaccttggtcaggaaggagggctgcgcatccatgccattccatacgctcggctcgccgatcatgtagtcgagcgacggcgtgccttcgatgtcattgatcttgatcatcgtggaggtctcacgtgcggacagcaacgcggagccatcatccatgagctggatggtgttgaagtggatccagtcccaacggttcgtggcggtcggatcggattcgtcgatgccggaatgatcggtggattgcttgtaatcggggaacaggtcgccgaaatccaccagcaggctcacctcgccggagtcggtgtccaccttgatgacctgatcctgcacggcatggtccgaatgtttcagatcggtggccagagagacgatattgccgtcggaatccagcgcgtaatcatggtgcaggatgtactggtcgcccagattgatgatcttgaccagcttgcctaggcggttcatgccgacgaaatgcttggtggaggcggagaaccacatgatgccgtcattgtcgaacagcagacggtgcgagcggtagtagagcaccgggatttcgccgcgaatcacaccgttcgcgtcatagtagtacatgaaatcctgctcgttggaatcattgccgagaatcgcgtacaggccattgccgagcgtggtgaccgtggattcgtcgggggcgacggcctgttcgagccgtacttcctcctcgcgagcagtttcgggccggtctgctcgatggtgcgcgtggtggcgttgccgtcggtgtcggtgatggtcagggtaatggtgttcttgaccttggggatcagtcccaacaccagaaactcgtgctcggtggaggcgatgtcattgctcgataccgtggtcgtctgactcgccgtgctggtaccgccgacattgccggaaccgtcggcgtcgccggcggcggcctcacggtatgcggcggccgcctcatcgctggtgatggcgttggccgtgtaatccgggtacccctcagcggaaacggtgtagctgacggtggaggcctgatcggtggtgaagtacacgtacatggacgtggtgttggtgccgtacgggttcaccttggtgtagatgctgtcgactgtgcgttctttggcgtcgcgctcgtcggcgatctcggtgtccatcatctgctggtattcgtcggtatagacgttctcgatctgggcgttgagccgctccacgcggcgttccttgatggaggcgctgacgtcgtcctgtgagaacaggcacagaccaatggcgatggctgcggtgacggctgctgcggatattttgaagacgcgactacggacggcagtggacacggggaaaccctcacgacagtatgggtaaacgattagtgaattacgtcacatacattatgccgcaggtcttggaaaacaccggccggaatgctgggagaatactgaagcttggcgggtcgccgagcggtccggtcctatagcagggtgaaccaagactgaacctgatgccagagcgtcggattgttggcgatcatcgaatcgctgcgcgactgcacgaagcaacttagtatggctatgcccagcgcccacaatacggccagcatcacgacccagcgcatcagccaacgccacggagtgacgcgggcgatgccatcgcctgaagcggcgtcgttggcccccgccaatgagcggctcggttcgcgcccattgaccagccacagtagccccggtatggacgccagcgagatcagccagccgaaatcggcggaataccgccatcccaaaccgccgacgcggctgtcgaatacgaccagcaccgccgccacggccaagcaagacatcagccatggccgcatgccgtgtgtttccaatctgcgcagcaggggcagcgccaaagccatcaaggtcagtggcgtggccgtgaaaatcgcgccgaccatcacctcgtaataaccccattgcggcatcggggcgggagagcccgccagccacgggaaacgatccatgaagcgcagcggcaggaacaggtaataccagatgttggcgggcatatccgcggacggggtggtataccgggtcatatcggatatggagaactgatacgcattgccgaaattgaacggggaatcgaaccgaaccatgttccacgccatcagaggcgtcacgacgagaatggcgggaatgattaccgccagcggcgcgcgcaacgcctgcaacggcttgatgcggcgtgtgcgcagaccggtgcccagcgcgcgaatctgcggccagaacagggggaacgcaagcaatgcggccaaggtgaacgtcggtcggcatccgaaattcgccgcaatgcacaaggcgcccaaggccagtcgtggcagggagagaggcttggcatcgcccgcctgccatcggtccgatggtctcagcggacggcgggacgtgtccgcgccgagccatagccatagtcccagcgacgtcaacgtcagcgatgcggcgaacggtatctgatagaagttcgtgcgatacagcaaataccccatttgcgcgctcaccaacgatgagaccactactaacgacgcggccgccaccgaagtcttcggcatcacacgatggatgacgcgcagcaccagcaaggagaagaagatgatgaacagcagcacgagaatatactcggcggcggatgtcggcagattatgaccggccagcagacgataggggacgaacagcagcactgcgggcaacacgccaaaataggaataccagtgaccgtcataatacgcgtaatcccagtagagcggactggctccattggcgagtagctgggcacgtgtggctacgtcataggggtgctcggtggcggccagctgttcgggaaccggcaagtcgagccagggccggccggcgaccagcgcatcggccacatgcccatactggtcgaaatcataggtgtaatcgccggaaacgtggaagacgagcgaagacgtgtaccacagttcgtggatgatggatacgccgataagcagggtaggaatcgccagaagccccacgaaagcaagtcgttgccgagtgctggacgggtcaagcgtgatacgccacaggcgcgatcccggcctccagacggcaatcatcagcaacaccaaggccatggcgagcacgcgcatccaattgatgacgaacggtacgcgcacgttggcgcgggcgtcggtgaccggtacgatcgcgccgcgctcttcctgaatccaaatacgcacgatgccggcacccggcgccttgacataatggctgcgaatagcgtcgggattcatcgactgggccttgccggtgatgccatcgacatccgcgcgcacatgaatggtcgccagcggtttgaagacttccttatcgtcgttcgctttggattcggcctcggcctgctcgcgggccttatcgatgaccttgctgctctcggtatcgatgcgtaggtaatccgacgtgccgtccgcggtcagttcaagataggccttggtcggatcggtgacggtcaacatgccatcattccggcgcgtgagacccgaacccagcgtgttatgcacggcgttcgtatccgtgctcgctccgagcgtacgccagaacggcaggttgaacacgatgcactccatggcggcgatggcggcgacggcggccagcaaggcgatcagcaggcgcaccaaacgcagccggtgccgggtatccgggcggctgggcaggtgccgttcatgattcgacggcatcggacggtctgcgcgagtgtggtctatggaatgcacgcatttattctataggctttattcgggcttgatgtcgggcaaacaagagacaatgtgaatcatgccaaaacgtacatcggaccatgggaagcacaaccgcacgccactgctgggcgggctgaaggattcgatgaacgcgctcgcggccgatctgggactgtccaagccgaagaagcacgatacgaatccgttcggcgatgccttgcgggagatcagtgagcgtaaaggcggcattatcgacgaactgactcgccatgcagtggcgctgagtcctgtaatcaagcggcgcaccttccccgaattggagaacgtgccggaagggctggtgcttggatgggcgcagctgccctccaccagaggccgtggcttttcgcttggcattttccccgaccgcgatcattttgcgcaggtggcgttcgccgatacgcatggccgcgtattcgtgggcaccgaccccaacatggacgtgcaggatatgcaggcgcgattcatgttcggcaaggaaaaggaagtgactctgccggacggtgagcggctgggcgaaagcgacgagccgcgttcacgttccggtttctcccgtgcaggccatggcctgggaagtgcgctgcatcatgggcgtggtttggggcgtggccttggtcatggtgctgacggcgtgaaggccattaccggtggcgtggtggggcgtgacgacaccggacgcatgacgtggctcgcctcatggctcaaggccggcaaccggtacacgcttgagcagatgcgtgccaatctgccgcctgtgatgcgtcatgatttggaataccgcgatgccattaccatcgcgttcttcgccacgtatatgttgccgcagatcaatggtctgctcatcggattcggttccggcaatatcttccgccgtctcaaccgtgaggcgccaatcggtgcgattcgccgttcggtgcgtgacactttggcggcacgagcccacggcatgcgggcctccggtctggaggatcacttcgccgatctgatgcgcgaagccggcgccctcgacaccacgccgggactggaagcggtgcatggcgccgaaccgttgcacctgtacacctcgacgtattcgagcggctatttctttacgtgggataagtccttggcattcgggcaggcgctgaaatccttgaagatcgaaggcaacctcaaccgattcgctgcggtgagcgcttggctggagcgcaacgcttccttggggcgcaaccctacggaagatacggtgacccgtgccgaggccgcgcaaatcgacatgaaactcattgagaaccctgcgattatggcgcttgacccgtatgatggcgagcaggagcgtcgggccgtgctgagcctggtcgatatcgccgcacgcacggctgggcagattcgcagtgaattccctgatcctcgagatgtgctgacccagcagaacgtgccggattcgggtgtgacgaatgctgcgggcgctgaaagtactgagagtgttgagggcgctgtagagcggaccaataagagcgacaccaacactcaagccgctcggccttcgtgctcgccggcgaggagcgacgaatgggtgtatcgtcagaccctctcctcactgttgcgccggttacggttgccgtatcggtttgatgtggagttccggtcgcgcttggattcgggtgaagtggccattggcttcaccactgccggcacctcgatgatgcccgatagccggtatgacaccactcgccgtacgtggcgtgcgctgagcagcgccgaacgcgcgtcgatgagcgccgcctacaacctgcgtgtcggcctgatgatggcagcgctgagtttcggcaccagcgaatccgtgcgccaggtgtcgttgcacatcgattccattggtcttgaagaggcgattgccgaacaggattccgccatcgaggcgatgatgagcgaggccctaagcgccttcgaacatctacgcagtggcgatttggggcgtgtgggttccaaagccgaccccaaagatggtgatttccatggcgacccgacccgccccatcacccatgaggagacgttcgggcagacggcgtccggtgacgaacgcggcacggccgggggagcaggcaacggtaccggaccgtctgcggatgctacggatcaggccgcggccgaatctgctgacgccgatggcgctgcgtccatcgattcgcagttcgaagacctgatgaagggcatcgatatcgacgaaatggcgttcggcatgccggacgatactggcgcaggcgacgacctgggcggtatcggcggcgagggcgtcggcactgacggtgctgatggggccgccggcatggacgatgatccgatgagtgtgctgcgccgcaatcccaccgtgcgcaatatggtcaccgtcaccttcacccgtgatgccttcctcaagcgactggacaccgctgggcttgacaatcccgaggaaacctaccgcatgttcggtgccgtgatggacgtggacggcgaaggtggtctgaaacccatcagcgccgacttcgacttggcggacagccggttctctcccaccggatcccaggaggagcccgaactggccgaccgtcaattcagtccggcgaccgctcacgtgctgggcgcacagaatagtgccggactggctatccagcgagtggacctgctgcagcatggcgtcaacgaattccacgatatcgccaggaacacgtcgctcggctccgtggaaaaggcccagcgagccatgcaggtcatcgaatcgatatgcgatcccgaactgaccggtttggcctctcaggtcaccagtgcgttgatcgatggcaaggacacgccggacttcacgttcacgcttgccgacgatcttgacaaggagcgtctgcgcgcccgagatatgctgttctcgggccaagccgatcaggccatcgaagcggccgaagcggccgtggcccatttggaccaggtgtatgcggcaggccatggcgtacctcgatacttcaactcctatgccgagcgcgtggtctacaaccggctgttcgccacattggacgagcgtacggtgcttatcccggacaatctgttctacgcgcacatggagctggctgacgtgttgagtcagatcaagggtgccgaggcggccatcccgcatctcaaccgtatggtggcgtacgcgcccgcctacccgctctcacatctgaagctcgccattcaactggcccgcaatgaggattgggattcggcacgcgccgcctgcctgaatgctctgcgcgtggccttggaccgcgacgatgccgcgttcgcctattaccggttcgcgtacgccgaatggatgcttgaccggttcgacacagccgccgcagcctacattatgagcgatcacatcgctcccggggccattggttcgctggaaagcgaactgcaggaactggtttcccgtgcggactcgcagtgcataccggtgcctgaatcggtggaggccgccgcccatgtgcttgccacgcatgatctgccggtctggccgcatatcgaagtggctgacatcgtgcgtgacgccgctcgcgtgtgcgtggatgaggacatgttcgtgccggcccgcacgctctcggtggctgtggcccgcatgaatgacggcgaaggcgataacatcgacatcatccaagcccagttcctgcgctcgctatccgcgtagccgcctgaggggagttgacggtatagccggccgaggggagccgagcccgctaggatagacaaccatgagcacgaacgaacaactggcatgggatttcgacgatggggatgtggccgaggtccggcctgataccggtattgcacgttttgcccctggctccgaacaatggatagccgcactgcagcccactgacgacgacgcgatacgcctcgaccgtttcgacgtgaacacgatgaccgctgaggccgccgcccgcctgtgggctcgcgtggccgcatgggtggaatccgatcagatcgcctactacatcgacgactcacccgtcagctccgacgccgcttacgacgcgcgcatgcgttgcctcgaacgactcgaagcggcgttcccctcactggacaatccgcagtcgcccacccatcgcgtcggcggctccttctccaacgacttcgcctccgtgcgccaccccagccgcatgatgagccttgacgacgtcttctccatcgaagaactcaaggattggtacgactcggtgattcgcgacctcgattggcctgaatccaagcccctgcccatgagttgcgaggtcaaaatcgacggcctcgccctgaacctcatctatcgcaacggcgtgcttgaacagggactgacgcgcggcgacggcgttacaggcgaagacatcaccctgaatgtgcgaaccatcggctccattcccgcaaacctcggcggccccaaggaagacgttccggacttcgtggaaatccgaggcgaagtgttcatgcgttgggatgatttccacaccctgaacaacgagcaggaggacgccggacgagcgcccttcgccaacccacgcaacgccgccgccggctcgctgcgtcaaaaagaccctcgcatcaccgccacccgtcgcctgagcttctatgcgcatggtctggggcagctcacttgggggccggaccatccgcgcggcacccatgatgtggtcgccgaccagtcgcaggcctacgatctatacaccaagtggggcgtgccggtctccccgcacaatcgtgcggtgacctcattccaggagatcctggacatgatcgagtactacggcgagcatcgtggcgacatcgagcatgcacttgacggcatcgtcgtcaaggtcgatgacctgggcctgcagcgtaccctcggcgccacttcgcgcgcgccgcgctgggccatcgcctacaaatacccgcccgaagaggtcaacaccgaactgctcaacatcaccgtgcaggtggggcgtaccggccgtgtgacgccggtcgccgtgctcaaacctgtctacgtggccggctccaccgtggctcgtaccacgctgcacaatggatttgaagtcaaacgcaagggcattctgatcggcgacaccgtggtggtgcgcaaggccggcgatgtgattcccgaactggtcggcccggtgcttgaacggcgcaaagggcgtgaggaccagctgcgcgaattcgtcatgcccgagttctgcccttcatgcggcgcgaaactgtcacccgccaaggagggtgacaaggacattcgctgcccgaatgtggagagctgcccggcccagttgaccgagcgcgtgatttcgctggcctcacgcaaggcgttcgacatcgagcacttgggcgaacaatcggccatcgctctgaccaacccggaggagaaccggcctgattcggtggcgacctacgcgccgaacatcaccgaggttctggtcgcccccggcgaagagcctgacccgtacgagccggtggaagggctggaattgccggccgcgcagaagccggtgttgtctaacgaatccgggttgttcaacctgaccgccgccgatctgcgcgacgtgcgcgtgtggcgtgaggccgcaatcgtcgaggtgcatgagacggtcggtgcgaacggtaagaagaaaaaggtgcgtaagcgtgtcggcggctctggcctgtggcatcaggtgcctgctttctggaccgcgcccacgccggccaaaaagctcacggccaagcagctggccgaacgcgcgcaaggggagaccgcaatcgaatctgccgaaacacagggaggtaccgccagcgagacgaccggcgcacctaccggggctgaggcgccacttggtactatgccgggctttgccgcagcctcctatcctgagtatgacgtgccggccgacgcggttatcgtgcgcgtggatcacaagaccacgcgcactggcgtcacggatgtaccggtgatcattcggcccggcgaaaacacgcgcaagatgttcgacgaaatggacaaggcccgtcacgccgacctgtggcgtgtgctggtcgcgttgtcgattcgccggctcggtccgcctaccgcacgcctgattgcctcggcgatgggctcgctggcagccatcgaaaacgccacgattgaagatctgacggccatcgacggggtgggcccggaaatcgccgaatcggtggtgaactggttcgccgccacccgcgaacccggcgactggcgcggcgcgactttgcgtgcttggcaggccgccggcgtgggcgtcgacgaggccgagaccagttcgttgccgcagacgctggccggcaaaaccgtggtggtcaccggttcattggagggctattcgcgtgattccgccaaagaggcgattatcgagcgcggcggcaaggcggccggttcggtgagcaagaagaccgattacgtggtgattggcgcaaacgccggctccaaggccgccaaggccgaggaactcggcatccccatgctgagcgaaacccaattcgcccagctcctagccaccggcaccatctaaaatagccccctcagacgcttcattaaccccctctgatgagggggctgtcagcctttaggctgactgggggagagaaaaagcgaatcccgccccagtgtgacttactccactccctctggcatgccgccgcatcacacgctagggtagaacaggccctaaaggaggatacggatttatgagcgacgcacgtcagatcgaagccgacatctacgaacgcctgagcaaggtcatcgaccccgagctcggtcgttcggtcaccgacctcggcatgattgccgccatcgaagccgcgcccgcatcgtcggacgccggcacttacgacgtcaccgtgcacgttgagctgacggttcccggatgcccactgagcgagaccatcaccagccagatcaatggcgcggtcagctcctatccgggcgcacagctgctgcctcatatcgaagtcggttcgatgagccgtgacaagctggccgatctggtcgccgacctcaaggccgaacgcaagcagaaccccttcagcaaaccgggtgtcaagacccgcatcttcgccatcgcctccggtaagggcggcgtcggcaagtcctcggttaccgcgaacctggccgccacgtttgcggccctcggcttcgacacggccgccatcgacgcggacatttatggcttctcactgccgcgcctgttcggcgtgcatacacagcccaccaatctgaatggcatgctcatgccggtcaccgcgtggggcgtgaaactgatctccatcggcatgttcgccggtgctgaccgggcgattctgtggcgtgggccgcgactgcagcgctccttggaacagttcctgtctgacgtatggtggggcgagccggacgtcctcttgctcgacttggctcccggcaccggcgacatggcgatttccgtggcccaggcgctgcccaacgccgaactcgtggtggtcaccaccccgcagccctccgcttctgacatcgccgtgcgctccggactcgtggccctgcaggtgccgatgaaggtgcgtggcgtggtggagaacatgagctactacgagcacaagggcgagaagctggagattttcggtgccggcggcggtcagcgcgtgtctgaacagctcactcaggcgctgggctatgacgtgccgctgatggcccagctgccgctggaacccgaagtgcgcgagaccggcgaggccggccggccggcggtgctggacgccgacggcgctttgcgtacggatggcattggccagaccttccgagggttggctgaacggctgttggcagtgtgagcctgcgcagcctcacacttttgtaggcggcgttggcgtttaagtccggttcgctgctggtgggcgaatcgcttgaccacagcacccgcgacctggtggtcgaggcaatggagcgcactgtcggcgtggataggctcattaacctgcaggccattcacatggacgaggacgccgtgccgcgctgccttggtatgaatgggagatctacgttgagcccgatatctggcgggtgcctcgcagtaaataacggcatagcgcattgtcggtgcgatgctaagaggtaatggcccatgagcggttccaatcggcgagattgcgttgccgggacaccacgacatgggccatctcgataaaacgatgccgcgtgtcggctgttctcaggtcatccgcagtgacgagaatgacgatccagccgagcagttgcaatgcgtttcgctttgccgcgtcgattcgcatttgtgccggatcggcgtgataggctccctgatattcgaacgcgacgcggcagtccggatatgccatatccaatatgacgtatgagttgccgatattcacgcgatagttggcggtggggcatcccaagcctgaatccttcagcatcccaaacagcgtgttttccggcggagaatccgtgttctctgtcatgtagggcagtgcctcgtggcatttgttacgacctatgaaccgcggactgatttccaagtaagtatcgaaatccttgcgagtggccattctgcgccgtttatcgcggctcatcaaagaggctccaatggccgcaagttcctccaatgtagagtattgggccatctgagcccacatcatgaccggcgaggcaatccagaactgttcataatcctttttgcggatatccagttttcccttaaacacatggaagaccacgcctttgattcgtctgcgtttgttggcactggaaacacaggcgtgcacggcatcaacagatagcgtgcaatgtcgggggatgggcgcgccgtagtagttggccgcattgatgtatcccaccagcaatggacctttcgaacggcgcgcagcatcattgcagcgttcacgttctgctcggcgtcggccgacaatatcctcatgcataaaagagctcatggtgcgaccgtaaagctgatttggacttgaatgcaagccaggcagggcaatgtggttccagcttatggagttatccacattgtctatttgcgcagagaacggttctcagtagtatctgtgcgctcaaatgaacaagaacataacaatctcacatcatcgcaaatggcgacatggcagtgattagggcatattccatgtgtgcttcgggcgtagagaagtgtgcacagacattattgagaaccgttctctgcgcgcctatctggctacgacctcggtgggcaggagccccgtgcgctggaacggccggtcctcgatctggtcaagcactagggtagccaagctgacgccgaatgcgtccattggctggcgcacggtggtcagctgcgggcacgctggcgtcggcgtcgacgtcggcaagtacgacggtccgatgatataggcgattcgtcgatacccgcgccccaacatatgctcggtgagcttgcgtgaagcgagtcggttgtcgatgtcgacggtggggaaggggtggcgctgccatagccgacgccggaaatggcgactggcacgctgatattggcgaatccctgaaatagcgggtcgtccttatgaaatgtgttgagaatccacgggccgtatcgcatggcgcagcgcagtctgcaccgccccgccgccgaaccaaccccggcaagatcgcgcgccgcgccggcaccactatcctcgccctgctgttctgcgtcgtatggttcttcccggtctactggatgattatcaccgccgtaaagccgcgcgatgagatcatgaccacgacccccgtgttctggcccatgcacctctcgatcgtcctgtcgattattgtcgcgttcttcgcgtgcacggccctgaccctgtaccgcttccgcgggcgcaagccgatcatggtgttcgtgctggccatccagatgacctctggcggcatcatcccgcagatcatcatctacaaccagctcggcctgctcaacaaatacagcggcctgatcctggcgtacatcgccatggtgctgccgttcgcgatctggaacatgcgcgggttcttcctgaacatcccgaaggacatcttcgaatccgcggccgtggaaggcgcgaacgactggcagatcctgtggaagatcaccttcccgctggccgcgcccggcatcgtctcgacctcggtgttcgcgttcatcaacgcctggaacgactacatgatcgcctatacgttcatgaaggaccagtcgaagtacacgctgccggtatggctgtcgtccttctcgacacccaccatgggcaccgatttcggcgggcagatggccgcttcggtgaccttctcgttgccggtggtggtgttcttcatgctcatccagcgcaacatcatgaagggtgtgacgaccggtgccgtgaaatagcgtatgccgccgtacctcaccaaacgattcgtccgctgatggcggcgtgaccgcgtgtcgcctgccgtcagcggatgaacgataataaaaacagtatgaaaggaacagctgtgcccacattcgaatataaggctgatgccgcaacgccgtgtctcaccctgattcccgctccggtgacattggaatacacgcatggcacggctatgatcgggtccttggtgacgatcgagaaacgaattcccgaatatgccgtcaccgaagatgccgatgagacctgggaaacgctgccaatcgagcagctgtccagcgaactcgagcgttactgcggcgtcgccgtccgtacgcgccgagtcctcacagccacagatgaagccgacgccggtgccaatgccgccgaaaaagcgcgagatgcgggcgtgggtgcgggtgcgggcgcgggtgcgccggcagcgatgaacggcaccgtcatatcgctgtgtgtggatgcgcgattggcgcatgacgaatacacgctggatgtgttcgcctcagataccatcgccgtgcgtggtggcagcgaaagcggattgcggtacggcatgcagacactgcggcagatgatcaggcaaacctcgcggaccttgccctgcctgcatatccaagacaagcctgcgttcgcggtgcgcgcctacagtcttgacgtgacgcgcgggcgtgtgccgacgatggcgttcctcacctggttcatcgaccagctggcgttgtataagtacaaccaattccagctgtacgtggaacatgccttcgctttcggcgagctcagcgaggcgtggcgcggcactgacccgctcacggccgacgacatcatgttcctggacgaatactgcgcacaccacggcatcgaactggtgccgtccttggccactttcgggcacatgtatatgaacctgcgcacccgtgaacatcgtggactgggagagttccccgaagacgccgaccgtccgttcagtttcatcgaacgaatggaacaccacacactgaacgcagccaaccccaagtcgcacgatttcgcctcgcgcctaatcgaggaatacgcgccgctgttccgctcgcggtccttcaatattggtggcgatgagactttcgacttgggccgtggccggtccgtacaggactcgccgggcgccagtcgcgatgagctgtatgccgatttcgtcaaagacctatgcagcacgcttgcccatcgtggtctacaaccgatgctgtgggcggatatcgcgctcgagaatccgcacaccatggacttgctgccaggcgacatcacgatgctcaactggatgtatgagccggatatcgacgaaagcaagatccagaccatcgcatcacaaggccgccgccaattcgtgtgccctgccgtgcgtgcgtggagccggttcttccccgactatgacggtgcctggctgaacacgtaccgcatggcggtggccgggctcaaatatggtgcggaaggcatggtggtcaccgattggggtgactatgggcatgtcaatgatccgcggttgagcgtgccgggactgtgctacggtgcgcaaaacgcgtggaacccggttgcaattgacgcatgcgaaatgaaccatcggatttctaatctggcgtatggcgacgaatccggttggcttatggattcactcgctcgcatcgactccgatggagtgtcgttcccctgggacctcgccgtgcaagtgctggaactggaatacggttccggcaccggcatgctgaatacggatgtggcatcatatgtggaacggtcgtgcgggggagagctcatgtttgaccgtgcgctgggatgcgccgacgcgcgccgccgattgctcctgcggaaccatgcccgtctcgaacgacgccgggattgcgaccgggcgttgattgattgcggcagtgcggttgtcgcggtgctcgatggctcggcacgaggaggattgaacccggagctgctgtgggtgatgctggatgggcagcggttgttcaatagactgggtgaggaactgctggtattggctggcggcgaggacgcctgtggcaccaaggatgtgaccggccgtgcgctggatacctcgcgccgcgcccgtcttgccgccgatttggagttgtggttcgaacggtaccgtgtgcagtggctgtccatcggccgttacgccgaattggcgcgtatcgcccatgtggtgtggtcgtttgcggacatattgcgtaggggagcgctataggggggctcgcagaaattcggtcctgctgagaacaatgtgaggcttacgcgccgtcaaacgcacatggtgatttcaaaaatggcgaattgctgccattcttgcacctgtgcgtttgatgggaaatgtgcgtatgcctcacattttttgcataaagcatgaaaatgtgtgagaccggcgtcaaggtcgaattcgagaagaaggccttcgaacagattcgccagaacgcctcccaggtcctcaactccgacgacgctccggacgttacggaatacaacaagggcaacgccacgtccggcctgctcgccagccaaggcctgctcaccaacctcaacgattacgtgtccgaatatggctgggacaagattatcaccggttccttggccgacaccggcaagtacggtgagcaaggcgtgatgggctccggcgactggtgcggtatcaccaccggcgcggtgaagtaaggtcattcgcacaacaggcaattcaatcaacaagcagtacatattggttttggtttcggccgccttgttccctggcggtcgaaaccacctctccaccaaggagcagcagcaatgaagttcaccaacggctactggatgattcgtgacggcgtcgacgccctctacgctcgtaagcctacgaactggcggcggatgccaccaccgaaagcctcaacgtcctcgccccgacctccgtggtgcgcggccgatacgataccctgaacctgcccacattcaatgtggacatcaccacgccggcagaaggcgtgattcgtgtgcgtgccgaacactggcaaggcgccaccgaataccccggattcccgctcaatgccgacgaacccggcaaccgtgattacgtgaccgttcaggcgaacggcaatggcgacggcgaagtcggcgtcaatggcgcggacgtcacgctgaccactggcggacttaccgcgaaggtcgtcaagggcaccccctggaacctgaccttcatcggcgaggacggcaaggtgctcactgagtccgcaggcaagtcgctgggccgattcaagctcggtgccgaatcgaacgtcaccgcccagccggtcggcgaattcggtgtgaccatggacggttccgcccgtgatgaatccgacgtgttcattgccatccagctgcatctgtcggttggtgaagacgtgtatggcttgggcgaacgcttcggcgcgtacgtcaagaacggccagagcgtcgacatctggaatgaggatggcggcactgcttccgaacagggctacaaggacatcccgttctacatgacctccaatgggtatggcgtactggtcaacaaccgcggccatgtctcctttgagatcggttccgagaacaccgaggccgtgcagttctccgtgcccggtgaggccatcgacttctgcgtgatctatggccccacccccaagcaaattctcgaccgctacaccaagctcgtcggacgtccggcgaatgtgcccgcatggagttacggtctgtggttgaccacctcgttcaccaccaaatacgacgaggccaccatcaactccttcatcgacgatatggccgagcgtgatattccgctggccgccttccactacgactgctactggatgcgcgagttccattggtgcgatttcgagtgggacaagcgtttcttcggcgacatcgaatccacgctgaagcgcctgcacgaagacaagggcctgcacatctgcgcttggatcaacccgtatatcggccagcgcggcgaaatgttcaaggagggccgagacaagggctatctggtgcgcaagcccaatggcgaagtctggcagaccgacttctggcaggccggcatgggcttggtggacttcaccaacccggccgcccgtgaatggttcaaggacaaggtcaaggcgttgctgaatcagggcgtggacgccatcaagaccgatttcggcgagcgtatcccgcgcgacgtcgtctggtatgacggctctccgaagctctccatgcacaactggtacacccagctgtacaaccaggccgtgttcgaagccatcgaagaaaccttcggcaagggcaacgcctgcctgtatgcgcgctccgcgacggtcggcggccagcagcagcccgtgcattggggcggtgactgcgagtccaccttcaatggcatggcccagtccttgcgtgccggcctgtcgctgacctcctccggcttcggcttctggagtcacgacatcggtggcttcgagggcgcgttcccggatccggccgtctacaagcgttgggtggcgttcggcatgctcggctcccactcgcgactgcacggttccaccgtgtaccgtgtgccgtggctgttcgacgaggaggacgagaagaacggcgtcgcattggtgcccggccagaccgccgtggatgtggtgcgcgagttcaccaagctcaagcttgaactcatgccgtatgtctaccagcttggcctgcagcctcatgtgaacggtactccggtcatgcgttccatgttcgtggagttccccgatgacccggcatgccgcacgctggaccgtcagtatatgttcggtccgtccatgctggtcgcccccgtgttcacctactccggtgaggtttcctatcgattccgctgtgggtgcgcgatagcagcgtaacgacatgaacatttcagcgtggtgctgtaacacttcggtgttgcggcaccacgtttttgtgctgatatggggatttgtactagtcgaatccgcgaaatgttcagtaaatgttcacgtagcgaaatcggcatagaatgcgagcaaacgcataacggcacggtgctgttcatgtgtacaccaacgccagacgaaccgccggaaagaaggggtctccgtgattgagacagtggacgatatcaagacgattgcgaacgtcggcacgggaaccatgggccacgcgatcacgttgcagttcg

SEQ ID NO: 24 - DNA, 2443872 bp, Bifidobacterium longum (residues 1,221,937-2,443,872 of 2,443,872)
  modified_base (101572)..(101670): a, c, t, g, unknown or other
  modified_base (967348)..(967447): a, c, t, g, unknown or other
  modified_base (1466136)..(1466234): a, c, t, g, unknown or other
  modified_base (2133522)..(2133620): a, c, t, g, unknown or other
  modified_base (2431890)..(2431988): a, c, t, g, unknown or other
cgttggccggatatccggtgcatctggtcggccgcggcgaggcctcgctggagaaggcgatgaaggcgattcgttcggatgccgaggacttcgccgaagccggactgctcaaggatggcgacaccgtggacgcggtgctggcccgcatcaccggttacgccgactatgcgagcggcgtggcggacgtggacttcgtcatcgaatccgtggccgagaaccttgacatcaagaagtccgtctggaccgaagtggagcacgccgcccccaaggacgcgattctgtccacgaacacctccggcctgagccccaccgcgctgcagtcggtgctgaagaagcccgaacgcttcgtggtggcgcacttctggaaccccgcgcagttgatgccgctggtcgaagtggtgccgggtgagaagaccgatccgaaggtggtggacatcaccttcgacctcatggccaagatcggcaagaagccggcgaagatcaagaaggaatcgctgggctttgtgggcaaccgcctgcaactggccgtgctgcgcgaggcgttctacatcgtccagcagggcatcgcggacgcggccaccgtggacgacgtgatgaagtacagtctcggccgtcgctggaatctggtcggccccctcgccagcatcgacctcggcggcctcgatgtgttctataacatcagcacttacctgttcgacgatatggacaacggcaccggcccgagcccgctgctcgccgagaaggtcaaggaaggcaatctcggcgccaagaccggtcagggcttcttctcctggcaaggcgaggacggcaagcgcatcatcgaaacccgcaacaaggccctgctgcgtgccctgaaggacgacgccgcggatgccgccgctgcgcaggcgtgaggcacgaatgacgaatgttcgtgcgtgacgtatatcacgatggaaggctcccctcaggggagccttcgttgtacttacgtcgttctctgatttggctcatcggcatgcgtatgcgtcgccgatagcgacaattgcggaaacgcttacagtgtgatgtgcacacggacaacaaaccgatacacgcaaggatcggtgacgacgatgacatccacagaacacagcacgcgagccgacatgctggcccatttccagtgtgccgtcatgcatgcactgcttcaatatgaggtctcgctgggcgatgaggtcgtcttcgatctggtcacgcacgtcacgcacggacgagaaatacaggtagaacgtggcgtggttgtagccggcgagttcggtgatctgacgcaccgagatcttctcgatcggcttggtctcgtacagcttccagaacgcctccttgaggctcttgaccgtctgctgcgtaagttgcgggttcttcttgattgcgattcgcggtatggttattgcgcacaaaacgcacaatcccatcgactcgtcggtcaagttcgtgaccttcatcgacgcgatgctctcgctggtggtcacgcaggacgtgcttttggaatcccagggaaccgcgcacgcggcgcaatcctcgggactgttcggcatcgggcttggtgcggtgaccatgatcatcggcctgtggatgctgctgcggcggcgctggacggtgccggcgtcgggcgaagattccccggacgatgccgttcctgcagtcgagatcacggctgaaaccgaggcgtagggcgtcgcaatgcctgtttacaatcgacccgaatggtctttgtggtgagaagaggcatatggtgaggctgccgacgttgaacgtgaattggagtcgcgatcgggtctacgcgattcggcgcggagtggtcgcctgctgtatcctgttctgcctgatcggcgccggagtcgagaccgcggcggcgcagcgcagctggccgcgagccgacaccgcatccgccgccgcaaccgcagcggcgaacgagcccacggccgttacccgcaagcaggttcccgatagcggcaaacagggcgggtcgcggaagacgcagaacacgcagaacggcgatgacaaagccgcgcaaagcgtggactggaaggggccgaccggcaaacagcccgacctatcccagtactccgacctgagcgtggaggtcagtctcgccaaacaacgggtgtacgtcaagtccggtggccagaccatttatacgatgatcgccagtaccggcgtcgacgacgccaccccgcacggctcgtacaccatcgatacgcgcggcgaacacttctacaatgccgaagaaggcatgggcgccgactattgggtgcagttctacggttcgtacctgttccactcggtgccgaccggcgaggccttcggcgactatctgccggaggagggtgccaaactcggccagcccgcctcgcacggctgcgtgcgcctgactgtggccgacgcgcaatggttctatgaccaggtgccggacggcacgctggtcaccatcgcgtagggtggtctctcgctcagtctcgttgcgttcgacagctccctcgtcagagggagcttatcagagggagcttagctgattagcgcgcttcgggcgggcggtattggtcgtcggtggtgaagcaggtgcgatagaccatggccatgatcagaccgtcggccagcaaggtcagcgcggcgatggcgccgaagaccacgaactggtatttggcggcgttcagtggatctccgccggctatcacctggcccgccatcatgcccgggatggtcacgatgccgctggaggccagcgaagcggtggtgggcaacagtcccagccgaatcgacgagatgacggatggacgggcggactcccatgccgtcgcccccaaggccagcatcatatccacctcgtcgcggcgttcctccatgctttcatagaatcggctcagcccgacagcaagcgcggaaacggtgttgcccagcagcatgccggtcagcggcaccaccagctggggcgcgtaccacgggtgcgggcgcacgatgagctcggtgaccagcgccagcatcagcagcatggtgatgaccaggctcaggaagatcggcccggcaaggcccttggggatgccgcgtgcgcgggacatcacgatctgcacggccgccaccagcatgaccgccatcagggcgaacaccatccacacgctgttcgaacgaatcacatagctgatgatgaagcccatggcgcacagctgcaccaatgcgcggcacgacgaccacatcagggtcttgccgatgcccatatgcatgagttcgctgatgatggccgccacggccaccatgcccagcgcgatgagcagaccccagatatcgatgttgtaggaattgcccagatcgccgctcatgcctgcgtctcctcattttcatcggcgccggcaggcaccgcgttcgcgtcctgcgccgccgaatccgtcatctcgcgttcggtcagccgccccttgtccagcgtcagcgtgcgggtggcccgtccgtccggcgggcggtggcggatgcggatgatcgccatgccgcgtgtggcggcatccgccatgatcgtagccaccttggccgcgttgtcgtcgtcgagaccggcatctacctcgtcggccagcagcaccttcgggtcggtgagcagtgtgcgggccagggccacgcgggccgtctgcccgccggacaggtcgtgcggggcgcgctccagatcgatgtcctcgcagcccatcgcgtccaacgtcgtgcggatgcgctcgtcgggcagcagctgctcggccttgccgcccttgccgcgaatcgcgagcgtccagggcaggcggatcgcctcggccacgttcttgcccgtcagaatcggcttctgcggcaggtaggcgacatcccgccgccactgctgcggcgtgaactcgccgctgcccttgccttcaagggcgaacgtgccgtgcgcatgcgggttgagccgggcgcacgcggtcaacagactcgacttgccggagccggacggtcccaccagatcgacgatctcgccgcgctccacagcaaaggacaggttctcgaacaccgtgcgttcgtcgtccgccggcgattgcgcggggatgacgcaggacacggatatggcttcgaagaaggatcgcatattcatccagtctagccgggggcacatgggaaaccccagcgttcacttcctgtatacccggtgtggcataatagccgaggcaatttttgggctttgcctaagctagtttgaatttgaaataggtgaataacgtggcacagactactaacgacatcaagaacggatccgtcctgaacctcgacgggcagctgtggaccgtcatgaagttccagcacgtcaagccgggcaagggccccgccttcgtgcgcaccaccatcaagaacgtgctctccggcaagatcgtcgacaagaccttcaacgcgggcatgaagatggaattcgagaccgtggacaaccgcaccctccagtactcctacgaggacggcgacaacttcgtgttcatggacatgaccacctacgaccagatcatggttccgaagaccctcgtgggcgacaaggccaagttcctgctcgaaggcaccgactgcctggtctccttccacgacggcaccccgctgagcatcgatctgccgggctccgtggtcctgaccatcacccacaccgagccgggcctgcagggcaaccgctccaacgccggcaccaagccggccaccgttgagaccggagccgagattcaggtcccgctgttcgtcaatgagggcgaccgcgtcaagatcaacaccgaggacggttcctacaccggccgcgagaacaactgatctccgcatcctcaacagacgaccgaccgtataaaggactaggacagcagcagtatggcacgttccaccgcgcgcaaaagggctctgaacaccctgtacgaagccgacgaaaaaagccaggatattctctccctgcttgacgagcgcatcgcacatcccggtgcccagaccccgcttcccgactatgccattgaaatcgtcaagggcgtggccgaacaccgtcgtcagatcgacatgaccctggacgaacactccacgggttggaaggtccgccgtatgggcgtggtcgatcgcaacattctgcgtatcgccgcttgggagattctgttcaccgatgatgtgccggacaaggtcgccatcgacgaggctctggcattggccaagaccctgtgcgatgacgattcgcccgctttcatccatggcctgctgtctgcggtgtgcaccgccaagaacgcagcaccggcaccggagtccgtggcagaagaggccgatgaggaatcgtccgattccgctgccgccgcatccgagccgaccgatgagggcgatgtttccgattcgcccgattcgtccggtgcatccgacgagcctgctgccccgtccgctgagattcagccgacggtcgattagtcatttgttgttcagcctccccattcgggaggctttttcatgggcggacacttgtgccgccgtacattctcaagtcggcaccttgccgacagccccgccagcgggggtgagactttgcgcccaacggcgtgtgagtctgcgctggccgttaaccttggtacgaatacccgaaaagcataagggggttttggtgagccagaacgagtccgggaccatcgcaattccgatgtatgacaaggacgatgcagtcctcgttttggaagacggacaggtatatgtgggggagccatacggcgccctcggcgagacgaccggtgagatcgtcttcgccaccggtatgaccggataccaggagacgctcaccgatccgagctacgatcgccagatcgttgtgcagacgttcccgcacatcggcgataccggcgtcaacagcgaagaccctgagtcctcccgcatctgggtcgccggatacattgtgcgtgatccctctccgaacgtgagcaactggcgtgccgaaggcagcctggacgacgacctcgccaagaacggcatcgtcggcctgagccacatcgacacccgcaagctggtgcgccacctgcgttccgcaggcgtgatgcgcgccggcatcttctccggcgacgccctgaccgatcaggccaccggcgcgctcaagaccatcgagcagctgctcgaagacgtcaagaacaccccgcagatgcagggtctgagcctgtacgacgaggtgtccaccaaggagacctacaccatcgaaccgtgcggcgagtacgaaggcaaggagccgctgtacaccgtggccgctgtggacctcggcatcaagggcatgaccccgcaccgcatggccgaacgcggctgccgcgtgcacgtggtgccctccaccatcaccttcgccgaaatcgagaacctgaacccgggcggcgtcttcttctccaacggcccgggcgacccggaacaggccggtcccgaaatcgagctgctgcgccaggtacttgacgccggctacccgttcttcggcatctgctttggcaaccagctgctcggccgcgcactcggcttcggcacctacaagctcaagttcggccaccgcggcatcaaccagccggtcaaggatctgaccaccggcaaggtcgaggtcaccgcccacaaccacggcttcgcggtcgacgccccgatcggcaagcaggtcgacgcgccgtttgaaaacggcaagtacggcaaggtgttcgtctcccacatcgatctgaacgacgacgtggtcgaaggcctgcagtgcgtggacatccccgcattctccgtgcagtaccacccggaggccgcagcaggcccgcacgatgcggcctacctgttcgaccgtttctgcgaacttatgaagaacaactccaaggaaggtaagtgatatgccgaagcgcaccgacatcaaatccgtgatggtcatcggctccggcccgatcgtgatcggtcaggctgcggagttcgattactcgggcacccaggcatgccgcgtccttcgtgaggaaggcatccgcgtcatcctcgtcaactccaacccggccaccatcatgaccgacccggagatggctgacgccacctacatcgagccgatcgccaccccgatcctcgagcagatcatcgccaaggaacgccccgacgcgctcctgcccaccttgggcggccagaccgcactcaacgccgccatggcgctgggcgaggccggcgtcctggagaagtacaacgtcgaactgatcggtgcttccctggaagccatcgaccgtggcgaggaccgtgaactgttcaagaaggtcgttgacgaggccggcgccgaatccgcccgctccgacatcgcccacagcatcgaggaagtcgacaagatcgccgagaagttcggctacccgctggtcgtgcgcccgagcttcaccatgggcggcctgggctccggcatcgcccacaacgaggaggagctgcaccgcatcgccggcgccggcatccattactcgcccaccgacgaagtcctgatcgaagagggcatcgagggttggaaggaattcgagctcgagctcatgcgcgaccgcaacgacaacgtcgtggtcgtctgcccgatcgagaacgtcgacccggtcggcgtgcacaccggtgactccatcaccgtggccccctgcttcaccctgaccgaccgcgaataccagaagctgcgtgacatcggcatcgccatcatccgtggcgtgggcgtggacaccggcggctgcaacatccagttcgctgttcatccggacaccggccgcatcatcgtcatcgagatgaacccgcgcgtctcccgttcctccgcactggcctccaaggccaccggcttcccgatcgccaagatcgccaccaagctggccctcggctacacgctcgacgagattcgcaacgacatcacccagtccacgccggcctccttcgagccgaccatcgactacgtggtcaccaaggtgccgcgcttcgctttcgagaagttcccgggcgccgaccccaccctgaccacctccatgaagtccgtgggcgaggccatggccctggccggcaacttccaggagtccctcggcaaggccatgcgctccatcgacaagcgccacatgggcttcaattgggatggcgagaagccgtccgccgaagaagtggccgaactgcttgagaccatccacaccccgaccgaacaccgttacctgcagctcatgcgcgccatctggggcggcgccacgctggagcaggtgttcgcggccaccaagatcgacccgtggttcctgaagcagatcttcctcatcaatgagaccgccatgacggtgcgcgaggctgaaaccctcaccccgaagctgctcaagaaggccaagctcgccggtctgtccgacgtgcaggtggcccacctgcgtggtttgggcgatgaaggcgagaacaccatccgcgaactgcgctggacctacggtctgcgcccggtctacaagaccgtcgacacctgcgccgccgagttcgacgccgccacgccgtactactacagctgctacgccgacgaaaccgagctgcgcccgcgcgaacgcgaggctgtgatcatcctcggctccggcccgaaccgcatcggtcagggcatcgagttcgactacacgtgcgtgcacgccgtgcaggagcttggcaaggactatgacaccatcatggtcaactgcaacccggagaccgtgtccaccgattacgacatgtccgaccgcctctacttcgagccgctcaccttcgaggacgtgctcgagatctacgaggccgagaagaagatgggcccggtcaagggcgtcatcgtccagctcggcggccagaccccgctgtccctggccgcgcgtctgaaggctgccggcgtgccgattctcggcaccaccccggaatccatcgacttggccgagaaccgtgagctgttcggcgaagtgctcaagaaggcggagatgaacgccccgcgttacggcaccgccctgagcctcgaagaggccaaggaagccgtccaccgcatcggttacccggtgctcgtgcgcccgagctacgtgctcggcggccgtggcatggaaatcgtctacgacgacaagcagctcaacaagtacgtggaccgcgcacttaccgaggccaaggccgataccgtggtctccggtcgcctgccctccccgctgctcatcgacaagttcctgcaagacgccatcgaaatcgatgtcgacgcactgttcgacggcgaggaactatacatcggcggcattatggagcacgtcgaggaggccggtgtccactccggtgacgccgcctgcaccctgcctccgtccaccctgtccgacgaccagattcgtcgcctgcgtgaaggcacctacgccatcgccaagggctgccatgtgcagggcctgatcaacgtgcagtacgccttcatggccaacacactgtacgtgatcgaagccaacccgcgcgcctcccgtaccgtgccgttcgcctccaaggccaccggcgtggcactggccaaggccgccgcccgcatcatggccggcgaaaccatcgccgatcagcgtgccaacggtctgctgctgcccaagggcgacggcggcgacatccaccccggccagcaggtcgcggtcaaggaatccgtgctgccgttcaagcgcttccgcaccccggtgggcaagaccgtcgacatcctgctcggacctgagatgcgttccaccggtgaggtcatgggcttcgaccgtgacttcccgcacgccttcgccaagagccagctcgccgcctacgacggtggcctgccgacccacggcaacgtgttcatctccgtgaacgacaccgacaagcgtcagctgccgttgatcgccgttcgtctcgaggagcttggattcaagctctgggccaccgagggcaccgcctccgtgcttcgccgttacggcatcgagtcgaacatcgtggacaagatcagcacccgcgtggacaccgatccggaagccccggtcgaggtgcatcacgctgccggatccgtgggcaagaacgtggttcagctcatcgaggaaggcaagatcgacatgatcctcaacacgccgaactcgcgcggctcccgttccgacggctactccatccgtgccgccgccattgccgccgatctgccgcagttcaccaccatcaccgagttccaggccgcactgctcgctatcgaggccgtgaagcataatgattatcagatcatgagcattcaggagcattcgaagcagctgttcgaattggagcgacgggagttctgatgactacactcagcagtgaggaattgcaggcacaacgttcggatttcggtctgcgattaagcaattcaatggccaaatacgggccgctgtgtgtgggcattgacccgcatcgcaagctcctcaccgactggggatacaacgtcgacgccgaaggcgccgaactcttctccatgcgtatgctgcaggccgccaacgggcgcgccgcagcagtcaaattccagacgccgatgttcgagcgctacggagccaaaggtttcgaagcgctcgagcgcgtgctctacgcggcacgacaaatgggcgtcatcaccatcgtcgattgcctgcgcggcggcctgtccaccacgatttccgccatcgcagacgcctatttcaagcccggtgcaccgttgctggccgacgccatcacgctgctgccgtactatggcgcgcgttcgttgaacggcctgattaccgaagcgctggaaaacggacgcggcgtgttcatcgcctccctgacctccaacccggaaggcatgagtctgcagaccgcgttgcgccagagcggcgattacaagggacgtaccgtggcctacggcatcgcctccaccgcgcagaagcataacgtggatatcgaaggcatgggctcggtgggtctgatcatcggtgccaccatcggccaatggatgcaggattccggcgtggacccctccaagttcaccggtccgattctttcccccggttacggttggcagggtgccgaggccaaggatctgaaaaccgtgttccgcggtacgcgcggcaacgtgctggtcaccgtgtcccgctttatcgcctcgcatgggccggatatcgccgcactgagccaagccaccgagtcgattgcgcttgacgtacgtcaggcgctgatggaagccactgtcgaaggctcggaaaaccagtaatcagaacggaatcagatgtcgcggcatgcgtacgtgtctatctcatcgcgtacgtcgcatcacgattcatattcttccctgttcgtcggggctgtagcagttaccggtcatctcgccggtgagccgttaccacattggattcataatcgctgcacaccacatcatctccggaggaacccatgactgaaaacacccatgctggccgtctaatcgtcctgactggccccaccgcagtaggtaagggcaccgtggaagccaagctgcgcgccgaccaccccgaagtgtgggtgtccgtctccgccaccacgcgtgccccgcgccccggcgaggttgatggcgtcaactattggttccttactgaagacgagttcctggcccgcgaagcggccggtgagttcttggaaaccgccgtggtgcacggcatggcccactacggtacattgctcaagcctgtggaggaacatctggccgccggtgtgcccacgattctggaaatcgacctgcagggtgcccgccgcgtcaagcagcgcgccgccgagctcgacctcgaagtggtgtacgtgttcatcgcgccgccaagcttcgaagagctcgagcgccgcctgatcggccgcggcaccgaaaccgccgaacagcaggcccgtcgcttggagaccgccaaggtggagctcgccgccgaaagcgaattcgacgtcaccatcgtcaacgaaaccgttgatcaggccgctgccgacctctggtccgtcatcgccaaggaatacgggctgtaaactaccgctttaccaccaactgctggtggaggatttcggcgctgtttttggccggcgcctgcttccagcggatcgcttcggattcgtgatgctcggtgacataatgccgcatccattcgaagcactgctgggtttggatggcatcgcttaatgcgcggtgctcctcattgtccgcgatgccgaagcgtacgatcaggtcggccagacggtgatgccgctgcgcggggaacagggcgcggctgatctgcatcgtgtcataatccgcgcaggcaaagccgcagccggcgatatgccgggtgttgtaatccaggaatcgcagatcgaagctgacgttatggccgacaatcggctcgacggcgggaccggcagccggggtagcgagccatgcgatgaatcggggaagcacctcgtcaatcggatcgaggtcggccaccatcgcatcggtgatgccggtcagcgtggtgatctgacgcggaatcggccgcaagggattcaccagctgctggaattgatcgacgatatgcccctcccgcacgcgcacggcaccgatttccgtgatggcgcaactgttcgggtaaaagccggtggtctccaaatccagcgccacataatcggtggggaagacggcatcgtccatggcgattcgcccgccggcaccatgattgggctgggatggttggccgaaaacggtaatgccggaagtggtcacggaggctcctcatatcagtcggtgttcggtgacttattgtaccggcatcccggtctgacggtaaaattattccctcccggtttttctcggatatattggttaggcggccggcaattgcgcggcgcatcgggaagggagcacagctgatgaaacagatagtggcaggcatcgtggcgcatgtggacgcgggcaagaccacgctgtccgaggcgctgctctaccgtaccggtgagatccgcaaattggggcgagtagatcacggcgatgcgtttctggacaccaattccttggagaaggcgcgaggcatcacgatctttgcgcaccaagcgttggttgaacacggcgacctgcgactgaccctgctggatacgccggggcacgtggacttcgcagccgaaaccgaacgggtgctgcgtgtgcttgattacgcgattcttgtggtctccggcacggatggcgtgcaaggccataccgagacactgtggcgtctgctggccagatacggtgtgccgacgttcatcttcgtcaacaagtgcgacgccgccggattcgaccgcgaggccattctggcacagttgcgcaaacgcctgagcgatgcgatatatccgctgccggcaatggagcagtccactgagggcagcgcggtaccgttggacgcgcttgccgaggatatcgccaccctggacgaggaggcgatgaacgactatctggaacatggcgcgctgtccgtggacagattgcgatcgatgatcgccgtgcgcgagctgttccccgtatatttcggctcggcattgaaactcgaaggagtcgaggaattcctggacgggctggagacgttcacccgcgaacgtgaatggccggccgccttcgccgcacgcgtgttcaaaatcgcccacgacggccagcacaaccgtatgacgtggctgcgcgtcaccggcggtgcgctcaaagccaaggagatcgtctcttcatcctcgtgcgccgcggcgtcatcagcaccgtcgccggtacagggggatgatggcacggtatggtccgagaaagtcgatcaggtgcgcgtctacaatggcgccaaattcgagacggtcaccgaggtgcctgccggatcggtgtgtgcggtgaccggactgacgcggaccttccccggcgaagggctgggagcggaaccggacgccgaatcaccgtcgctgcaacccgtgttgacctacacggtgttgcccgccggagcggaatccgatacggccggcacctcgggagcggccaaacgcggtgacgccggccataacaacgtgaatcaggacgatgccgagcatgatgccgccaagtcgggaaccggccgcaatgaggagaacgacaccgccggccagaccgcggcggacaatagctcgccggcccgtccccagttcgatgatctgaccttgcataaggtcatcaccgcattgcgtgagctggaagacgaagacccgttgttgcatgtggtctgggtggagcggttggccgagattcatgtgcaattgatgggcgcggtccagctggagatcatccagcagaccctgcacgaccggttcggtctggatgtgtcgtttggccccggctccatcctgtaccgtgagaccgtcactgcgccgatcgaaggcgcaggtcatttcgagccgctccgtcattatgccgaagcacatatcctgctggaaccaggggagccgggcagcggagtcactgtggcctcggccctgtccgaaaacgatttggaccgcaattggcaacggctgattctgacccatctgaccgagcgtgagcatctcggtgtgctcgttggcgcgccgctcaccgatatcaagatgactttggtggctggccgcgcgcatctgaagcataccgaaggcggcgacttccgccaagccacctatcgtgcgattcgtcaggggcttatggaagccagagctggagtcagtggccggcccgagacgccggtcgagagccgtccggacaccgcaggggagggcaactgccgactgctggaaccgtggtatcggttccggctcgaagtgccagcagacatgatcggccgtgccatgagcgacatccagcgcatggccggcaccttcgaatccccggtcaccgatggcgaatacgccgtgatcgaaggcgaggcgccggtgtccgagatgcgcgactatgcgatggatgtgaaccagtacacgcacggccatggccgtttctccgccactttcggcggctacaagccatgccatgacgccgaacaggtcatcgcagccgccgcttacgatcccgaagcagatctggacaacacccccgactcggtcttctgcgcccacggtgccggctaccccgtcaaatggtataaagtccccgaattcgcccacgtcgactacgccatgtgaggtggtgactaccaaatctgcggccgaatgaatccgttggtctccaagaaccgttgaatatcgcgcatttccggcatattaatggaatgggccatgcccggatacacttgttcggtcaacgtgccgtgctcgtgccagaactcacccatcgccgtcacatcggctttcgggaagatgtcgtctgcagcaccatgcccatagaacaccggcggcttcaacgaagccaattcggcatcgcccgcaacggaccccggtgccagccatccagagcaggagacggctgcggcatatcgcttcggattgaaacgcagcagatgcgcggccaagaggccgccctgcgagaatcccatggcaaccaccggccgagtggcgggaatatgctccgcaacccatgcatcaatggcttgggcggcttcagtcgcctgcttgtctaatgattcgccctccggcacaccttcatgcgcccacgcaccgaaccatgtatatcccatgccataggcgatgggtgcctgcaaactggcataatcagccgaaccggcaccgcaatagttcagcagatcgggcaaatcgtattcattggaaccccagccgtgcaacagcacgaacaccggagcggtttcgggaccggtcaaacgggtcagagctttggtgatcttcatagcctcagtgtatccaccgtttgggcgacaataatgccctgatgttcgcccatcgagtaacgtcccataagtaatgcgtatagcgcagcggccgtgccacgtgttctgatactctacgatgacacggcagggggacaggtatgttcggcccccgaaatcgtacatgggtggctaagaccgtttatgcgcaggagaagaaacgagaagcaaaggaaggagcgcgcccaatgacattcgattggtcgttcgtgcagcgttacgcgcctttcttcgtcaacggcacattgatgaccttattcatatccgtgtttggcatattgcttgccatcgcggtgggtctggtctgcgctggcgtggaaatcgcgcgtatcccggtcgcccggcaaatcgtgagaatctacatcgaactcagccgcaatacgccattgctggtacagctgtactttctgtacttcggcctgcccaaactcggcgtagtatggtccgccgaaacctgcgcgatagtcggccttggattcttgggcggttcctacatggccgaggcaatgcgcggcggattggaagcggtgcccaacgtgcagcgcgaaaccgcgtacgtgctgggactgacttccacgcaaaccatcacccgagtcattctgccgcaagcagtgtccaccgccattcccggcgtagtggccaatgtgatcttcctgtttaaggaatcgagcgtcgtctccgccattgcgctcgccgacgtgatgtacatggccaaggatctgatcggcatgtattacagcacctatgagtcgttgttcatgctggtcgtggcctatctggtgattctgctgccgatttccatcttcggcacatggttggagcggaggttcgattatgagcggcgctgaaatactgctccagccgggcgtattcccacgtctgttgcaaggcctgtgggtcaccgtgtggatagccggcgtatccgtaggcgcgtccatcccggtcggcctgttggtgggctggttgatgacgctgaagaatcccgtgatccgggccgcgatgcgcatctacctcgacttcatccgcattatgcctcagctggcgttgctgttccttgcctactacggttttgctcgatggttcgattggaatctcgatgccaccggtgcctgcgtgctggtgttcatcctgtggggaggcgccgagctgggcgatctggtgcgtggcgcattgcagtcgattcccaaagtgcagtacgaatcgagctacgtactggggttgagcccgtggcagaccttctcccgggtgattctgccgcaggctgttcgccgtatgctgccggcatccgtaaacttggcgacacgtatcgtcaaaacgacatcattggccgtgctgctcggtgtggtcgaggtcatcaaggtcggccagcagattatcgacgcgaaccgattccagttcccgactggaaccttgtggatttatggcgtgattttctttatgtacttcatcgtgtgctggccgctgtccattgtggcccgccgactggaaaagaggtggtcgaatgactgaacccgaaacgacctgcaagggtttcgaggtgaatcatctggtcaaacagtatgcgaatgccgacaagccggtgctggatgacatctccttcaaggtggagcatggttcggtgctcgtggtgctgggtccttccggctcgggcaagtcgacgctgctgcgcaccatcgccggtctggaaccgattcagggcggcacgatttccatcaacgatcaggtgatcgatgccggcaagcctggcacggaacgagccggacgatccgaccggtccagtgaactgcgcacgcgtatcggcatggtgttccaaagctacgatttgttcccgaacaaaacggtgctcggcaacatcaccatggcgccggtgctcgtgcagaaacgcgataagtccgaggtggaggctgaagcgatccggttgcttggccgcgtgggacttgccgatcgcaaggactcttggccgcacgaattgtccggcggtcagcgccagcgtgtggccatttgccgtgcgctgattctgcacccggaagtactgctgctcgatgagattacggcggctctcgaccccgaaatggtgcgtgaagtgctcgacgtggtgctcgaactggccaagtccgggcagacgatgcttatcgtcacccacgaaatgcagttcgcgcgagccatcgccgaccacatcatcttgctggacggcgggcgcatcgtcgaggaatcgtatgatgcgcaggcgttcttcgaacacccgcaaaccgaacgtgcgcagcagttcctgcacaccttcgaattcgagtgattcgattgtgccatatcgacgtatttgagaagaaatatcaataacaacaagagaaggagaacccaatgagtatcaaggttgggaaatcattcaaagcactgattgccgcaggcgcggcattggtaatggcggcgtccatggccgcatgcggtccgtcggcaggcaccccgagcgaagcgaagtcctctgacacgggcaccagctccagcgccaatgccaaggcccgcagcctcgacgagatcaagaagagcggcaagatcaagattgccgtcttctccgacaaggcgccattcggctacgtggacaaggacggcaagtaccagggctatgacgtctacttcgccgaacagctggccaaggatctgggtgtggagccggaatacacgtcggttgacccggctgcccgtgtggacgtgctcacctccaacaaggtcgatctggtgctcgctaacttcaccgtcaccgatgagcgcaaggagaaggtcgacttcgccaagccgtacatgaaggtggcgcttggtgtggtctccccggagagcgcccagatcaccgatgtcagtcagctcgacggcaagaccctgatcatcgctaagggcaccaccgccgaaacctggttcgagaagaacgcgccgaacgtcaagctgcagaagtacgaccagtacgccgatgcctacaacgcgctgctggacggtcgtggtgacgccttctccaccgacaacaccgaggtgctcgcctgggccaagtccaacaagggcttcaaggttggcatcacccaccttggtgacgacgacaccatcgcgcccgccgtgcagaagggcgacaccgaactgctgaacttcgtgaacgacgagatcgtcaagctcggcaaagacaacttcttccacaaggattaccaggagactctggagccggtctacggcaacgaagtcaaccccgatgacatcgtggtagaaggcggagccgtctgacggacagtccggtggactgtccgtaggcgacgccgagccgcggcagcggcgaggtgtgttgggccggtcgtcaggccgtccattcttgcaggacggagaggtctgattatacccgtccataaccaacacatatagcaacgccggccttcgggccggcgttttgcgttaaggtcgtaatcgtgccgcgcggggaacggcttcgcgcagatgacgcaacactttaagggggtgcgcaatgaccaggttcaacactcagctcgtccacggactgccggttggagacaacaacaccggagccgtgaacccgccgatctacaactcaacgacatatgccttcgagaaggttgacgcgatgccccgctatgactacgcacgaagcggcaatcccacacgtgacttcctggaacagcagatcgcccagctcgagcagggaacgcgtggttttgcgttcgcctccggtctcgcggcgatccacgcggtgctgagcattttcaagcccggcgaccgcatcgtggtcggtgacaatatttatggcggatcgtattcccagctcaatgagttcttcactcgctggggaatcatcgttgaggccgtcgacactcaggacatcgcagcattggaggccgtcgtcaagggcgaccgcgcgaacggcatcgtgcctgcccaagccgtctactttgaaaccctgaccaatcctctactcaaggtgaacgacgtgcgcgccatctccacggtggcccaccgtttcggggcgctttcgattgtggataacacgttcgtgaccccgtatctgcagaagccgcttgctttgggtgccgatgtggtgattcactccgccaccaagtatctggccggtcattctgatgtgaacgccggtctggtggtcgtttccggtgaggatctggcgagccgcgtgtacttcgcgcagaaccgtttgggtggtgtgttggctcctgctgagtgcgacgcggcattcagacgctggcccttcgcatggatcgtcagcaggagaatgccaatgccatcgcccgctacctgctggtgcatccgctggttaaggcggtgcattacccgggtctgcccggcgcaggcgaccagcgtctggctgccaaaggtctcaagggggtcggtggcgtgttgagcttcgaggtcgtgcctggcgttgatccggctgacgtgctcaacaacctgcacctgttccgtcttgctgtgtcgttgggtgcggtggagtctcttgccgagctgccgtgtcgtatgacgcatttcgaactgcctcgcgaggagcgtctgaagatcggcatcaccgatgaattggtgcgtctcgccgttggcatcgaggacgccaacgatctgatcgaagatctcggccaggcgttcgatatcgcttacgcccgttacatcgatcggcatgccgacttcgacgtgttccaacagctgacttcgggggtgtttgcctgatctaatacttttctgcctatttttctactcctggggagcggcgtcggttgtgccacaccggcgccgctttttttatgctctggttccgcctccgctggcagagggctgtcggcgtagccgactggggtggttaagcggaccgcccgcattatgccaaccgcgatatcacagcatccccgttacgatgaatacggtttgatagtgcaccgcgtaaaagtcaagcgcggcggaacaaagaaaggacctgatatgaccatcgacgtctacggtgccacatggtgcggcgactgccgccaggcaaagaacactctcgacaaactgggcgcggcatacacttggcacaacatcgaggaagaggaaggtgccgccgaccgtgccgtggcgatcagcggccagatgcacattccggtggtgcggtacgatgacggctcgttccaagtggaaccctctgcagtggatatcaggaacaagctgcaggagctggggctgctggctgactaggaatccgtggtctgagctgcataaggcgtgcgtcatcgatcggtcttgatggcgcacgtcttatctgtttatgcggatcagagagtagggggcttacgcttcggtgcccactactgttccagttgccgggctttgaccccaatgcgatttcggtagtcggcaagcatattggcaagcgtaacttccctcatggaatccgacatggctttggccactggagcatacgcatctttgagaacgtcgtggatattccgagccacggggcatgtgtgatttcctctctcgtggatgccgatcacatcatcgaggttcgtggattccactgcctgatagatatcgagcagagtgatttccttggggggtgcgggcaagttcggcaccgccggttccgcgtgccactgtgatgagccccgcgcgtttgagcgctcccaaggcgttacgaatgctgacggcgttcgtcccggtgctttcggagagcagcgcgctgggcgccgatcgttatttcgactatcgcatcgagaactatgctgaagctctttctgacgcaccggttgaccatgtcatcgacaccttaggcgaaacggcaaagttgttatccggatggagtgaccgagcgtctttgcgctgattgctgatttgatatgcgttatcgccagatatgaaaagagaaccatgactcccttttgatgagattgtctgaaggtcaacgattggtccggatgcaatatgtgtccaaggaagtttctgaagcgttggtgtcgcaaattactaaagggttcggcatcgatgtcaacataatctttggagatatcgacatcgtcgcggataccccgatagggggcatcgtggccattttcgatggtgaaccggtacggattgacgcggctttgaattatttgaggcagcgtaatattgcggccgaggtgctgaaagagggctgggcagcttggtgtgttccggcattcggcggatattctatagccattgcttataagcgcgcattgacaattgcgataccgatgtgccggtgtcgcgtaccatgacttgctaagttcgggaatagagtcgagcccgccacaatagagcggcatgaggaagaaggattaatggacgttgatttccgaacgcaagccatccacgccggctacgagccgctggataacggccgtgccgctgtgccgccaatctatgcctcggccgcattcgacctgggtgacgcggcgcgcggcgatgcgctcgcgggcggtgacatcgacggcttcgagtactcccgtgtggccaatcccactgtcgatgcactggaaaagcggcttgccgcgctggagggcggtatcggcgccgtggctgtcggctcaggcatggccgcagcatactgattggatgccgcacttttttataagaagccagcatgcacacatagtgaacagttgtacacatatgcgtacgatgtctaccgctttgttttgaacgctgatacgatggaaatcacgagtcgaggccgagggcggtttcgacgtgggtgaagggaaaacatcatggccgtattctttgctggtccgctgattatcatcgtgctactcattgttctgctgtctgccgcattatttgtcgtgccgcagcagcaggcctacatcattgagcgattcggcaagttccttaaggtccagttcgccggcatccatatccgcatcccgttcgtggaccgcatcgccatgaaaaccaacatgcgtgtcaaccagcttaacgtgcagctggaaaccaagactcttgacaatgtgttcgtcaccgtggtggcctccacccagttccgcgtgaacccgaacgatgtggccaccgcctactacgagctgcgtgacccggccggtcagctgcgctcctacatggaggacgcgctgcgttccgctatccccgcactgtctttggatgatgcctttgctcgcaaggacgatgtggcgttcgacgtgcagaagaccgtgggcgccgaaatgagccgtttcggcttcaccgtggtcaagacgctgatcaccgccatcgacccgagcccacaggtcaagaacgcgatggactccatcaatgccgcccagcgtgaaaaggaagccacccgtcagcgtgccgaggcccagcgtatccagatcgagacccaagccgccgccgatgcggagaagactcgcttgcagggtgagggccaggccaattaccgccgcgagatcgccaacggtatcgtcgaccagatcaagagtctgcaggctgtgggcatgaacatcaacgacgtgaacaacgtggtgctgttcaaccagtacctcgacgtgatgcgctcgctgtccgaatcgaacaacaccaagaccgtggtgctgcccgcctccacgcccggcggttatcaggatctctacgagcaggtcaccaaggccatgctcaccgcttccgagacgaagtaatcaccccgtttgcgaatccccatccatcgatagtgaagtccctccaagcgagggacttcactatcgctatgcctgaaggaatgccggaatggcctcggccgccgcgtatcccttgcgatacatcatttccagaccctcgaagttcttttttagggtgttgaggccatagaggtcttccggggcgagaatcagcacgcggccttctgcctcgtaatgcttggcgagttcgagttcgtcgttgtaggtcttgtagcgcatgcgcagcttctcggccgcggcggggtgggagcgttcgaggatgcgggccggagccaaatccttctgctgcttgcgcacttcgtcacgcaagcgagacagaatcagaatcacgcgatcgtagccgtcctccagcgccttctgcaccggcaccggatcggcgatgccgccatcgaaatacggcacaccatccaccacatacggctcgcaggccaccggcacggcggacgaagccttgatgatgtcgaaatcatcaaaacgcacgcgcgatttgtcgaagtacttggtcgagccgtcctcggcattgcaggccaccacggtgaacccggtctcattggcctcgaacgccgcgaaatccaacggattctcgccatcgtgattgctcagcgtgccgtagatgtagtcgaggttggcaaagttgtggttcttgaagaagctttccgcactcgcgtactccttgcggaaggcgtacttggtgtagaaggtgtggttgcggccgtgctggcgtgcgatgaatgaggtcatattggccgcgccggcggaaacgccgtagcacatatccacgtcgatgccgtcctccagcatgcggtccataacaccacagccgaaaatcgcgcggaacccgccgccgacatcaatcatcgccgtctttgtcataccaaccccctgttcacttgaatctggtatgagcttacgcgtgctgcacggacaacgatatgggcagtgtgctgtgaatttgtctggttcttccttggcttccctcagagaggggagccaagaacggctcatacgttcagcaatttgcgtgacaactcggcaatccgttcggacagatcggaattggcgagttccacgccgccggtcgcgtcttcgggtgccagtttgcccagggactccagcacaacgcccagatggcgcacggtgccctcattgccgtcgatgacagcagcccgttcgggcagcagctcgcggaagtagtcgcggtagaacacgaaatgcgtgcaacccagcaccaccgagtcgatgtgctccatgtcgtactggtcgaagtagccatgcagcgtgcgcatcaccaggtcatggtcgccgagccgcccggattccacgatctccaccaagtcggggcaaggctccttgaaaatcgtgttgttggaatcgaatcgatccatcagtttggcgaacttccgctcacgcaaggtcaggggagtggccgccacaatcaccctctggggaatatgatgcgggtcggaaggcacgtcaccccggtcgcacgccactttcagggccggctccatgccgatgatcggaatatcgtagtgttcgcgcaaatcgttcaccgcggcggaagtggcggtgttgcatgcgatgaccacggccttgacgccttgacgcacgaaccgttcgacaatatcgaaactcagggccctcacttgttcaggcgtcttgatgccgtacggtgcgttggccgaatcaccaaaatacagcacatgctcggccggcatatccttggcgatttggcgagccacggaaataccgccaagacccgaatcgaatacgccgattggagccgaagagctcatgcctgaatcctccctatagccatgcctgcaaccgtatgttgccgcgaccgatcacaaagccgattgttttgcggtgttgtttcgctccctagagtactctgaaagccatgagtcttccgcaacgagtaaccaagacacacgcaaccggcaatgatttcgtggtatacctcgacaagtccggcaaattcgagcctaccgccgatgaggtccgattcctgtgcgaccgtcacttcggcattggcggtgacggcctgattcgcctgacacggcctgatttcgtgtctgatttaagcgatgatcagctttcggacgtactggccgggggcgcgaaatggttcatggactatcgcaatgcggatggatcgttggcggagatgtgcggcaacggtacacgcgccatcaccttgttcgctcagcgtgagggggtggccgactccaccgagccgttccgcctcggcacccgtgccggcgtcaagattctgacgccacgcggcaatatgaggccgtacggagccaacgtgttccaggtcgaaatgggggagtggaagatcggcgaaaccgacgcctacgaggtcaccatccccggcactgagggctcggcgcgcggtacgtttgtggatatgggcaacccgcatgtggtcgcggtgatcgaggatgccttcgcgtccctgccagtggttgaatcactggatttggtcaccaaaccagtggtggctccggtcatcgaatccgaccagaacgtggaattcgtgcgggtcgacgacatcgatcagagcaccggcgtgggtgaagccacgatgcgcgtcaacgaacgtggctgcggcgaaaccctgtcctgcggcaccggcctgtgcgccacaggcattgtgctgcgggccaagaccggcatcagccactgggacatcaccgtacgtggcggcaccctgcgcgtggacgtcaccgacagcgacgtaaagctgaccggagcagccacgctggtcgccgatatcgatttgttgtaaaggaatcaggcagcgaacagggccgcgccttcggtgacgatgatgagtaccacgatcgccacgatccacagtatgtcgaccatgaggtcgatgttgaggcggtaatacttattgagtccggccggcaccgccgcgacctcagcctcaccgtcgctatcatcagccgccacagccttacgcgacggcaatccctgcacggccacggtcgcatggctcaacgccatgaactggatggtggtggagaacatcagggtcaggcaccacgggcacagcgcgtgaatcacgaacagcgactgcgtgctcagccagtacgagtaagccaaagcggccagtccgcccagccacgtgcaggtcgcgaaccaacgcggcaccttcacacgcgccaaaccgatcaccgcgatggtaatgaacaccgattcggcggcgatgccgaagaacgcgttcggatagctcagcccgccgaacttcgcgatttccgcttgccaggactgggccaccgccgaacaggacaccaccgagttcagatcgcagccgagtgcggactccggatgccgagccaattgcaaagtctcagcggacagaatgagcgaggcccccaacgccactgccgaggcaatcagcatgatgagatatgtccaagtggcactgtggcgccatccaatcaacggtcgtgcctccgccaagccaagcggcgtggtgttcgtggtgctggatgatgtgtcggttgcggtgttacgagtcatcatgtccctttcgatagcgctgcgctccagattagcctctgcggttgtcagctgggtgccgaatgtctggtttcggccgttggcagaaggtgacgacctgtctgcgccttgcgtgggaatgctgaaatgaggttacgatggaaggtatgactggatatgtgatgcctttggaaccgcccgccgtcgggtgggacatccactgccataccgccttctcggatggcacggaaacgccggccacgttggccgaacaatccaaggcattgggactcaagggcgtggccatttccgatcatgacaccaccgccggctggccggaggccgaagccgcggctcatagggtcggtttgccgttgctccgcggcaccgagatcaccgccacggatgagaacgtctccgtgcacatgctcggctaccagtatgatcccacgaatcagcacatcacggacttgttcgccaatactcgagccgcacggttgcaacgcacgcagcgcatggtcgaattgttgtctcgtgattatccgattacctggcaatccgtgctcgcccaagtcaaggagggtggcaaaaccaccattggccggcctcacatcgctgatgctttggtgagtgccggcgtatatcggactcgttcggaagcgtttgcggatgcggtcagcgcctcatccaaatactatattcccacgccttcgccgacctctcatgaagtggtggccgccgtcaagggagcaggcggtgtgattctgatcgcccatgccggtgatgtgagccgtaaccgcagactgttgtccgatgaccagatcgaggcattgatcagcgaaggactggacgggctggaggtatggcaccgtggcaattcaccggagcaacgagaacggctgctcaccatctgccgccggcaccagctgctggtcaccggtgggtctgactggcatggcaaaggcaaaccgaacaaactgggggagaacctcaccgacgaggccactgtcgaagagatcgttcatcgcggcgtgcttccgctatatcggtgattcagcaatacaaaagcggccttgagataatgcccaaggccgcttatgcgcgattcatggtcacagcgtgccgaagccgacggcgtgcttggtttcggagccgatgatcgcgtaaccgagtgccttggcgggcacgatgatgcgacggcccttgtcatcggtcagatcgatcgtcgtgttgtcggccacggcctgcgcgatggcctggctcacattgtcggctgattcgtcggtgctgaagttcaccggtcgtgccacgttctgaatgcccagttcgatatccatataaggctccttgttctgccgtctttgtgacgaacatcatggtaagtggccgtcgccggccgaggttctgtactctattgtgccgcgtgtctgcgtcgtcatgtgcggtgttacgcgctcggcgtggcgcggaacaccgtacacgacattatttggatgatgtggacgattcggccagcggattgccctcgctgtcatacccgtccaacccggcacgggcatcgcgcagagcgcgttcttcccgctccaacagcggaatcaccgtggtttgggcactcgaggctccgtactgaacgagactgtccggagtatcgtcattcaccgcatcgtcggtcggggcggcggattgagacgcaggggaagcgtcggttgacgtcgtgccgctatgcccgttcatactgaggagctccttcagcgtgatcgtcaccgaagaatgggaagcgccatgtgagggctgcggtttggtcgatcccgtaccggttgcgatgccggagacattcgcttgcgggtgattggcggtccggtcagcatcgggttcgacttccggggtaagatccacgtcgccagcggccacgatgtcagcggaaccggtgcgatcgggatcgggcgtgtcgtccgagacctcggccgccgcggtaccggtgtcggactgctgcggttgtgcgggtgcctgatgacggtcgtcctgcaacaatgtgccgacggtgattgtggaaggcaaaccgggcttcgttgacgaggcggcggccgaccctgcggctggggccggtgccggagtgtgcttgatcacgcccaactggtgtgcgagtcgttcgacctgtgccttgaactgcatgatgtgatcgttgtccgcacggttcaacgcctgaatgaattcgcccacctgttccatctgcagccacaggttggccctgagcatgatgagatcgtcaagtcgagagcccatcatgcggccgtatgcggaaagcacggcgttgcgatgggattcgtcgagcttgccgaaaatccaggcaaggtctcgtgccggatcgttgacctgcatatcctgccagttggtcaccgtggtgatggtggaaccggagaacaggaagtcgccgtcggaaaatccgccgtgaaccgtgcaggtggagaacgaccacaatccctcggtgtccatgatgcgcgcccagctgtcggtgatttcttggggaacatggccggcggagcgtaagcggcgaatccaggcggtcagctgcgaacgaatctgaccggtggtaactaccggatatttggcattggccagaaaagtcgaaggcaggcgatgaatggctccgatggcggtgccgacggccgcgcagtcatccaatgtcaacaggtcgagaggccgcgcctggccatcacggtggacggcaatcatcacggtcgtctcgcctgtgggaccgggcttgcgcggggtcagcggtgtggactccgcctgagtctgctgccccacggcctgtgcggtggccgtctggccgggtcgggaaacgtctcccggggcgaacgcgaccacacggtccatatcgaagccgaggccaccaggctcgcgcgcggctgccagtgtctgcgccgctttcacacggcgaatcagacgcgtacgcccttccttggtgtcagtggcgtatacgtcgtacaacttgcctgaggcatcttgaatcacggtctgatcgatgcctttggcctcgtcggttgcgctggcctgcacgttctcgcgtacgccggccacccccagattcggcaggacggctgaggcgagtgccgccaacatataatcgctacgtttcatcacccttccacactaatacatccgtggcgattcgcaccgcagaatgacacgcaaaacgcgtgattctggcgatgttttgtcgtgagcccgattcagccataggcatgagtcgtgccgtgagcgcgaatcgtgccacaatggacgcatggaacaggcgcaggggattcttgaggggctcgatgagcggcagcgtaccgccgcgactacgttgcaagggccggtgcgcattatcgccggcgcaggtgccggtaaaacacgcacggtcacgcggcgaatcgcctatgcctgcgccaccggggcatggaagccggagcgggtgcttgccgtcaccttttcggtaaaagcggcggcggaaatgcgcgcacgattgggccagctcggcgtagggggaggtactggacgttccggttcgggcgcgggaactgccggagtcacggccgcgaccttccactcagcggcattgcatcagctcaacagcgtctgggcagacatatgcgaggctccatttccgcatgtgatcgaagatcagcgtgacgtcgtctcccgcgcgatcatccgcgccaccgcacgtaccgatgccgatccgctgaccgttcgcgatgtgctcgccgaaatcaattgggccaaaatctcgttggtggcggtggaagattatgcccgggcatgtgccatcgcccataggcagccgcccgccggactcgacaccgctcggttcgccgacgtctacagcgcctacgagcaggaaaagacctcgcgtggcgaaatcgattttgacgatattctgttgctcgtatgccatatcatggatggttttcccgaagccgccgcccaaattcgttccaccatcggctggctcaccgtcgacgagtatcaggacgtctcgcccctgcaacacaggctactgaccctgtggctgggcgggggaggacctgacggcaagagcgcaatgaaccgcaacgtatgcgtcgtgggcgatccggcccagaccatctactcgtttgccggtgcttccagctgggatctgctgcgtttcgccgatgaattcgggccgctcgccgccgatgtcaatctcaacaccgactatcgttcgacgccggaagtcgtgaacctcgccaaccgggtgcttgcggccgcgccgaaccgtgaggattacctgaaactggtttccgcccgtgaatccggtccgcgcgttacccgaaccgcttatgagagcgatatggaagaggcacagggcgtggcggcacgcatagcccggttggttgccaacggggccaagccgtccgattgcgcgatcctcacccgcatcaacgcccaacagccggtattcggtgccgccttgcgcgctgcgagactgaaatatcgcgtccgcaaggattcgggatggcaatcatccgcgctcgccgacgatgccgcgtccaaacgcgcactattggaggcgatgggtttggacgccaccggacttgccgcaaacgacgatctcggggttacgatttccacgatccacgcatccaagggtctggaattcaagcacgtgtttctgatcggctgttcggaagggctcttgccgtatggttcgccggaaacgggggatgcgctggaagaggaacgccggcttatgtatgtgggcatcacccgagctgaggattcgctgcatttgtcgtatgcacggaccaaggatggttatggagcgcagcgcagacgcccatcacgatttttgtgacgggcgtctgtaatgcatactgaatgctcctgaacgttcaggagcgggaattggctgaaggccggttgactatgcctgcgtatcctccgagttgccgttttcaccgtcttcgccatcttcgccgagcagcttggacagttcggcatcccaatcgatatcgccggtcttgccatctgcggcagggtgagaagcggaaccgttggcatcggaagaagaacctgaaggggcgtcggatgacggagacgcgccatctgcgggcttgtcgccaggcagcgaaggcagcagatcgggatgcgtccacttggcgtcacggccttcagggccttcggcggcggtgatcatctcccatatcccggtggcctcgcgcatgcgcttgggacgcagctgcaaaccgagcagactttcgaacgtacgctcggcggggccacccatcgcgcgctcgcggcgcatcatctcacgcaactgttcgatatgaggcagatgggccataccggcgcgccacaccacgcaatccacccagccctcgaccatcgccagcagcgattccagcgaagccagcgcctcgcgctgttcgggagtgtcggggatgccgaccttggtgagattcaccgcgccggaaatcgactccggatccatcgacgtggcgtcacgcagctgttcctccatcgcatccagatcgatggagatgccgcgtgcgtacttgccgatgagcgcctcgaaacgcggcatcagccacggtaccgaggcgtacaggcgggcgtgagccatttcctgcagggccaggaaggaaagcacttcagattcggggattttctcggtggtctcgaatccggagagcgcagcctcgaacgcggcggcgtcggcggcatcggcggaagcatcagagccggagacttgggcggtaccgtcagttgccggagtatcgctgttgccggccgaagtgaagccaatgggattggcagaagcgtcggtggatgtggagaacggattgaccgagtcggttgaagtgccggccgtgtcggcctcggccgcagaagcctcaccgttcagcatcttcgcgtattcggtggcgttctgggcaatcagtccaccagccgggttcttcagcaacgcgatgccctgatcgaagctgccatgcacttcatggctcagattgccggccgcatgccccaactgcatggcaaaggacgtgttgcccagcagcttcatcagttgggctgggtctttcataccgtcgggaatcggaatcggcaccggtccggcgaacatgccggcaatctcgccatcgccgaacgcgccgccaagacgctccgaaatcaccgaagccaaagcgtcgttcatcgactcggccacaggagctgcgaacttcgcccactggtcgatggtgccctccacccagccggcgcgggtcagcacatccggatcgccgggcgcgggattgaactcgcaggcggtatccagccacaggttcgcctcactcatcgcgcggcgagccgcctcgccatccacggcggacacgctggatgcagaaccggaggcgttggcctgctgcaaggcaatcgacttggcgagcttgacgttgatcggcccttcctcgacagtgcgctgcatatcgcccatcgtgttgagtccgccggcgctgaacgcggccatcatctgctggacttcggatggattgggcagtcggctggggtcctgactcatcagctgttcacggatctcctcaggcaactggctgatctgctgccaggccatctcaccctgaatggggccgaagcatttgatcagccactcgtgaatcgcgttgtcgtccatgcgtatccttctttgccgcggtgtgttaccccaagtgtagggtctgcccgggcctgttcgcttgtggccgagcaatattttcggtttatgttcgttttcggccgatttcggccctccgcttacactgtagggtatgtttgcacgccacaggaatcaggaaccagacctcgtccaggagcaggagagcccgactgcggattcggaagcgggagatgagcacatgccatcgttcgaagtgaagcatgattcgcgcctatctcgtggaatcagccgtgctcgggcctatgcggccgctcgtccgaaacgccatttcgtcggtgcattcgccgtgttgcttggtgtggtgattctgctgctgcccagcccgtacgtcatcgagatgcccggacccacccaggatgtgctgggcaaagttgaggatggtgcggttatcgacatcactggtaccggcgtgacgacgtataaggattccggcaagctgctgctgaccacggtgaacgcgtccggcgtgcccgggtacccgatcatcaacgcgcaggccgtctggggttggtccaatccgcaggtggaggtcatgccgcgtgaggccacggtaccggtgggccagagcgcggaccagtatcagaagaaagtcgaacaagacatggccggttcccaggattcggccagtgccgtcggtctggcgtatgccaaagcccatgcggacgaactgggcattgacgccagtgcattgcaacacgccaaggtgacgatgcacgtggacagcatcggcgggccgtccgcaggcatgatgtacacgctcggtctcatcgacaaactcacccccgccaacgagagcggcggcaagaccatcgccggcaccggcaccatagacaaggacggcaaagtcggcagaatcggcggcatagagctgaagatgcttggcgccaagcgcgatggcgccacatggttcctggcccccgcgtcgaattgttcggatgtggccggccgcgtgccggatggtctgcgcgacgtcaaggtcgccacgctggacgaggcgtatcaggcgttggtggccatcggcaaggggcaggccgacgatttgcctcattgcgaggcctgacatgcgcggccagtcgttgtttctggtgagacgactcgcatgggtctgcccacaatgcggcgattttcggccgcgttaacgcatttgttcgcgaagacttgctaatgtgtcccctgtgaatcaaacggcatcacagaacgctgaagaatttggtttcgagcccggcgatatcgtccaggagtggctctgggacgacgacgtggacgattccattcgtgcccagattgaagagctcacgggcgaggatctcgtggacgaggactacgactccgctgtggacggcgtcatcgtatggtggcgcgacggcgatgatgaggacgaattgtccgatacgatcgttgacgcctacgcggtactgggcaatgacggcccgctgtggatactgactcccaagcccggccgcccgggtgccgccagctcgtccaccgtgcagtccgctgcacagaccgccggtatgaacgccgccaccccgctgaccgtcagctcggactggaacggcatccgcctgcgcgcattcggcaagggccgctgataagcctcaatcaatacgcttgactttaagcgtgttgaccggcgtcgtgtgctgcgtagtgctgctgggcgtgactgaatgtcattgcgattgagcgctacggcacgcgtatgcgacaccacgtgtcgcgcagtgctggccatacgctattgttgtcatttgcgggcaattagctcagttggttagagcgccacctttacacggtggatgtcgggggttcgagtccctcattgcccactttcatttttcatcgcttcatggaatcccctcattccacggatataggctgtgacgatattccctgacagtcttcggcaagggttctgaaatctcaatgagatgcgtgcagaaggaaaccggcagtactgctacaaaatcgtgaatttcggtcttcttggtcagatgcgtctcaatagtcacgtaaagttgtggcagagtgtttatatccagcaggaggtcgaatagccgatggcgcaggaacttcgtgaaggggacggcaagtcgggcatcgcacgtgcgggcaagcgcaagtgggggtatgaccccgctcaggtggacgctttcctggagcgcgcccatgctttgtatgacagcgagggcatgaatctcacccagcatgacattcagaacgtgtcctttgatttgcgcaagaacggctatgtgatcgcacaggttgacgccgcgcttggacgtctggaacgtgccgtggtcgataagcagaccacatgggagatcgcacagcatgggcgtgtgacgtggaaggcgaagaccgagaagctgtatcacgaagtccagaaccatgcggagcgtgacgagcgcgaacgcttcaagtccggagcgcccaagcagccttcgtacgataagaagcaggtggatcgtctggtcgaccagattgtggacaaggcggcggccgcattgggcgttgacggcgtgaccgaagacgatgtacggtctttggccgatctcaatgcgaatacggtcaacaatgtgatcttcacccagcgcaagggcaagaaaggctatgacgagcgacaggtcgattacttcctgaacgcctgcgtgcagttgctgagtcgcttggaatcctatgcacgtgtggccgatttcgtgtccggcgagcccacggctcctgcccagaccgccacgaacgtgaccgttcaagcgaacggcgtctcaccgttgttcgcttccggaacgcagcgcccggcaactgacgaacgttttgcgccgtctgccgttgctcatgacgaatcattcgatgccctgcatcaggccgagcagagcttgttcactgctccggctccggttgctcccgcggcgccggccgcgggagcaccgatcgcctatgcgccggctcctgcatcgttcgatgcttccacaagcaccaataacaccaatacggaacagccggtttcctttgctcccgtagcatacccggtgcatacgtccaacgagtctgcggcgaagcccgtctccgagacgccttccgtggctcctaccgcagctgttgcggctgagcctcccgccagtgccccgtccgcgccggtttccggtgtgaccgctggcagcgccccctcgtttgctccggcacagtcgtcatacgaatccgcagctccgtcatcgaccccgtcggtgttcgcggaacatcccgtggatatggtgcaggacggttcctctctggccgctctcgcccacatggctgcggtttctcaggaacttccggcggtggatgcgccgtccttcgctcccaagatgcccagccttgatacaccgaatgcgctgaaattgaatgaggtaccgggttcggtttcatccccggcaccctccgccccggcagcgcaacctgtgaatagcactgccgacgaggctgcgtccgctgccatgccggtctcctttgctcccaccagcaagccggatcgtaacacgaactccattccggttcgcgtatccgatagtcagcctgcagacagcacggtctcccgtccggctgtggaatcatctgaatacgtcgccgcctcccacgacacggaagcagctcagccgtcacaggataagcacgattccaacgattcgttcccgctgctgttcccgcttggcggtaacttcgattcggatatccccgacctgtcgttccccacactgaacaatgacgatacgaagaaggaacagtgagcatagcctccaactccaccgtcatcattctcggatccaccggatccatcggcacccaaggacttgacgtcatctcgcgtcaccctgaacgatttaccgtcaccggtctggcggcgggcggagcacatatcgagctgctggcgcaacaggccgcacagttccatgtgcccgaagtcgcggtgtttgatgagaccaaggttccagcactgcaagcggctctcgcacaggccggcgcacaaggtgtccgcgtgaccggcggtccggattcggtcatcgccatggccggatccggtgcgaatgtcgtattgaacggcatcaccggctcgatcggcctcgaaccatcgatcgcggcgctcaaggccggttcccagctggcattggctaacaaggagtccgtagtcgcgggcggtcatctgctgttcagcgcgcaagtgcgcgagaaccagatcaacccggtcgattccgagcattccgccatctggcaatccctgcgctccggaacccacgccgaagtcgccaagcttgtggtcaccgcctccggcggcccattccgcggctggaaacgtgtcgacatggagaacatcactcccgagcaggcgctgcatcatccgacgtggaacatggggccggttgtcaccatcaactcctccacactgatgaacaagggcctcgaagtcatcgaggcgtcccgcttgttcaatgtgtcgcctgaacgcatcgacgtgaccgtgcacccgcagtccatcgtccattccatggtcgaatttgtggacggcgccacgatttgccaggcttcgccgccagacatgcgtctgcctatcgcgctgggcctgtccgcgccggaccgcatgaccaatgtggccgccgcgtgcgactggacgcaagccgcaacttggacctttgagccgttggacgatgaggcgttccccgccgtgcaactggcccgccactgcctggccgcctccgagaagcatacggcggtgctcaatgcagccaatgaacaggccgtgcatgcgtttcttgatcatcggctgccgtacctcggcatcgtggacacggtcaaagccgtgctggaccagatggacgccgagcttcgtggtaacccgctgttcacggacgtggaggaaatgaaccagcttgagcttgaagcccgccgacgcgccgacaacctgataaacaagcaatgatgaataccttgaatacggaaaatcccatcgaaaagccgttccgcaaaaccggtgatccggtcgacctggccagcgaatcgcccttgcacccgcgccgcaagtcccgccgcatcatggtgggcccggtgccggtgggcgggggagcgcccatctccgtgcagtcgatgaccaacacgctcacggccaacgtacctgccacgttgcagcagatcgccgaactgaccgccgccggctgcgacatcgtgcgcgtggccgtgccgagtcaggacgatgccgacgcactgccggaaatctgccgcaaatcgccgattccggtcatcgccgatatccacttccagtccaaatacgtgttccaagccatcgacgccggctgcgcggccgtgcgtgtgaaccccggcaacatccgtaagttcgacgaagtcggcccggacatctgcaaggccgccaccgacgcgggcatctcgctgcgtatcggcgtgaacgccggctcgctggacaaggaactctacgccaaatacggtggcccgactccggaagcgctggtggcctccgccttgaaggaagcgcacatgttcgaggacgtcggcttccacgatttcaagatctccgtcaaacaccatgacgtcatcaccatggtcgaaacgtaccgactgctcgcttccaagggcgattggccgctgcacctcggcgtcaccgaggccggccctgcttggcaaggcaccatcaaatcctgcctggcgttcggtgcgctcttggccgagggcattggcgacacgattcgcgtgtctctctccgcgccgccggccgaagaggtcaaggtgggttgcaaactcttggaatacatgggattgcgcccccgcaagttcgacatcatctcctgcccgagctgcggccgcgcccaagtggatgtgatccagctcgcctccgccgtcaccgaaggcctgaaggacgtgaccgcgccgatccgagtggccgtcatgggttgcatcgtcaacggtccgggcgaggcacgcgaagccgacctcggcgtggcctccggcaatggcaagggccagatcttcatcaagggcaaggtcatcaagaccgtgcccgaagaccagatcgtcgacacgctgctcaccatagcgaacgatatcgccgcccaaatggaggccgacggtcaagtccccgtcaattccaccggcccggtcgtggtcccaatccagcaccccggtcactgattcggccgaataggccctcggcataaatatcgcggtcagattacaatagcgcacgtgccgcaagaagaagagcatcgcctgactgttcgatccaagccgtggaccagcacccaccggctgatggtcagcctgcccatcttcattatcctgattggcgtgctggtctccatttccaatctgaccacggtgccttggaacatcgaacccaccggccagtcgatggccacgctcaccgacgataccgaagtcaccttcgataacccgtccggagaaacgctgccggcaaaaggcacgtatgaggtcaccgagcgatacatcacgctgaacatgaccagcgacggcaatctgaccaaggagtccggtgctcggggcaaggccaatgcggacggcgtccaagctatcaaggtattgattcgggaacctcagaacgcatcaggcaagcgccccggcgtggtgttcatgcacggtgccggatacggcacctgtgacaactcctttggcgacgtggcctccggtatggcttcggccggctttgtgaccgcagtgctcgacaaacccgtctggaacaccaccgacatcaaccgcgattatccggcctcagccaaggcttatgatcaggtcatcgaatacctgcgagaccaaagcgatgtagacgaggccaaggtcggcatctatgccacctccgaatcgacatggatctcctcgtatctgctcgaggacgatccggacgtcgccttccagattcttctgagcccgatggtgttcagcccacgccaatcactgggatttttcgtcacccaggacttcacccttgttggcgcgaacgaaggctatcaatccatcgtccaacgtgtgttcagcgcggacaccggcctgttcggactgaacaatttcgacctcgccacactcaaacccgccgcctacgccgtacccacctatgtggcttacggttcgaaagacgtgatgacggcgcaggtcgacggcgtgcgtgcgattctctacaacgcccacaaagccgataactggaatgtgaccgtgcgcagctacccggtcgccaaccatgtgctgcgtttgggagatgagtccgaagcgggcaccccgtttgcggacgcctatgtggacgatctcatcgactgggccgtcggcacttccgccggactcacgcagaccagcgaaaaggtggccggcaccaatctgtaccaatcaatcggtctgccgggcgctttgaaggcaagacgcgtcggcaccatatatggtgtgattctgcacgtcacggtggtactgctgctgctcgcatccatcgtgctggcactggtggcgctgggtcgcaaaatcgcggcggatgcccgatggcggcgagagaagcgcgaggccaaacgtgcgggcatgctgataccggaacggcctgtggtactcggtttcgcacatggtttcggcaatgcgctgctgactttgaccctcaccactcttgccacattgctcatcttcttcgccggactcgggcaggtgatcatgggcgtggtcaaacttgcatggggtggcgcacctaccgagacgccgggtgtcatgtattggagctggccggtcatccaagtggtgtccgtgctggtgctatgggcttggtcccgcgtctttatgcacctgatagaagccgcttccgtccgcggcctgattcagataccccctcgtcgcgaatccgttcgagacatcgtcaccggtgccgacccggtactcgcctccacccgtctgggccgaatcctgttctggctggtgaccttcaccatgctgtacatactgttggtgttcgctttctggggtctgtttatttactgactacttcattgagtggagtctgccgggcgtcgcggggaaaggagatgagatgtcgctgtaccgagacgaaggtgtggtgttgcgcacctccaaactgggcgaggctgatcgtatcatcaccatcctgacgcgtgggcatggcaagattcgggcggtcgccaaaggcgtacgtcgcaccaaatcacgcttcggtgccaggctcgagccgttcatgcgcgtcgatgtgcttatcgctgaaggccgctcgcttgacgtggtatcccaagctgaagcggtcgccgcttatggtgctccgatcgcggcggattatgcggcgtatgaggccgccaacgtcatcgttgagactatcgataaaatcgccagcaccgaacatgagcagctgccgaaccaatatcggctgctcatcggcgcgttgaacgcgctcgccaaacaatcccacgccccgcaagccataggcgactcctatgtgatgcgcgccttggccttggccggttggacgccacgattgggcacttgcgtggtatgcggcaaggcggagccggcgtacctgtccatcgcgtccggcggtgtgatgtgcgaagccgaccacactaccgatgcgcgccgtatcgcaccgttcgtgttaaaccagttcgatgcactgattcgtggcgattggtcggtgcttgatgccgcgcctgtggagcgggttgtgcaggagttggttgaagattggggggagtattacctcgaacgcccgattcgttcgctgcgcttgatagattcatgagtatggcttttgagaacgttgattacacgtcgttggacattcccgcagctccgttcagcgaccccgctcgtattcccgacttccccaagaacaaggtaccccgccatatcggtgtgattatggacggtaatggtcgttgggccaagcagcgcggcatggtccgcaccaatggccatcaggccgccgaaccggtggtgttcgacactatcgccggtgccatcgaagccggtgtacggtatttgagcctgtacacgttctccactgaaaactggaagcgctcgccacaggaagtgcgcttcctcatgggtttctcgcgtgaaatcatccaccgtcgtgtggaacagatggacgagtggggtgtgcgcgtgcgctggtccggccgtcgccccaagctgtggaagtcggtgatcgacgagcttgaagccgccgaggagcgcaccaagaacaacaaggtcatcgatgtggtgttctgcatcaactatggtggccgtgctgaaatcgccgacgcctgcgccgccatcgctcgcgaagtgcgcgatggcaagatttccggcgaccgtgtgactgaaaagatgattgccgaccatctgtacaatccggacattcccgattgcgacttggtgatccgtacttccggcgaacagcgcacctccaacttcctgccgtgggaggccgcttacgccgagctcgacttcgtgcccgaactcttcccggactgcggccgtgacgtgctatggcgctccatcgaccattacatccaccgcgatcgccgattcggcggtgtgaaatagtccttgttaggccccctctgacgggctgagccgtaaagcaaacagcccggtgggctgtttgtaggcgaagacgagacgagagtcaagccagaagaatgcgagcggcagcttgtccgtaattgcggtcgagctgcccgtgtagcggactgaggggagttaccggcacacctcagccatcctctctacaaactcatccaaaaaacgttccgaatccacaccaagtgccacatgcacatgcggcatggaatgattcaccagcccaaccgggtctccggtggtccggcctcgtactccattgaaatcaccggtattggtctccgcgcgcaacgcaagatcaaaacaatcgaccagtgaagaatcaagtgcaaccgccgccgctaacggatcatgcaacggcataccgccagagaacagtgcggggtcggcttccaaatttgccttgatggaaaagtccgcgagatcagccaagaaccgcccgcgcttggtccccgtcgcacgccaccggtcggccgccgattgcggtagcaaacactggtgagtcacatcaagtcccaccattgtgatgtctgcgccggaatgaaatacacgattcgcggcctcagggtcttggatgatattcgtctcagctaccgcatcccaacaattaccgggttgggtaagcgtaccgcccatcatcaccagcctgagtttcgatgcaatatccggtgctcgagtaatagccgcatccacatccgtcaacggcccggtagccagcacggtaacgtctcggccaaactcgcgaacctgctcaatcagatactcaatcccatccgcagcatcaacggagcatctccttttgcccccgctggcgagagctgtcggcatagtcgactgggggtggcccaccgaccgagagcggttcacacgagaacaagcacccaacgccggatgagcatgaacatcccccgccaaatacccgccaacagaaacaacctcatcgggcacatccacagacatgtcatcaccagacatatcatcaccagacatatcatcaccagacatatcatcaccagacatatcatcaccaggcacaccagctccatcagccagagccccggaccctgccagccgagtattccccagtccatcatccccgtggaactgggcacaccctgcatcaggaataaacgcatcagcccaagaaggatgctcagaccctaaaaacactggaatatccgcccgaccaaacaaatcaagcaccgcgcaagtattggcataagccgtgttcgcatccacattgccataactggcaatcacgccacccaactcgcactcatccgtcgaccccaacaaatacgccaacgccaacgcatcatcaacacccgtatccatgctggcaataatacggtcaggacattggaccatagaatcgtctccttgttagcgtgatccgttatgaataaccttatcggccgatacgcaaaaatgcgtcctttcctcatgggaaggacgcatttttgcgtagattcaaactcggaatatcggaaattacttgccgatgaattcgtcggtggcaaggtccttggcctgcggggcctcatgaattatcttgtcatgactgtcggtgtatgcgtcttcttcagccaggaagtcgaagtattcctgagcgcccttgaagtcgttggtgccgagcacgaaagagccgtccttgatcttggccggatcgccccagtactggccgtcgacgataacctgcatgctcttcttgacgaattcgggcttgaggttggcgtcaggggcttcgtccacgagaatctgcgcggcgtcatccgggttggcgtacgcgtactcgtaacccttttgagtggcctgagtgaacttcttgaccaggtcgggattgttcttgatggtcttgtcattggtgatgatgccgatggtgtcggcgttgccgggcacgccatagtcaggctcggtgaagcagttgagcttcgggccgtacatgtcggcttgcacgccttcccacgtggcgtagaagccgccgaaatcggccttgccggattccatggtctggaaggtggaggtgccgacggtcaccttgtcgaattcgcccttgccgccatcggtttggatcatgcggcgcaccacggcatcggactcgttggagccgaaggtggcgaaggtcttgccatccaaatccttaggggacttgatggcggtgttggacgccagtgcgcaccaaatggcgctcggcttctgctgcacctgcagcacctgcttgatgtgagcgcccttcagcgtgtagacgcccacgttggtcaggttggacagggcgaagtcggccacaccgttgttcacggcctgttcggcaccggcctgggccacggccacgatatccacgtcaaggccggcgtccttgaagtagcccttgttcttggccacgtacacgccgatgtggttggtatcgggtgcccaggaaagcatgaaagtgaccttcttgaggtcggaggtgttggagttggaggagtcggcggtgttggtctggccacatgcggcgaaaccgaaagtcatggcaagggcgcccacgagggcagcggccttggatacaaggcttttcttcataatgatggttccctaattcgttgtctctctatcgttctctgggattgcttcgaacggaagtcggcagaaaacgatatggagggccttgatttccgttcgaccagcgcccccgacattccctatgaaagctcgggaaagccggtttgccacacgctggtaaagctgttccattatagagacagggttggagacctcatgagaagccgcttcgttcagtcggtcctggccgccggctcgtgcctttgacggtaaaaaaagaactactggtccgcgtcggggtcttcgtcgtcgccgggcgggccgagcaggatgcgctcgctggcgtttaccgccagcatcagtacgcatgtcatcaggataatgacgatggtggcggagaagatcagcggcgtgcggaatgaattgtaggcagcctgcagccagatgccaaggcccttgcgtgcgccaaggtattcagcggtggatgccgtggcgaagatgtatgcggcagatactcggataccgccatagatctgacgcgcggcaacgcgcagcttcacgtgccagagcgtccagaccggggtcgcgccgcaggtcaatgcgacgtcggaatagaactggggcactgcttctagtccgcgcacagtctgcacggcgatggggaagaggccgaataccgccacgattacgattttgccggaaatctcaaaaccgaaccaaatcaggaacaacggggcgatggaaatcagcggcatggtttgtgcggcggcaagcagcggatagaacgccgcgttgaacgtgtgcgagcagtacagtgcaatgccgatcataatgccgaagaacacggcaaacaggaatccaaccacgccctcatagccggtgattgccgcggccgggccgagcgtgttccatgtttcgatggtggcggcgaaaatctcgcttggcgcggagatcatcgtgggggagacatgtcctagatccacccacgtttcccagactgccagcaatacgatgacggcgatgacggtgggcatgcggcgcttgaggcgcttggcgatggacatgggatgtcaccttgctttccgcgccagtccggtttgctggtggcgcttgcggccggggcgtggaacagtaaggtgaggagcctgcgcgcctgccggtcgtgtgatggattgtgttatatgccgtccatcagtataggcgaaggcgaacgacagggcgcacaaaaaaacctccctcgtcagagggaggtgaaagagctactccagtccgatggacttcatgtggtggagcttcagggaatccaccttgagactaccggactcggcgacgagcttgatggcgcgcgggccttcggaggcgtaggagtaggagctcagcacttggtggccaccgttgacgtagacctccacggagccgcaatccacgaacacgcgcaggtccagcttgccggaggccagttcggcgtcggtcagtggggcggcgcggtagccgcgatcgccgttggccatggcctgacgatccaccaccacgcggccgatctggccgtcataagccacgtaggtgtaggcaccgtcctcagtggcgtgaatcttcagacccgcacgctcggcagtggaggcagccaagtcgatggtcatttcgatttccacggcctcggcgtcgtcggcgatgatctgctcgccatccatgtcgagtgtgaccgaaccatggtcgagggtatcctcgcgcaggccttccatttcggcgaccggcgcggtgaccacgtcgccgtcatcgccaagggtgatctcgcgcggcagggtgagctggccacaccagccgtcatcctccatgggaatcggctgcacgaacgggctcatccagccatagacgatctgacggccgtccacattgaaggactgcggggcgtagtagttgtggccgcaatcccacaggcggaactcggtttccggcttgaattcgccgcccggctcccacgtgccgatcatgtagccggcgttgctgacgttgcggttcatgaagccgctgggcttggaccccatggcggagaagccaatgacccacttctcgttgccgtccttgtctttgatggggaagaagtcggggcattcgagcatgaacacatccggatccgggtgctggaagagcacgcgctcgtattcccagcggaccatgtccttggaggagaacagccacatctggccgcgcttgtccgcagaggagacaccgaaggtcatgtaccaggtgtcgccggtcttccagaccttcgggtcgcggtagtggtggtcgaccttgtcggtcgggcagtcgatgatcatgccctgcttggtggcggaggtgagctcgtcattgtccggcagcgcggtcatctgcacctgccagtcgccgccggtgttgtcgttgccgttggcccaacggtggccggtgtagtagaagcgaaggtctccgttgtcgtcgatgacggcggaaccggagaacacgccgtccttctcctgctctaaggacggcgcgaacatgatgggctcgcgcttccagttgagcatgtcggtggaggagacgtggccccagtgcatcggaccccactgggtgccgtaggggtgcagctggtagaacacgtgccagcggcccttgtagaagcacaggccgttcgggtcgttgatccagccaccgttggaggcgatgtgatacttcgggtaccagcggttgttgcgcttggcggccatctcagccacgccggcttcggcttttgccagttcagcagcgtggtcgcggatgggggtgagaacaggggtttcgggagtgaagtcagtcatggctgtcctttcaggccttggccgcttccatctgacgcagctgcttgtcggtgtagaacgggtcgccgccgacttcctgatcatcatgcttgatgacgaagaagccgtaaatcagtgcgcacagcacgatggcagagatgacccagaaggtcacgcgggatcccatgtcgttgttcggcagaatctgagccatcttgtcgtggaaggcacccagaggggtcgagaagatgacctgacccacttgggaagcgatctggaagcccaccatgtacagcgtggcagagagcttggtgtcgaagtgcagagtgaagtagcggaatgccggcaggcagaacagcggcacttcgatggagtggaacagcttgacgatggagacggtgatcgggtcgtggaacacgccgcacaagccgatgcgcaggaacatcacggtagcgccgagcagcagagcgttgcgcacgccgatcttcttcatgatgatcgggaccacgcccatcattgcggactcaaggaagacctggaaaccgttcagggtgccgtaggtggcgttgccgatttcttcagtggggaagaggttggcgtagtaggtcgggaacatctgctgatcgaacacggtgtagaaggtgttggtcagcagcatgaagacgatgagcacccacagggtcggcatcttgagaacggcgaccatttccttgagggacgggttggtgggggctgcgttcgggtcggtttccttcttgagctcttccttctgctcggccgggacccagaaggcgtacacgaggagcatgccaaggccgaatgcggagccgacccagaagttgatcagcgggttgatgttgaacaggaagccggcgcacagcgccacgatggcgtaaccgaaggagccccaagcacgggactggccatattcgaaaccgaatttacgggagtagcgttcggtgacggcctcgaacagggagcagccggacatgaagccggcagacagaacgatggagccgatgagtgcgccgatccagcgggtggtgccaccggcgaggatcatcggggcgtaaacgaattggacgaatgggccaacgcaggcggcgattaccgagactacgatgacgagcttgcgcttgatgccgagctgatcctgaatcacgccgtacacaaacatgatgaccagggtggccagcgagttgatggagtagatggtgccgacttcagcattggtcaatccaacgcctgagatgagccagcgctggaagaaggaccaccagatgccccaggagcagaagaacatgaagatgccgaaagagctctgcagataggaaggattcttccatgcagatttggttgcacttgccataatcatcctttgattactacttggttggttattggttatgtaacgcttctgctcgggcggccgtgcctttgtagaagttgttgcgtagtaattattatgcgacgtcaatcgatttacgtcaatcgattgacgtaaatcggcgtgtcgtatccgttcgacacgcaaaaggcctccgtgctgaacggaggccttgagaaatcgtgtgggactcggttacttcaccgaggccttttcgatcagcgtgcagtggatcttcgccggaatcggcgcgtcgatcggcggcaggggagcggtggtcgctggccatgagacgtcgtccatcgagcgtccttcgataatcgacaccagcttggccacggcccagtagcccatctcgaaatgcggcagttccacagtggtgagcatcggttccagcgtttcggcgaacacgcgatggttgtccacgccgaccacggagatgtccttgccgaccgtgagtcctcggcgtgcggcgcattcgtacacataccaggcgcgggcatcgttgaagcagaagaatccgtccggatgctcggcatcgaacaaatcgctgactgcggtcagtgccggcccgttgttgagcacattgacgaccagatgatcgtcatagtcgaggccggcgtccctgagcgccgcctgatagccttccaaacgatcgtcctgcgcaatcagcggctccaagcaacccacataggcgatacgtgcgcatccggccttaaccaatctggtggtggcgtcgtagccgatttggaactcgtccggttccacgctcgggattttgccaagcgagtcggtggcatccaccaacaccagtggcgtcttggccagcgaggaaggcacatgggtgatgcggttcgacatcttggcgtacagaaagccgtcggtgccgtatcgcttgagtgcggcgatttcctcgctctcgctgttctcgccgtcggtgctcacggtgatgagcatatagccgaactggcttgcagcggtctgcgcgcccagaatcataccgccggcgtacggggtggtggccacctcctcactgatgaaaccgaggatgtgcgtcctgcctgtacgcagcgaactggccagcggattcgactggtagccgagcttggtggcgatggcgcgcacattgtccgcaattttggactttacgcgcccctcgtcgcgtccgttgagcaccagcgataccgtagagacggaaacccccgccttgttcgcgatttccttcatcgtaaccatgcgtcaaacgatacaccctaattgacggactgccaggaaagtatcagttttctccaccgactccgccgaggttgcgcaccgcaccgatgaataatggtatgccgtccggggtgacgtacgaatacagaaatgggcgatccaccgtgaactcgacgttgtccaccggcgcgctaacggagtctgcgccgaccttggtgaaggacatggccttggcgccggcttcgttcacctcgatgcgcgtgccttgcagaatcgagccgatatacaggttctcgccgtgcgaaccggtgtcgatcatcttggtgaagtcggcgtcgcctgcactgaacgcatcggtcacccccagtttttcgaatgccttgatggtggcttccgagtcgaacatgctgtcgatggtgaatcgcggtagcgtgacgttcaccatgaccgagttgacggagacgccccatccgggcatactgtccgcggcgcaacccattgcgccctcgccaagggaagccgtcgagcatgtaccgaacgcccaactgagcttctcggcatcgccggccaactcgtcgaaatgcccttcggccggcagcacgatggccagattgccgccgttgtcgaacggaatctccacccgctgccaagtgttgtactcatcatgtccgtaagccatttggctgaaggtccggtgcatcatcggcacctgagcatctccggcttcgccgtggaaggtgccgttgccggtggactgctcttcgaacggatccttccaacggccatccgcatagacggtgttgatgatggacaggacttcacggtcacgcagcgtgatcttcggcttgagcgaaccattcgtatgcttggcgatccaatcggacatctttgcggcggcctgatcgtcgaacggtaacgtggtgacttcggcctcgaacatcttcttgacggtggattggtaatcgctggcaagagagtagtcgtcatcaatccacagcgagttcgcggcgctcatctcggatttcgcccccgaatattgcccgttgatcgaacttagcagcgattggtagtcgctatcggtcagcgaaccggagcccagcagttcgttcagttgcgagcgggtcgtgccattggcgccctgcgcggcgatggccaacgccatccacatcgaagcaggagagtagttcacattgccggtgcctcggtcgccggcttccatcgccaggaattccggtgcggtgcggtaggcgaaggttgcggtgctgttgactaccggctgcgtggcaggcgtggccttcggcttgaacatattgcgaaccaatgcgctgccatcgccggccgtccaccatacgccgccggcgacggcaaggacaagcactactgtcacgatggcggcgatacaagcgttacggcatttgcgttgtccgcgcaaccggtactgttccatcagttgctcgctcatggttggcccctttgcttggatcggctcgtgcatcattgcatgaaatcgctgttttcattatattgcggctttcccttgagcccaggaacggtatgggaaccccggccgtaagcgaagattggtccagccgaatgccagtggtccgatgattgcgctcgccaacgggaaagacagactgccggatcgtgtcgaaccgagtatcaagttggtgattcccaacaccaatggccagtgcagaaccataccggggaaccatacgaacaggtttttggcagccctgtcaagaacctcgtcgggcatgagatacattgatgagctccactgcagtagcagcaacaccgctatcagtacaaccatgccaatccaatgcgcgcggttccatgtgaacagtcgttgcatcccgcgctcggcggcggcattgcgcatatcgctcctgttgagcttgctgagtgcttgtgcacggttcattgccgtcctcctttaccgccttgtcaaggattgatgatgattccatcgtaaatcacgcaggaaatgtggaatgatagttgtcatagtgaccatgacgtgtcaggacggagtagttcggcgtcgggcacactgaaggggtgaatgtaatggaagaagcgcgcaaccgcaacatacgcatcggcattgtggacaatgacccatatgcgctgaaagtgttcggcgcgctaatcgaacgtatgtccagcgattttgccgtgatatagacctgcgatttgggtgctgtggccatcagccgatgcctgagccccaccaagcggcctgacgtgctggttacggatatgtctatgggcgcattggatcgcacgcatcaagtcattgatgtgattgaaggcaggggagaagcggcgcacagtgcagtgactccgcatgattcgaccgttgatgccgctcctggcattgcatgtgacatcacagacgctgattgtccgctggagacgcagacctatccaccggcaccggcctcaaccgttaccaacaattactagaacaacaaaacggcgccctgcatatcaccacgcaagacgccgaatggacattatcagcagttattccactgtgaggaaaccgatcacccaaccgacttctgcgcagtctccgcgccaaagaagccgacaatcagcatcgatgcaatagcaatcgcgctgatggccacaaagatggacgtggcaccaagcgaggtaagcatccagcccaccaccatcggcatcaacacattgagcagcttggccacggcgttcgcgaagccgacgcaacggaagcgaaccttggtggcgaacagttccggagcgtacacagccaccacggaagccataagcacgtacaggcacatcatgagcaggaagccaacgataattgcgctcacggtagaggtctggaaggcatacatcaaaccgaacacgccagtgaacaggaaggccggcacaatcgtgcgcttgcggccgatacggtcgataagcagagagccaatcaggcagccgaccggggcaccgagcatcatcaccgtggaggtgagcagcgagctggacaggttaataccacgcttgaccagaatcgtcggaacccaagaagtgaaggcgtaggagcacacgttcgtggcggccacagcaaccacagccacaagcaggcagatgccgagcgaacggcctccggcgttgcgggtgtcgctggtgtcggccttggcggctgcgtcgatcggttcggaaccgttggcctcaagctgcttgacgatggcgtcggcctcatcgtaacggccgcgcacggcgagccaacgcggggattcggggatgtcgcggcgcagccaccagatgatggcggccaccaggccgatggccacgaacagcggacgccaggaccagcgggggatgatccatgcacacagcagcatagcgattggcacaccgcagttggccacgagcgagacaatcgcgcaccagtggccacggcggttcatcggtgcgaactcgttgaccatggcgaagccggtgacgatttcagcgccgaggcccaggccggcacccagacggcacagggacagcacagccatgttcggggcgaatgcgccgaggaaggtgaagccgccaaacagcagcaggttgatttggtaagccacgcggcggcccttcaggtcaccgacgaagccggccagcagcgaaccgaccagcagacccaggaagcccgcggacataaaggtggaattttgcgcaacggtggaccagcgggtagccaacgtgctggaggcgacggcgctgccaatatatacgtcgatgctgtccatcagcatgccagcggcgaccagcgtcacgatgcgatggaacatcggggtttcatgtgcgcgatccatgcgcgagataatatcctgaaccttggcttgatccgtcacggtggtatgtgcttgtgcgttttccatagccgcgggattgccggaaatctgctgttcagcagcagtcatatttgagccctcttcttgcaaacctgcccgcgtgcaactgctcaatggtgttgcggcgagcgaactcttgattggactgtgtgttccgttcgccctcccattgtgtgggatgaacgacgtttgcgatccaagtcttgaattctacgtagcgagccaatcgttgtgagatagctcactacatggggcttaactataggttcgattttgtggcacgccgcgttgcggtcacatcgtgaacgataacagaggttgtgacgctcctatatatgccccacttacgctcttaccccgtcgaaagaaggcagaaccgtgattcccatggggcggtaaaacactcatggggcggtatttggcccatggggcggttagcggattatgcctttccgcagaatagagccgttttcgactaccgccccatgagggttttaccaccccatgggtgagctaccgccccatgaaacgtgtaataacaaagcatgcccttgctggtggaagcgatgctttgctacttcgcctgcttgtcggcgaggatctcatccaccagcttgggcttttcggtcagctggccggtgaagccggggcggatatccatgtgcagcaccagagaagtgcggtagccctgctcggcgagcttcttggcggcctcaccggccaccttgagcacgtcgtccagatcgccttccacgttggtgaacagggcgttggtttcctgcggcaggccggattcgcgaatcacctcgacggcctgagccacgtatggcgaaacctcggagcccacgccattggccgacacctgaatggcggccacggtattgaggtacggtttgccggtttccgggtcgatcggcacttcctgagtaacggcattacggtcaataatcataattctccttttattacttggctcccctcagagaggagagccagtaggactcagcgatacttccagaaatgatccatcgggccggagccgtggccaagattcagctgggccttcagcgcaccggtcagatacttcttcgcatgcttgatggccttgggcaatgtgtcgccaagcgccagatacgaggcgatggcggagctcagcgtgcatccggtgccgtgcgtgttcggattattgatacgcgcgccatcaaaccaggtcacggttccatccgtctcggcaagcacatcgttggcatcctcggtgccatgaccacccttgaccagcgcggcacagccataacgctccacgaggcggtgggcggcggcctccatatcctcctgatcgcgaatcagcgtatcggtcagcacttcggcctcgggaatgttcggagtcacgaccgtggccatcgggaacagcttgccagtcaaggccgcaatggcatcgtcactgatgagattggcaccggaagtggccaccataaccgggtcgagcacgatgttcgtggcgtgatggaaggtgagtcgttcagcgatgacgtcgatgatgtcagtggcagacaccatgccgattttcaccgcgaccggcggaatatcctcaaacaccatgttgatctggtcggcgagaatgtccggtttggtgtcctgaatggaacgcacgccggtggtgttctgtgcggtgagcgcggtgatggcgctcatgccgaacacgccgcaggccagcatggtcttcagatcggcctgcatgccggcaccgccggacgagtcggagccggagatcgcgagaacagcgggaagtgtagatgttgcaatttgtgccatagtgttcattctaagtggggcccatgatgtttttcggagcggttttccttgatgttttgccgctcctgtggtgagacggggaaggtttgctgattgcaattgattcatgaaatgttcgggaggaggcatggctgataacgatgtactgcgccgtgacggcgtcttggtgcgcatcaccggaactcaccgcatattttggcgtaatgcctaacggacacaccacacagctcacatttccgcgtcaggaagtgttcgatgtgggcgacgtgttgctcgtcggtacggatttctatcgcaaagtgccgcatgatgtgtggccgttgaagccccgtgtgggcatcgtgcgccgtgcgctcaacgaaggcgtggtcctggagacttccgacggcctcggtccagatggcgcacacttcggcaccgccttcgagcgagtcgagcgtcgtcccgaattaagacaccaccgggcataataattggctcccctcagagaggggagccagagaggtttactcctgggcggtggagtagagcttgccgccctgggcggtgtacttttcgctcatcgcatccatgccggcgaggatttcttcggggctgagcacgttggcggacaccacgccgttatcgacattggccttggccgtagccagtgcctcggagtcgatgcctgcagcagcctccttcacgatttgctgctgagcggcctcgccaccgaatgccttgcggatgttctgggagatggccatcgagcagaacttcgggccgcacatcgagcagaagtgcgccatcttggccggctcggcgggcagggtatcgtcgtggaaggcgatggcggtgtccggatcgtaggacagattgaactggtcgagccaacggaactcgaagcgagccttggaaatcgcattgtcgcgatccatcgcgtgcgggtggtgcttggcgatgtctgcggcgtggcaggcgatcttgtaggcaatcacgccctgcttcacatcatccttgttcggcaggccgaggtgttccttcggggtcacgtagcacagcatagcggtgccgtaacgaccgatctcggtggcgccgatagcggaggtgatgtgatcgtaacccggagcggtatcggtggtcagcggtccgagggtgtagaacggggcgttgtggcacacggccttctccagctcgatgttcatgcgtacggtgtcgaacggcacgtggcccgggccctcgatcatcacctgcacgtccttggcccaggcgcgctcggtcagctcgcccagagtcatgagctcggaaagctgcgcggcgtcgttcgcgtcggctagggagccggggcgcaggccatcgcccagagagaacgccacgtcgtacttggcgaagatgtcgcacagctcgtcgaagtgcgtgtacaggaagctctcctggtggtggcgcaggcaccagtcggccatgatggagccaccgcgggagacgatgccggtcacgcggttggcggtcagcggcacgtaacgcagcagcacgccggcgtggatggtcatgtaatccacaccttgctcgcactgttcgattacggtgtcgcggaacagttcccagctcagcttggaggcatcatcctcgaccttttcgagggcctggtacatcggcacggtgccgatcggcacgggggagttgcgaagaatccactcacgggtggtatggatgtcgttaccggtggataggtccatcacggtatcggcgccccacttggtggcccacgtcagcttctccacttcctcatcgatggaggaggtgacggccgagttgcccatgttggcgttgagcttggtcaggaaggcggatccgataatcatcggctcggcctcggggtggttgatgttgcagggcatcaccgcgcggccggcggccagctcggagcgcacgagctccacatcgcagttctcgcgggtggccacgtactgcatctccggggtgatgatgccgtggcgggcgtaccacatctgggtgatcgggtggtccttggcacgcatcggctcatgcttgcgtccacgccattccttggtggcgcggccgcgcttgatggcgcgcttgccatcgtcctcaaggttgcggcggcggccctcgtagtcttcgatgtcgccgcggtcgcggatccagtcgagacgcaggggcttcaagccttccttcgggtcgcacttggggccttcggtgttgtagtcgtggaacggcgggttcgggcccacgccgggcgtgtcgctcagcttgatttcggtgtacggcacttccaggtcgtaggaaccatactgataggtgaacggtacggacttggtcttgcggatgtgcgccttgtcgcgctgcttggaaccacgggcggcgatgtccacgcgctgctgcttggcaagcttctgggcatccttggcgtccttggcgttggtgaacttcttctcagtggcctcggaaccgggcttcgcggccccttcctgagcagcctgagtgtcagtagcgggggtgtgggttacgacgcgcggagcgtagccgtgcttcttgtcgccgcggacggccttccagccttcgaccatggtgcgcgcggcctcttccgggttctcggcacccgcgatggcggagaccacgaaccagccagcagccttggtatcggcgagcatggccatatcggctgcggtcacgccgccgcccacgaccaccgggaattcgctggcaacgcagatggtgttgatctgggcggcgtccagcgtcttgccggagccgtcgttgccgcccacggaagcctcgggcttggtggtggagacgtgcagaggaccggcgccaatgtagtcgatgcagccgtcgggcagctcgttgatgagccgaacgaggctttcggtctcagccgacaggcccacgatggcctcgtcgccgagcagggcgcgggcttcgcgcggctccatgtcggtctggccgatgtgcacaccgtccaccttgatgcccttgcggcgggcctgccacaccacgtcggcacggtcgtcgatcacaaaggccacggaatcggacttctcattgtcctcgatgatttgcgcgatgtcgcgagccatgtcggtcagctcagaggcatcggcctccttggcgcgcagttggatgaaggttgcgccgccgtgcagagcctgatccaccacgtcggtcagcggacggcctttgcagtcctccggccccaccacgaagtacgcggacaggtcgaagctgtcgcgcatggaggcgtataggtattcattactcattattattcctgcttttgttgtttcttgtggaagtcttattggaaaaaactgttatgagctccctcatcagagggaactgaaactactgcaccaaaatctcggattccgccacctgttcggcggtcacattccacagcgcgtcaaggaacgcaacttggaacgagcccggtccgtacgaagttgtatcggccacctctcccgcgcggttgtacagcagagacgcggacagggcggcggtcaacggatcggagaccgccaaatacgtggcagccacgccgcccagcgagcagccggcaccggtgatcttggtcatcatcgcgctgccgcccggcagtcggtacacggtttcgccatcggtcaccagatcggcgatgccggacacggccacggcgcagcgggtggaagcgtcatgggaggaatgcttggcgtgctgttcggtcagatactgtgccagcgccaccgccgcgccggttgcggactccacgtcgtcgacggattccactccggcggggcggtgctcggaagcgtcccccacggtttcggtattgagcccccacatgttcgccagcgcgattacctcggatgcattcgcgcgaatcatggtcgggggagcggccttgaaggcctgaagaatggcggtacgggtgcggccgatgccggcggccaccgggtcgagcacccacggcttgtccaagtagttgagtcgctgggcgatttcgggcagtgcgtccttatagaacggcagcagcgtgcccacgttgatgtagttcgcgcccgcgattttcgcggtttcgatcacgtcgtccggcaggaaactcatggccgcagtgccgccggccgccagttgcgcgttggcaaccaaattgatggtcacaaaattggtgaatgactgggccaacggagtcgtctcgcgtacgcggcgaacggcatcggcgatattgtcacggatgggtgaatcggctggaaccggagtcccggcggtataaccgctggacacgccggtaaacgatgatgcactattgctcatttactgctccctacgatggtcttaaccaacaggttctaagggtcaggctcaggcctttctcaactcgcgaaccacatgcgagttcccctgcattacagtgccgacgctatgcgccaacatggacattatcgtgacggatttgttcgatacgtgtcgtcaggtctggcgcgtccccgtccattcgtgatacatagacgcctccgccgagcaacatctcccgaatttgtgacgctgacgcgatgtcagtggcacaaattcgggaagggtaaaacaacaggaacaatatggaggtgttgcgatataggaatcgctgcgaacggtcgctcgtgagacgcggaacatataccggacaatgccgcctgacctgtcaccatatacggctatcctgaagcggttgttattagaccccaaaccgttcaaaccagaaggtgcattgtggctcagtccaaactcgatgaagtcgtatcccttgcgaagcgtcgcggcttcgtgttccccgccggcgaaatttacggcggcacccgttccgcttgggattacggccctctcggcgtcgctctcaaggacaatatcaagcgtgaatggtggcgctccatggtcgtcacccgtcctgatgtcgtcggtgtcgacacttccatcattctgccgcccgaagtgtgggtggcgtccggccacgtgagcgtgttcaacgatccgctcgtcgagtgtctcaactgccacaagcgcaaccgcgccgacaagctcgaggaatcctacgccgagaagcacggcgacaagatgccggaaaacggcatgaaggacatcgtctgcccgaactgcggcacccgtggccagtggaccgaaccgcgcgacttcaacatgatgctgcgcacccacctcggcccggtcgaggacgagaacagcctgcactacctgcgtccggagactgcacagggcatcttcgtggacttcaagaacgtgatgacctcttcccgttccaggccgccgttcggcatcgccaacatgggtaagtccttccgtaacgagatcaccccgggtaacttcatcttccgcacccgtgagttcgagcagatggagatggagttcttcgtcacgcccggcaccgatgaggaatggcaccagtactggatcgacgcccgcacccgctggtacatcgacctcggcgtcaagccggagaacctgcgccactacgagcatccgaaggagaagctctcccactactccaagcgcaccgtggacatcgaatacaagttcggcttccagggttccgactggggcgagctcgaaggcatcgccaaccgtaccgattacgatttgagcgcgcactccaagcactccggcgaagacctgagctacttcaaccaggccaccggcgagaagtacgtgccgtacgtcatcgaaccggccgccggcctgacccgctccctgatgtgcttcctcgtggacgcctacgatgtggacgaggccccgaacaccaagggcggcgttgacaagcgcaccgtgctgcgtctcgacccgcgtctggccccggtcaaggccgccgtgctgccgctgagcaagaagcctgaactgcagaccgtggcccagaacctggccgacgacctgcgcttcaacgagtggatgatcgactacgacgagtccggtgccatcggtcgtcgttaccgtcgtcaggacgagatcggcaccccgctgtgcatcaccgtggacttcgacaccctcgaggaccacgctgtgaccatccgtgagcgtgacaccatggcccaggagcgcgtcgctcttgacaaggtggccgattacgtggccgcccgcatcggcgagaagcgcacccgcgtgcccctgaagcctgtggaaatgggcggtgagccttggcctgagtccggcgttcaggaagccggcggcctgtactaagccggagtcgcacaacttgggctcccctctgtgggctgagccgtaaggaagacatcccagtgggctgtttgtaggcgaagtggcggcgatagacgccggggctcctctctcaggggagcccctacttattttcttaggaatcacatggcacaatccgaatccgaaacagtgctcaccgagcatcacgagaccgacaacctcgacccacgtacggacgcgccggcgcgccccgggaccccggtgcatatcgccccggtccaactcggcaacatcaccgtgccgaccccggtggtgctctcgccgatggcgggagtgaccaactggcccttccgcgtgatttgcgaggaatatggtcccgatggactctacgtggccgagatgatcaccgctcgagccctcgtggcgcataacccgaaagcactgcgcctctgtcatttcgccaaaagcgaaaaaatccgttcactgcagttgtacggcgtgaacccctccatcaccgaacaggcggcgaaaatcgtggtcgacggcaacatggccgaccatgtggatctgaacttcggttgcccggtgcccaaggtcactcgtcgaggcggtggttcggccttgccttggaaaaccgacattttcactgagctattacagcgcgtggtcgccgtatgcgagccggcgggcatccccgtcaccgcgaagatccgcgtcggcatcgaccataaccatgagaccttcctcgaagccggacacatcgcgcaggaggagggctgcaaggccgtaaccctgcatgcccgtaccaccgccgaatactatggcggtcattccgactggtcccgcatcggcgagctcaaggaacacctcaacattccggtattcggcaatggcgatatctggggtgccgaggatgcgctcgaaatggtgcgcgagaccggctgcgacggtgtggccatcggccgcggatgccagggccggccgtggctgttcgccaacatcaaaaacgccttcgagggcaatcccgaacggctcaacccgaatctgggcgaggtctgccgcgtgattcaccgtcatgccgagctgcttaccgagttttatgagggcgatgagatgatggccgtccacgatctgcgcaagcacatcgcctggtatctgaaaggattcccggtgggcggctccacccgcaaggcctttatggaatgcgagagcctggccgatgtggaccgcgagatcggcaagctcgacccgactatcgaatacccgccacgcgtggtcgacaaaccgcgcggccgcgtgcgtttcgccaagaaggtgcacttgccgtatggctggttggaatcgcgtaccaccacccacgaagagcgtgaggcgctcttcggtgacgacccaatggacgccagttactgagaaaatactgaaaatacacgcaacacgcgccattctgcgcgtgaatttccctccaagagtagcctgtttgcgctactcttgggtgtaaccgtgaagtgacaggagccaaacgtgagcgagatcgcgcagaatgagttcaacgacaagaccaacatcaaggttgttggcgtcggcggtgccggcggtaatgccgtcaatcgcatgattgccgagggattacagaatgttgaatttgtggcggtaaataccgatgcgaaggatcttctgcgctctgatgcggatgtcaagatttccctttccgataagtccagtcgtggtctcggtgctggtgccgacccggagcgtggagccaaggcggcccaggaccaccagtcggatatcgaagaggcgcttaggggtgccgacatggtgttcgtcacctgcggcgagggcggtggcaccggtactggcgccagcccgatcgtcgctcgtgcggctcatcaacagggtgctctcaccatcgcggttgttactcgtccgttcagcttcgaaggccctcagcgttccgcttccgccgaatacggcatcgacaacctgcgcaaggaagtcgacgcgctgatcgtcattccgaacgatcgcctgctcgagctttccgaccgttccatcggcatcattgaggccttcaagaccgctgataccgcactgcttgccggtgttcagggcatcactgacctgatttcgatgaactcctatattcacgtcgacttcaacgatgtgaactccattcttcgtggtgctggtactgcgctgtttggtatcggttccgcacggggagaggatcgtgccacgcaggccgccgaaatcgccatcagctctccgctgcttgaggaaagcatcgaaggcgcacacggtgcgctgatcaacatcgccggtccgaccgacctgaagttgcaggaggcctctgctgccaccgaactggtgcgcaaggccattcaccctgaagcccagattatttggggtcttgctctggacgatgcttatggcgatgaagtgcgtgtcactgttattgctgctggttttgaccccgtcgccgctcaagatgacgacactcagagcacggtgacgccggttgtgccaaccgccgccgatcctgcgactcccgtggcacagccagctccagcaccggcaccggctgcacagcccgctgccactgcccaaccggcattcacaccggctaccggtgactccgcatcgttgccttttgatgatccgacttccgctcatccgaatatcgccgtgaacgatccggctggcgatctcgacatccctgacttcctgcgctgaaaggattgatccatggctgggttcatgaaaaacgcgatgtcctatctgggcatgagtgacgttgtggacgatgaggacgactacatcgaggaggacgaggagcagaagccggcttcgaagtccgcatttgattccgaccatacggtcacgccgctggcgtcaaccaccgcgcctgccgcatcgtcgactaccaagccgttccccggtggtcgtgtgaacagaatcaccaccatccatccgaagtcatatgaggatgctcaactggtcggccgtgcattgcgtgacggtgttccggtcgtactgaatctcaccggtgtggccgaagccgtggcatatcgcatcgtggacttctccgccggcgtggtgttcggcgtgcgtggttccctcgagcgtgtcactccgcgcgtgttcctgttgagcccggcgcaggtgaacatcaaggtcgaagagccgacaaaaccagcctcggcacacgatttgttcgctgactgaccggttcagtagttttcgcattcgacgttatatcggtattcggccgactcccagcaaggagtcggccgattcttattgtgctccgagcaaacttttcatgcgcggttgttagtctgtcagcatgctttccttagtgttctctttgatcggccgcattcttgcatggctcatcaacgcgtatatcacggttctgttcgtgcgcatgattctggactgggtctccgttctcgcacgaaactggtatccacgtggtgtggtggcccagctgatcaatattgtgtattccattaccgaaccccctctgcgctggctacgtcgctatattcgcccattgccgctcggttcgatttatcttgatgtcagcttcattgtgctgtattttgcgctggtggtactggaaagtgttgttctgatagtgttctgaggccgtttttgacccgccggaggcatatatctggcataaaaacccacgtcgaatgttctgaaacgatggggtcgtgatagcattctgacttgagaccaacgtaagtgcgggcgatgccccaaagcgaggtgcaagatttatggctctgttgacgccgaaggatattagggagcataccttccagactgttcgattcaaggaaggttatgatgtcgacgaggtcgatgacttccttgatcaggtcacggaaaccgtcgaggctcttggacgtcaggcggtagccggcggtcaggccacccagtctctgggtcctgacgtgaccaaccttaatgcgaagatctccgatcttaccggtcaggtgcagcaactcgagtcggagaatgctggtttgaagaacgctgtggctcaggcccagcaggccgctcaggctggcaatgatcaggcagcacagcttgtctctgccaagctcagcgaagccgaggaatccaaccgcgcgctgtcctcccagaatgagcagctcaagggtcaggtcgatcagctgaacgctcaaatcgatcagctcaccgctcaggctgctcaggcctccggtgaccaggaggctgtcggtcagcagatcgccgccattcagcaggaacgtgatcagttccgcgcggccaacgaggagctgtcccgtcagctcgccgctgctcagcagcagggttccgccgctcagcagcagtccgctcagatcgctgagctgtcccgtcagctcgaagaagccaagcagcgtgaaaaccagcttcgtgctcaggtttctaaggtcgagccgagcaccgagaccggttctctgcagaagatcgctggcgccgcttccatgccgggcaccgagcccgagcgcgccaccgccatgctgaccctggctatgcagctgcacgatcagtacgtggagaagggcaagaacaaggccaaggaaatcaccgaggccagccagaacaagtacaacgatctggtcaccaaggccaacaactactccgagcgtacccgttccgaggccgacgactactccactcgtactcgttccgacgccgacacctattcggatcgtacccgctccgaggccgacgcttaccgtgaccagactcacgcggatgccgagacctactcccagaacacccgttctgaggccgacgcatactccgtcaagactcgtcaggatgcggacaactactccaagtctcagcacgatgacgctgacaactacgagaaggaagtgcagcagcgtgccgccgagtatgacaagaacactcgttccgcggctgatgcgtacgacaagaacacccgctctgcagccgatacgtatgccgagcaggtgcgcgacaaccttcaggctcagtccaaggtcgtcgagggcaacatccagagcctcaagcagttcgagactgaataccgcgcccgcctcaccgagtacctcggccagctggcatcgcaggtttccgagtcgaacaactacgtcgaccagacctcgtccaagaccaactgagcgtaggcaggtacaggtcgtatgacgaaccaacagggacggctgcgcacccgcgtggccgtctttgcatgtgtggccgcggctgcgctgattgtcgatcagctcaccaaggcttgggcgatggccgcgttatccaacggtcagaccattcgcgtgattcccggactgctgtccttcaccttggtgcgtaatccgggcgcgtccttgggcatgggatcaggcgctacttgggtaatcagtctgttggccgttgtggcttgcgtggcccttgctgtggctggggtgcgcactgtctccatgaaatggtcggtggcgatttctttcgcgtttgcaggcgctctgggcaacctgattgaccgtgttatgtacgctgacggcttcctcgacggcaaagtggtggatttccttaactatggctggtccgttggcaatgtggcggatatctatctggtagtcgccggtgtggtcctggtgattctgattcttatgggggagccgttctcacacaaggatctcatcgagcaatccgacgaatccctacagtctgagccggaggcggacgccaagtaatgagtcgaatagtccctgctcccgatgcattggtgggtaagcgtttcgacgtagccgtggccaaaatgctgggtatttcacgatctaaagccgccgatctggttgactccgggcaggcgcgcgttttaggacgtgaagttgcgcggtccagcacattgcaggcgggggagaccgtcgaatttgatttggcggaggaacaggccgagcctgagcctatcgcaactgatatggccgttgtctacgaagacgatgatgtcgttgtagtcgataagcctgtaggcgtggcggcgcatgcctcggttggctggaccggtccaaccgtgctcggatcactgcgtgaccgcggcgtgcatatcacttcctatggtgcggccgggcgtgaaggcattgtttctcgccttgatgtaggcacttccggcttgatgttggtgtgcaagtccgaccttgcgtacaccgagatgcgtcggcagttcgccgagcatgaggtaaagaaaacctatcatgcgctcgtgcagggtggtcttaaagagaacaaagcaaccattgaggcaccgatcgggcgcgccaaagtgtccgatttccgcttctgcgtgactccggccggcaaaccggccgttacgcactgggatgtgctggagcgtttcggccatgaggccactctggtatccgtgaatctggagaccggacgtactcatcagattcgcgtgcatttctcctcgattgggcatcccctgtgcggcgaccccatgtatggtgccaatccggtgctgtctgaggccttgggacttgaccggcagtggctgcacgccatgaagctcgaattccgtcatccccgcacccgcgtctggaccacggtccggtcccagtacccggccgacttggctgccgcactcgatgccatgcgtgcccgacacatcgaacccgctgaacctgccgaatatgccgaagttctggtggactaattccgcgacgtgtgcatcatgcgttttaatatttagattcagttccggcttcgccggattcatcccagaataacgagagatcggtcatgatggctctccgtcatgaccataccccaagtgactgcggatgctgagtaccattcagtccaatggtcggtaaccgtacgtgaattaccggtatttccgctcaacgtgtctcggtactccagcgtgaagtgaacagaaatgagccaaagcagtaatgaagccgggcggtatatgccatccggattgcagaatctcctgctgataaaaaccgtttcctagtcgttgaccgtgcccgttccgacgacgatcgcggcctacgacgcgttcatcctctacccggcccaccgatacgacatcaagggcaagaggattctcaagcaggaaaagaagtactatgccgtggacttggggatgcgacgtatcctgtgctccaacaacgtgcgggacatcggacgcctcctcgagaacgtggtgttcctcgaactgatgcgccgcgagggcgacgtgtatgtcggacagagctccggcagcgagatcgacttcgtcacgaacgggccaggcggacgtcggtactaccaggtcagcgaatcggtgcacgattcggcgacgctggattgggagccgtcctcgctgcgcgccgtgcgtgacaactatcccaagacgctgattacgctggatgacgaacggccctactcccacgaaggcatccgacagatatacgcgcttgactggctgttgaacgaagaccacaagaaacagtagatactagggcggccagcgggttagcaagacatcagttggtgaggactgctgacattgcactccgacggatgaattgaatactcatatggtatccgattctgaacaattgagtgggggcgttgatggttgccatcgtttgagctggctaaatgcgatttcgcgccatgctgtttcaacaacggtggcaacagctacagttgaactatgcatgggttgaagagtgcgattgacaggggagcggacgcgtgggcacgttcgctgcctgggcgcgtgctcgaccggtatgtgtcgcggagcggccccctgctggcgaatggtctggcatatggtctgctgttcgccttttttgccggcgtctggattgcggtgagcgtgttcggccttatcatggtcggcaacattgattggcagcagatgctgattgacgcggtgcgtgaagtcattcccggtgtggccgactcgtttctgacgtcttccgcgctaggcgccatgtcaagcgcattgacgtggaccggtctggccacgttggccatattctggtggacagtgaccggctggatgaactcgctgcgccacgccgtacgggccatgttcgacgactgcggcgacgagctcaatatcgtcgtcgcaaggttacgcgatacgcttgccgccatcgccatcgcaatactgttcattctttcgaccgcggccggtacggtgtccggcggcatcgtacgccgactgctgcaatggggcggcatccccagcagttcgttgcccggcatcgtgcttttggagatgaccggtttcggtaccggtgtcgcgctgaatttcgcgttgttcatgttgctgctgcgcgtggtctcccacatcaaagccggacgattcacgatactcggcgcgttactgggatctctgacggtttccgcaatgcagcttctcggtgcgcgactattagccggagcctcccggaatccgatgcttgccccgttcgccgcgttgatcggcgtgctcatttggttcaacctcgtcgcccaggtcattttgctctgtgccgccctcattgccgagtgccgacaaaagagctgagcgtctgaactgactaatatgacgattagcgatgaagcctctctcgccgagatgattcgcgaactcagctggcactacagttattgccgtggtctctccatcttggcatatcgcaaacgagtagcttcacccgtgataccgagcttgcgaccaattgtttcccatgattggccacgttcatgcatgagcagtaccatctgcgcaatgcgggcatcaatgtattccagttcggctttgcgtcgattgattagacggctgagctccagttcgggagagaagtttgggctgtcctcgggaatgccttctgctggtgattcctgagactccacggcatctgccgcagcgttgccgatttccatgagtttggcctgtatctcgggagagtagtcttcaaatttcatcgttatcactgccttagtgtcgctgttgctgatactccactttataggcatgtggcctcaccggtaaatatttaccgctgcccagaccacacggtatggtggagcgcatggctgattacgggaacaactttgtgcaactgcataaccatacgcactattcgctgctcgatggtgcgtcgaagattcctgatttggccaagcgtgcggccgaacttggcatgcctgcggtcggtatcaccgaccatggcaacatgcatggcgcctacgagatgtacaccaactgcgtggccaatggcgtcaagcccatcatcggcatcgaagcttacgtgaccccggaaaccgcgcgtcaagacaagtcccgtgtgcactggggcaccgaagcccagcgccgcgacgacgtctccggtggtggtcttatcacccacttgaccatgtgggccgaaaacgacgaaggcctggtcaacctcatcaaagcctcgtccgtggccaacctcgaaggtcgcgtcatgcgctacccgcgtatggataaggaggtgctcgccacctattccaaaggtgtgatcgcctcctccggatgcccttcgggcatcatccagactcgtctgcgcctcggtcaattcgaggaggccctgcgcgccgccggcgaattccaggacatcttcggcaaagacaacttcttcatcgaacttatggatcacggtctgcccatcgaaactcaggtgaccggtgacctgctgaccatcgccaagaaactcaacgcaccactgctggccaccaacgattcccactacgtacacgccgaagatgccggcgcacaggacgccatgctctgcatcaactccggttcccgtcttgacgatccggaccgattcaagttcgacggcaccggctactacatcaaaaccgccgaagagatgcgcgaactgttcaaggaccacccggacgcctgcgacaatacgctcgttatcgccgaacgctgcaacgtgatgttcgacgaccacgaagacggcgcgttcatgccgaaattcccttgccccgaaggctgggatgagacctccctgttcctcaaaaaagtcgaggaaggtctggagaagcgttacgacggcaacccgccgctcgacgtattgaagcaggccgactacgaatgtggtgtgatttgccagatgcagttctgcggatacttcctcgtggtcgccgactacattcagtgggccaaggaccacggcattatggtgggtccgggccgtggttcggccgcaggcgccatggtcgcctattccatgggcattaccgagctcgatccgctcaagcatggcctgattttcgagaggttcctgaaccctgagcgagtgagccttcctgatatcgatgtcgacttcgaccctgaaggtcgtgcgcgagtcatcgaatactgcggcgaaaaatacggcaccgataaggtcgcccagtgcgtgatctatggcaccatcaaaaccaagcaggccctgaaagactccgcccgcatcatgggttatgaattctcagtcggtgaaaaaatcaccaaggcgctgcctccggcggccaccggcggcaaagacatcagcctgcatgacatcttcgacccggccgccaaacgttatgccgaggccagggaattccgagaactctacgattccgacccggacaccaagcgcatcaccgaggaagccaagggtatcgaaggcctgatccgacagaccggtgtacatgcctgcgccaccatcatgggtagcgcacccatcaccgacacctcgccgttgctggaacgcaccgatggcaccatcaccaccaccttcgaataccacacgtgcgaaacgttggggctggtcaagatggacttccttggcctgtccaacttgacgatcatccacgacaccctgaagaacatcgaggccaacggcaaacccgccatcgactacaccaagattccgctcgatgacgccgaaacctacaaactcatgtcccgaggagacacgctcggcgtgttccagctcgattccgacggcatgcgttcactgctgaaaaccctgaagcccgataacttcaacgatatttccgcacttatcgccctgtaccgaccgggcccgatgagtatggattcgcacaccaactacgccaagcgcaaaaacggcctgcagaagatcacgccaattcaccctgagcttgaggagcctctgaagcaggtgcttgacgagacctatggtctgatcatctaccaggagcaggtgcagtccgccgcccgaatcctcgccggttattcactgggcaaggcagacgtgctgcgtcgagccatgggtaagaagaagcccgaagtgctggccaaggagaaggtgccgttcttcgccggtatgaaggagcacggatattccgaagaggcctcccaggccgtgtgggatattctggtgccgttctccggctacgctttcaacaaagcgcactccgccgcatacggtctgatctcctactggaccgcatatctgaagacgcactacccggtcgaattcatggccgccctgttgcaaggtgccgccaccaacaaagacaagaccgcactgtacttgggcgaggcccgccgcatgggcatccaggtgctctcgccggacgtcaacgaatcggtgtacgagtactcggcagtcggcgacgtcgtccgattcggtcttggtgccatccgtaacgtgggtgacaaggccgtggccgatatcatcgccgaacgcgaaggcccgcgcggcaagttcgtgaacttcatggacttcatccgccgcgtgcccctgaccgcgctgaaccggcgattggtcgaatcgttgatcaaggccggtgccttcgactcgattgacccgaaccgtcgcgcgctgctcaccgtgcacgaggccgccatcgattcggtggtgagtctgaagcgcaaacaggcggagggccagttcgatttgttctccgatgccgaggatgggggagcggaggccatgggcgacgcttccgtgaccgtacccgatcttgaggaatgggacaagaagaccaaacttaacttcgaacgcgaaatgttgggcctgtatgtgtctgaccatccgctctccggtatgcagtcgattctcgcgtccttgcgtgaaatgtccatcgcgcatctggttgatcgagccaaaacgatgggtgaaggacagcaggtcacgttggctggtttggtcaccaatgtggaccggcgcgtatccaagaagggcaacccctgggccatcgtgaccatcgaagacatggaaagctccatccaatgcatgttcttcggcaaggtctatgaagcggccgccgccgaacttgccgtggacgccatcgtacagattcgtggccaagtggagttgcgcgacgaaaccgtttctctgagagccacggaaatgcagattccgaccttggaagccgaggatgaacgtccgttggtcatcacgctgccgtcggtggcgttggagcgccaacgcatgatgcaactcggtcaggtgctcgctaatcatcctggttactgcgaagtacatcttgcggtgctggatgagaagggtaacgctcaggtgctcacgtttggcgatcgtttccgcgtcaagcgagatacttcgttgtttgctgagatcaagattctgtttggccccagctgcttgcctgccgcctgattggcgggtttcgcccctggcctctccctcacctggctttgctgggggctccttcatcagagggagctaaggcgtgtgccaccatacgatgtgcgcgactactgtggaacgtatgggcatggagatagcggatactggtaacaacgatgacgagcaacaatggattgccacgatgctggaacggctgtctcattcgcagttccgcgccaaattcgctttgaccgacaaagaccgagcctatgcccgcaccaaaggcaaggcgaccatcgatcgtcatgcgcgagaaatgttgcgagaccgcataggcgcagccgaaccgaagaacgacggcagacagacgccatggcgcggccatccggtattcaccgctcagcatgctaccgccacatgctgccgcggatgcatcgaaaaatggcatcatctgcccaaaggccgtgaactcgccgaagcggaggtaaaccgacttgccgatttggtcatggcgtggattgaacgggaccttatcaatcatccggttcggtgaagcaccccgcatcctcagtatgcctgtatgccttcaatagttatgggccaacagccaacataggcctcgaaaaccgtagatgcaaggtattggcgaatgcggcagaacgccgaacgttgcctatagcgcgttcgtcaataatgcgacatgatgtctattcaagaagagttgatgaagtgtcaactctgccccaaggaggcggaatatgtactacagcagcggcaattatgaggctttcgcacgtccgaagaagccggccgacgtggacaacaagcatgcatacatcatcggtaccggactggcggcattgtctgcagcctgttatctggtgcgtgatggtcagatgcctggcgagaacatccacatccttgagaaggacccggtacccggcggcgcctgtgacggtcttgatattcccggccttggctatgtgatgcgtggcggccgcgaaatggacaatcatttcgaggtcatgtgggatctgttccgctcgattccctccatcgaaaccgaaggcgtcagcgtactcgacgagtactactggctcaacaaggaggacccgaactactcgctgtgccgcgccaccaagaatctcggcaaggacgcggggctcaagggcaagttcgggctgtccgacaaggcttcgatggaaatcatgaagctgttcttcaccccggacgaagacctgtatgacaagccgatcaccgatttcttcgatgatgaggtgctgaactccaacttctggctgtactggcgcaccatgttcgccttcgaaaactggcactccgcgctggaaatgaagctgtacatcaagcgctacattcatcacatcggaggcctgccggacttttccgcgctgcgtttcacccgctacaaccagtacgagtcgatgattctgccgatggtcaagtatctggaatcgcacggcgtcgaattccgctacaacaccaaggtcgagaacgtggaattcgcgattggcgggggagccggccccaagcgcgagcacaccggcgtaggccaagacaccatccagaagattcaggccacctccggcttcttcaagcgcaaccctgccagcacgcccaccaagaagcttgccgtgcgcatcgacgtggatcacgagggcaataaatcctccatcgacctgaccgagaacgatctggtgttcatcaccaacggcggttgcgtggagaactccaccatgggttcccagaactcgcccgccgcatggaacccagacctgaagcccggtggcggctgggatatgtggaagcgtatcgccgaccaggacccgagctttggacatccggagaagttctgctccgatccgaatgccaccaagtggatgagcgccaccgtcaccaccctggacggcgagattccgccgtacatccagaagatctgcaagcgcgacccgttctccggcaaggtcgtcaccggcggcatcgtcaccgtgcaggactccaactggctcatgagttggaccctgaaccgccagcagcagttccgcgaccagcccaaggaccagctgtgcgtatgggtctacggcctgttcccggacaagcccggcaactatgtgaagaagccgatgaccgaatgcaccggtgaagagatttgcgaggagtggctttaccacatgggcgtgccgaccgacaagatcgaggcgcttgcaaagcaccacgccaacaccgtgccggtcatgatgccgtacatcaccgcgttcttcatgccgcgcgcggccggcgaccgcccggacgtggtgcccgatggtgccgtgaacttcgcattccttggccagttcgccgagaccccgcgcgacacgattttcaccaccgaatactcgatgcgcaccggtatggaagctgtctacacgttgctcggcgtggaccgcggcgtgcctgaagtgtggggtagcgtctatgacgtgcgcaacctgctcaacgccaccgtcaaattgcgtgacggtgcaccggtcaccgatatgaagctcaacttcattgaaaaggccgtggtcaagaaggtgctcaagaaactcgacggcaccgatattgccaccctgttacgcgaataccgcgtaatctgacatccatctggctcccctcaaggtgaggggagccagcacgcgaagcgtgattgaggagagttgctcacaacggagtgttaagagaaagacaaaaacatgactgattctgatccccagttaatccgccacgccaccatcgacgatctggacgcgctggccgccatggaatccgaatgcttcccggccgccgaggccgccggccgctcgtccctgcgcgcccgaatcgagacctatccggaatgtttttggctattgattgatggcgagatcgtcatggcgttcatcaacggtttcgcgaccgatcggcgcgacttgaccgatgacatgtacgaggatgccgcgcagcacaaccctcaaggtgactggcaaatgattttcggcgtggatactgcgccgaagtatcagcatcgcggttgcgccagtacactcatgaggaaagtcattgaagacactcgtgcagctggacgtaaaggcctggtgctcacctgcaaagatcggctggtcggattctatgcgcaatttgggtatgaggacgagggcatttcggagtccactcacggtgacgtggtctggcatcagatgcgcctgaccttctaatccccctttggcttccctctttgatgctgggtcgtttaaaaaacagtccggtggactgtttttttagacgaaggcgagacgatagtcgagccataagggcgcgagctttgctcgtccgtaattgcgggtgagctgtccgcgtgatcggactgaggggagttgaacgtggaatgaattgttgcgacacgccggtgaacatctgatttcgttacgtgagcccataaaaagccggcgtatcctgatggtaacgcgtgattcaagctgatttcgacacgccgggcgaagcctgtcgtttcaacgatttgggcttatcttcgtgcgcccgatttgcgcgagtccgtgaatgcgtgtaagttatttccttgctgccgctcggcgagtggttctccttccggagggctgcgaggtgggtgagtggtggtggtttgagaactcaagagcgtgtttgtactacttctttatagtcaataactgttagaattacaggaccaacaagggtgttgcacttctaaatagacatcgggtcgggcgtttcgcgagggcggttttgctataattagtaatgcagaaagcggcaaggtaatacggcaaagaggccgggtcgctagaggttcccatcggatatggaagagcacgaggatgtgctggaaacagataacacagaagcggatgtggtgaaaagaaacataatgtaacctccttggcggtgcccccgtgtgacatagtctccgcgggggcacctgctgtgtggcgttccctttttgcgacgcattcccgggaatattgcgttgggagaatagttgggtgtgtgttttgcgacgcattggaatattgcgttgggaggagaggaaaagtacgggggcgcaggaggtccccaaaccagtgagttgtggcccggcgcgtcgttgtccggaggaatcgtaatataggtattcgtgtgtgccagcagcacgccttatgtaacaggcgagcatgctgggatatccttcaaaccgctgatcgcacgcagtaatgcgccgacgggaggggcgaaggccatcgggccggtggactgggctatcttttccgattcgtcgggtgccgccaacaggcggataccaagcgagtgtgctgaaaagtgtgggtgcagtgcggcggtcacacaaaagcaagagaaaccactgaatcggagaattcaagttgcctactattgaacagctcgtccgtaagggacgtcaggcaaagccgaagaagtccaagactttggccctgaagggcagcccgctgcgtcgcggcgtgtgcacccgtgtttacaccaccaccccgaagaagccgaactcggctctgcgtaaggtcgctcgtgtgcgcctgtcctcgggcatcgaagtcaccgcctacattccgggcgaaggccacaatctgcaggagcactccatcgtgctcgtgcgcggcggccgtgtgaaggatctcccgggtgtgcgttaccacatcgtgcgtggcgcgctcgatacccagggtgtcaaggaccgtaagcagggtcgttccctgtatggagcaaagaaggcgaagtaagagatatgtcacgtaagggaccttccaagaagcacgtcgtgctgcccgatccgatctacggttccaccgtggtggcgcagctcatcaacaagattctgcttgacggcaagaagtcgatcgccgaagacatcgtctactccgcgctcgatatggtcaaggagaagtccgaccaggagccggtggctgtgctcaagcgcgccctggacaacatccgtccgtccctcgaggttcgctcccgccgtgtcggtggcgccacctaccaggtgccggtcgaggtcaagccgaaccgcgccaacaccctgtcgctgcgctggctgaccgacttctcccgcgcccgtcgtgagaagaccatggctgagcgtctcgccaatgagatcctggatgcctccaacggcctcggtgcttctgtcaagcgccgcgaggatactcataagatggcagaggctaacaaggccttcgctcattaccgctggtaatcactcgccctgagtaaaactaaggaaaaagatggctgaagagatttcggacctccacgacgtccgcaatatcggcatcatggcccacattgatgccggcaagaccaccactaccgagcgtattctgttctacaccggtaagaactacaagatcggcgagacccacgacggcgcctccaccatggacttcatggcgcaggagcaggaacgtggtatcaccatccagtccgctgctaccacctgcttctggagccgtcagtcccacgacaccaaggacaagttccagatcaacatcatcgatacccctggccacgtggacttcacggccgaggtggagcgctccctgcgtgtgctcgatggtgccgttgccgtgttcgacggcaaggaaggcgtggagccgcagtccgaaaccgtgtggcgtcaggctgacaagtacggcgttccgcgtatctgcttcatcaacaagatggacaagctgggcgcgaacttctactactccgtcgacaccatcaaggagaagctgggtgctactccgatcgtgatgcagctgccgattggttccgagaacgacttcactggcgttgtcgacctggttgagatgcaggcttacgtgtggaacggcaccgaggagctcggcgccaagtacgacaccactgaaatcccggacgacctcaaggacaaggctcaggagtaccacgagaagctcgtggaagccgctgccgaagccgacgacgacctcatgaacaagttcttcgaggacggcgacctgtccaaggaagacatccgcgctggcgtgcgtaagctcaccatcgccaaggaagccttcccgatcttctgcggttccgccttcaaggacaagggcgttcagccgatgctggacggcgttgtcgattacctgccgtctcctgaagacgtgccggccatcaagggctacaagcctggcgatgagtccgtcgagatcgaccgtcacccggtcaagtccgatccgttcgcggctctggtcttcaagatctccacccacccgttctacggcaagctcgtgttcgtgcgcgtctactccggctccgttgtgccgggcgactccgtgctcgactccacccgcgagaagaaggaacgtatcggcaagatcttccagatgcacgccgataaggaaaacccgatggaccgcgctgacgccggtaacatctacaccttcgtgggcctgaagaacgtgaccaccggtgacaccctgtgcgccatcgacgatccgatcaccctcgactccatgaccttcccggatcctgtgatccaggtggccgtcgaaccgaagaccaaggccgaccaggagaagatgggcatcgccctgtccaagctggccgaagaggatccgaccttccaggtcacgaccgacgaagagtccggccagaccctgatcgccggcatgggcgagctccagctcgacatcatcgtcgaccgtatgcgccgcgagttcaaggttgagtgcaaccagggcaagccgcaggtcgcctaccgcgagaccatccgcaaggccgtcatggaccagggctacacccacaagaagcagaccggtggttccggccagttcgcaaaggtcctgatgaacttcgagccgctcgacaccaccgagggcaagaccttcgagttcgagaataaggtcaccggcggccacatctccgccgaattcatcggccccatcgaggccggtgtcaaggaggccatggagtccggtgttctcgccggcttcccggtcgtgggcgtcaaggccaccgtcactgacggccagatgcacccggtcgattcctccgaaatggccttcaagctcgcaggttccatgtgcttcaaggaagctgccccgaaggccaagccggtcattctcgaaccgatcatgaaggtcgaagtccgtacgccggaagagtacatgggcgaagtcatcggcgatctgaaccagcgccgtggcaacatccagtccatgaccgacggtgtcggcgtcaaggtcatcgacgccaaggtcccgctgtccgagatgttcggctacatcggcgacctgcgttccaagacccagggtcgtgccatgttcaccatggagatggactcctacgacgaggtgccgaagagcgtctccgaggagatcatcaaggcccagcgcggcgagtgacacgcgccactgcatgaagtagccagtgtcttcagtcagcggtaatatcgtataccgctgactgggttctggctcttcaaagtggcacataacccagaaacccagtagaataagcgagtccctgtgcgaaagggtgcaggaaactcacgagacgtccaggaggacaaaagtaatggcaaaggaaaagtacgagcgtactaagccgcacgttaacatcggtaccatcggccacgtcgaccacggtaagactaccctgactgccgccatctccaaggtgctgcacgaggagttcccggatgtcaacccggagtacgacttcaaccagatcgattccgctccggaagaggccgcccgcggtatcaccatcaacatcgcccacatcgagtaccagaccgagaagcgtcactacgctcacgtcgactgcccgggccacgccgacttcgtgaagaacatgattaccggtgctgcccagatggatggcgctatcctcgttgtggccgccaccgacggcccgatggcccagactcgcgagcacgtgctgctcgcccgtcaggttggcgttccgaagatcctcgtcgccctgaacaagtgcgacatggtcgacgatgaagagctcatcgagctcgtcgaagaagaggtccgcgacctcctcgacgagaacggcttcgaccgtgactgcccggtcatccacacctccgcttacggtgctctgcacgacgacgctccggaccacgagaagtgggtccagtccgttaaggacctcatggacgctgtcgacgactacatcccgaccccggttcacgacctggacaagccgttcctgatgccgatcgaggacgtcttcaccatctccggccgtggtaccgttgtcaccggtcgtgtcgagcgtggccagctggccgtcaacaccccggtcgagatcgttggtatccgtccgacccagcagaccaccgtcacctccatcgagaccttccacaagaccatggacgcctgcgaggctggcgacaacaccggtctgcttctgcgtggtctcggccgtgacgatgtcgagcgtggccaggttgtggccaagccgggctccgtcaccccgcacaccaagttcgagggcgaggtctacgtgctgaccaaggacgaaggcggccgtcactcgccgttcttctccaactaccgtccgcagttctacttccgcaccaccgacgtcaccggcgtcatcgagctgccggaaggcgtcgagatggttcagccgggcgaccacgctaccttcaccgttgagctgattcagcccatcgctatggaggaaggcctgaccttcgctgtgcgtgaaggtggccacaccgtcggctccggtcgtgtgaccaagatcctcgcctgattttcatcagacaagaatcttcgcttgaactagcgttataggaaatccccttcgaggaaactcggaggggattttctataaccgcagcaggatatggatatgtaccacgacttccggcctggatgcgctagtgttgctttccaatagataaacggactgctgcactgcgaggatatgacactgatggcaggccgggaaagaaggtcgatgatgactggtgcacaggccgctcactgtggttctgtatccgcaatttcgctgggactgcccgtttccacggcgattcccgaagccaaaggcacactgccgaaagccttgttcgtaggcaaagcgccgatttccggcaaactcaagcagcgattggtgaacgagatcgaatccatcaccatgctggcgttggcccggtcggccaacacggggcttgcggacggcaaactgatcccggaagtgctggtcatcggactgaagcttacggccaaagccaccggcataccgaacgaagtcatcgacctgatcgccggacagcgcaaatcgggcatcgtgttcgtgtgcgtacgcgacgtgccgttcgagggcagcacgcgtgaggaatgcgcgttcgccgtgcgccgcgccataccggggcgtgccgggcacacgccgatctatcaggtatatgccggcgactggcagccggcgggggaggcccagctggagctggccggctctactattgatgagctgtgggcatcgctgtgctcacagaccattttgggtacgccggaggtcgagaatctggatgcgcgcatcattcgccatactgaaattgctcggctcgaatccgaagtggacaagctcactcgtgaccatcagcgcgtcaagaacccggcccagcgcaacgagatctatgccaaactccacaaggccaaggcgcagctcgcaaaactgcgcgaggcatagtgatgtgaaagccattgggcttccgctggcgggagctggctcgcgaagcgagactgagggtggtccaggtccgtggcctagggctacgcctaagctaattgaaatattcgtgcatcatacagcgtacagttaaaccatgttccctctgctcgaaaccttggtcgccgtatacgaggtgggtcagttcacgctggccgccgatgagctgaaggtatcgcagtcgacggtgtcgtcgcgtatcgcccaattggagcagatggtcggcgcgccgctgttcgtgcgcaatgcgaaaagtgacgtgacgcccacacaggccgggcggatgctgtaccagactgccatcggcatcgacggattatggcgggatacgcgtgagcagatcgcccgcgtgcaggaggcgcgtgagccgctggccgtgtcgttctcgcacacgaccgcggcgattctgctgccgaaggcgttgccggtgatggctcgggacatggacggtttcgacttcgctgtacacgtgatgaactcggatgcgattctcgaacaggccagcatgaaggccgtgcagctcggcgtggtggaaaagccgatcgtgaacgattcggtggaccgcgtcaccctgtgcgaggaccggctggtgttggcgggggagcctgacggcgtgtggatggtgcgcgaacacggttccggcgtgcggtattacacggatctgtatttcaagaccgctcaggttgtgcctgcacgcacgatggaagtgtccagtaatgcggcgattgtggcggcgctgtccgccgggttcgggtagtcgttgatttcggaagccgccgtgccggcgggcgtgccggtgcagcgggagcttggcgatgagtttgtgcggcggttctatgcgctggtgccgagatccggtctgacgcacgatcagcgggagttggcggagacgattattgctgcgctgcgcgggtagtcagatagtcgactgaggggaggttgcgaacgttgtttctctccctccgtccgcctgcggcggccacctctctcatcagagggagatcaattaggtatcgacaaaatcgatgatatgtattggttgcaatgatttgaccgatgtaaacgcttgagcttcaatagacatcatgagagagttctgtacaaaatggtggaagcgcattgccaccgttgacatgctgttcattggtgttctgactctgctggcctcgctgttcgcctcctggctcaagcagttccccggattcagcctgttcggcgcgctcatcatcgcgctgctcatcggtatgatcatccagttcccgatccgcagtgcctacgtcggttccaatgatggccgcaaggcaggcgtcaaggacgccgctggcctgatttccaacaagctgctgcgcctcggcatcatcctgctcggtttcaagctcaacctcgccgtgctgttcacgcagggcatcaagtgtctgccgatcgccgctgtggtcgttacgctgaccatcatcgtgtgctatgccatcgcccgcaaactcggtgtcgacccgatgctcgccatcctgaccgccggtggcaccggcatctgcggtgcggccgccgtcatgggcctggccggttccatcaaggtgcctgaggacaagcaggacgagaaggacaacgacgtgaccatggccgtggccatcgtagccattatgggtactgtgttcgcgttgctggagatcgcgctcggcccgctgaccggcatgaccaaggaccagctgggcatcaccgccggtgcttccctgcacgaaatcgcccacgcggtcgcgggcggcgacgcgttcggcgcggtggacatcgccaccatcatgaagctttcccgcgtgctcatgcttgtgttcgcggccatcatcatcgccatctggtgggagaagaagcattccgaggttcagagcaccggcaagaagaccgtggccttcccgtggttcatgctcggcttcatcggcgcttcgattatcggcaccttcgtaccgttcgtcacctccatcaccccgcagctcgtggactttgcgtacatcgtgctcggcatggccatggccgcgctcggcatcaacgtgaacttcaaggccatcgcttccaagggcaagaagccgatgctcgccagcttcctgacatcgattctgctcatgtgcttcgctgcaggtgttgcgatgctgttcttctgataagcgctccaaatacaaataggcgaaggcgaacgacagtgagcaattggaatgtgtcacctaaaaatcacgtacttgcacaacggataaccccagccgaactggcaggccatcgcaatgaacttcaccacatatggactcagcccggtcgcacccggcatccagccgatcagcagcgtgctgaacgtgaagttccagatccacagcagcacgaacagcgccacggaacgggtgaagttgctggacgatttgaatgtcacgttgcggttcatcacgaagttgtaggtcgccgaacacaccacggcgatgccgttggcgatctgtgagggtacgccgatcaagtgcagaatggcgaacgtcgcatactccacaatggtctgcgtggcggaaacacccacatacttgcccagcacggcgagtccattttgcttcggggttgccgtgcccacggtattttccgcagtattcgttgtggtcgaggtatttgtggcgcccacaccttgattcggcttcacatccgctccattgttcgccatgcccatatacctcccggatgtacctgtgacgttcgacctcgcaatgataccgctgaccgcgtcgggaatcggcgtggcggtcagacgagaaaaccgcaggccgcagcaacgaccggcacacccagcgacagcaccagataggccgctgcggtggggtagcggtgtttgcggaagagcgtcaccatttcgttgattgcggtcgagaacgtggagaagccgccgaggaaaccggtggccagcactagccgccatggttcatcaagtgtcccgccgagtgccagcgccgcgaccaaaccggctaggaatccggcgatgagattgatggtgaacgtggaaagtgggaatgcgcgctgccagtacgttttgatggtcacgtcaagcagatagcggcaggaggcgcctacgccgccgcacaggcagaccaagattggtaggaatacggtcatcacgccttacctcccttgctggtcgtagcggcattcgtatcagcggacgcttcggcggatacgttcgaggagccggccagatgcgttcctgcccacacgccggcagacgcacaaaccagacccagcgcgaacgtcaccagtagataggcaatgccggccgccacctgaccgtcgcggattgcggtaaaaccttccagcgcgagtgtcgacatcgtagacaaaccaccgcatacgcccatgccgagtccgcgactggcaagttctttggaacgtgcgccgaaccgggaagcgccggccaagtaagcggtcaaccctgcatagcagaagcaagccagcatgttggccacaaacgtgccggtatggaagctgccagccgcgggaatctgtgcgaacgcatagcggatagcggtgccgatcgcaccgccgcagaagacgaccaacacaatatcaagatgaatatcggggagcttgcgcgccgggggagtggtcgtgtgcgtaatcggccgggcacctgcggatggggattgcgaatccataatagcctttcctgaaaccgctgaatcctgctgaagacacaacgattccatgcaatatcaaatcgtgtgtaggaactatcagcagtgtgcggttcgaaacgagttcaggcgggttccatcgccggttccttagcctactcgtggcggcgacaacaaacggcagcagtatctcggatattggcctatcgcggtggatttcggcaagagacttctgcaatgccgatgaacttggttgccgtgaggcgataaagcacgtagatgaattgcttggttgcttccatacctcgtgggtatggctcaacatggtttatggctattggctaatacagattgattgtcgtttaatggaacatgaggataacgggccctaatcgctcggtgccggaaacaaggagttgtgaatatgtctgaaaccatgaaagccgcgattttcgttgagcctggcaagatgaccgtggaagaagtgccaaaggcggcacttcagcaggatgatgacatcgtgattcgcatggtgcgcacctgtgtatgcggctctgatttgtggttcttccgtgggctgagcggacaggccgcacacagtcaggtgggccacgaagccattggcgtggtcgaggagactggcgcggcggtcgaatccgttaagccaggtgatttcgtggtcgtgccattcccgtacagctgcggcaagtgcccggtatgcaaggccggcttcgaatccgtgtgcccgcacgggggctacttctccgcttgtcaggccgaatacctgcgtgtgcccgaggcggacggcaccgtggtcaaggtgcccggttcaccggaagattattccgatgaacagctcgcatcgctgctgaccatttccgatgtgatgtccaccggttatcacgcggcggtttctgccgaggtcaagcccggtgacacagccgtggtcatgggcgatggtgcagtcggcctgtgcggtgtgattgccgccaagatgcgtggtgccacgcgcattattgccatgagccgtcacgaggatcgcgcggcgctcgcccgcgaattcggtgcgactgatatcgtgcccgagcgtggccaagaggctattgacaaggtgctggagatgaccggtggctatggtgcggacgcggtgctcgaatgcgtgggctccaagcagtccttcgacacggcgattggcctgattcgccgcggtggcgtgattggtcgtgtgggtctgccgcacgacgtggagatcagcgccgaaggcacgttctacggcaacatcggcatcaagggcggcccggctcccgtgcgccactacgatattgacggtggtctgctggatgcggtgcttaaaggcgagattaaccctggccgcgtgttcaccgccgaatatgacctcgaccatattcaggacgcttatgaggccatggaccagcgcaaagttattaaggcgttgatccggttctaatcgcgtggtgtgacggggtttaccgcagtggtatttaacgtccgtatgtatgcgtcccctttgtagggccgcatacatacggacgttgtgatgtgtctgacgcggtttacgctgaacgattgtggtgacgcaaaccggtcacctgttactcggcgagcagtgccttgtactgtgcagcggactgggcgagggcctcgtcggtgatgccgaaagcgccgcacgtggcgaacggcttgagtcaggtcgcgccgatgtataagccgtgccctcgatcggaataagcagctgctcgatggggtagtggccggggtgccggtctggtaggccgattccggcgaaccggtggacactgcgcatcgcgtcgggaaccgtggccaaggcgtacaccgaactcgccgactgcggcatcatcgacaccggtgccggccgcgcggcgcgtgtaaaacgggtcaagccgattcccgaaccgctggtgcgcgcggccaagacctatgccgacgaggcccgccggcttggcgcgagcctcgatgacgccttcaacgccctgtgcgcgcagtggtaaagcgcgcaccgatgcgaagcctacacggggtgcaccgtcagcgaaaagtcgccgatggtgctgacggtcgagggtgaggccagattgcagacatctcgcaagcagtacgtggcatacagcggaagataggttgttccgccgtcctgcgcaatattggagcgggacagcaccacgccctgcgagatgcgatattcggcattggccaatacggcgtcgatggcggcgtgcgtgcggtagctgcgccccgacttgacctcgaacggcatcacagaatcggcgttcgtgtcagcgatgaaatcgacttcaccatgtttctttgccatgtagtaatacagcggaatgccttgcgccgtcagctcctgagcaatcacgttctcgtagatggcacccagattcggtgaggaatcatcaaggtatgcggcttgcgcggtcggttgcgggtatcgtgccatgagcataccggtatcagactggtacagtttgaacttcggtgattgcgccgtgcgtttcaatggtgttttcggctcggtgacgcagttggttttcaatgccacacccgcatcgacaagccaaagaaaatccttctgattgcggtcgtaccgagcaccggggctgatggaggagacggcgaatctgccgttaccgtcaatcagctgagtggggagctggtcgaagatctcctgcacctgcaatgcgcgattgcctgcgtactgcgaaatatcgtggcgatattgccggttcaactcgttctgcaccgcgcgcacagccgccaaatcacccttggtgtccagaaaacgttgcacgacttccggcatgccgccgactaccagataggtgcggaagttcgtcatcattgcatcgtgaatgtaccggtcgattggcgtgaccgaccggcaggattctcggatgttttcaagtgtcgacttctgtacgccgatggcccaacagaattcctcaaaatccatgggacgcatggttttttcgatgaccgagccaacggggtaggagcgtacgcccttgaactcagtgccgagcatggaaccggagaacacataatcgaaacgaccatcggccaccagaaacttgaccatggtcatcacatccggtgcctcttgcacctcgtcgatgaaaatcaacgtatcaccgggaatgagcgttgaaggtgagaacaaggtaaggcggctgatgaactcctgcacgtcgttcgccgatgcgagcgctcgggccgcctgcttgttctcgtacaggttgatttcaaggtaatgggcgtattcgtgcttggcgaactcgcgtaccgcgtagctcttgccgatctggcgagcgccggtcagcagcagtgctttgccggtaccgctccgcttccattccagcagatcgtccgagattttgcgctcaagcatggcagctcctttccgaatcccttatgagggtagcattttctgccttgtatgtgcaaaatgccgcatttcaaaatgaggctttggtgcaaaatgccgcattttaaagtagggttttggtgcaaaatgccgtgtaaatggtgaattggacgtgcttgtaaggggagctggatgatcgtgcggctggatgaccttgtaactaaatgattgaacgattgcgcggccgtcgtttgcgtggccgcaaagttgtgtgggctgttcgcgaattatgcgcggtcggccgtcatgtgcctgcgcttggggtgctcgataagtagcgctcgcttcttggcgtcctcggcggtcgaagccggtacgccgtcggaggaggcgtcgatgatgcgctgcaggtagccgtatagggtgtgcagctcgtcgtcattcagacagtccagcatagaggggcctgatcaaaaccagttcacgaggtcctttttgctttaatccccgctgagagcgcgtagcgccggaggatgatcggatgccgcgacgccgaatcaagattcagccgctcgccgaccagcccgaccagcaaggaaccggattcgcgcatcggcggcatgcgcgctgctattcgcgctgaaacagcatggcatgggtgcgctgacaccgcgccggcgcaaaggccatcagtgaaactggggaatcggattgcaggtggcggacggtgcccaagacgaaagattctcgtccggcgttcagccgctgtcgttggccgtgatgatactggagaccatgaaactcaggcggcggcagccaagggcgaagtcgagaaagaggtgacggcgtgacacttgaacagaggtcagatagcgcggcggcaggccacgaggcatgtgaccagccgatcaggagcctggaaatcctcaaccaatgcgttccgctgttcgagacgctgaaggatccgaaccggcagcagttgctggtgcaattggtgtgccatgggccgcagacggtgggggagctggccgaatcgtcggcactgtcccgcacggccgtgtcccatcacatcaaactgctggaacaagccggattcatcgaaatcagcaaagacgccacccgccgcatttgctcggtgcgtgcggatcgatggctgccgctgctcgatgaactgtcttccgccctgaaagccgaccttgcggcggcggagcagtgccgagcatgagcgacgatcaacggccgcaggcgattgaggtgcgcggtgcgcgcgtgcataacctcaagaacatcgacatcgacattccgctgggcgaactggtgggcgtggccggcgtctccggttcgggcaaaagctctctggcgctcggcgtgctgtatgcggaaggttcgcggcgctacttggaagcgctgtccacgtacacgcgccgtcgactgactcaagccagccgcgcccaggtggacgaagtgctgcatgtgccggccgcgctggccctgcaccagcggcccactgtgcccggcatccgttcgacgttcggcacgatgaccgaattgctcaacagcctgcgactcctgttttcccgcgtcgcctcgcacgtgtgcccgcattgcggggcgcgcaatgaaccgacgctgaacgtggcggccggcctgcccatcacctgtgctggctgcggcaaggaattccacgcgcccggcgccgaattgctcgccttcaactcggccggcgcctgcccgacctgctccggcaccggcatcgtgcgcgaagtaaaccgcgcggccctggtcccggacgagtcgaaaagcatcgacgacggcgcggtgctgccatggggttcgctcatgtgggacctcatgaaacaggtgtgcggcgcgatgggcgtgcgcaccaacgtgccgttcaacgaactcacacccgaagaacgcgacatcgtattcaacgggccggccgtcaaaaagcatattctttacaagccgaagaaaggcgacgatttcgccgaactcgacttcacctacttcaacgccgtgtacacggtggagaacgcgctcgccaaagccaaggacgagaagggcctgaagcgtgtggtccggttcctcaaggaaggcccatgcgccgactgcggcggcacacgactgagcgtcgccgcccgggccccgcatgtgcgcgggctgaacttggccgaagccggcgcgatgaccttggacgcggcggcggattgggtgcgcggagtgccggaatccctgcccgccgacatgcggccgatggccgccaacatctgcgaatcgttcttggatgtggcccgacggctgctcgatctgggcctcggctatctggcgcttgaccgcgccggcgccacgctttcgaccggcgaacgccagcgtgtgcagctcgcccgggccgtgcgcaaccgcaccatcggcgtgctgtatgtgctcgacgagccatccatcggtcttcatccctcgaacgtggacgggctgctcggcgtgatgcacgacttggtggcggacggcaattccgtggtggtcgtggaccatgatgtgcgtgtactcaaagcgtgtgaccatcttatcgaaatggggccggttgccggtgccgaaggcgggcatgtgatcgcgcaaggcacggtcggcgaggtggcggcgaaccccagtagtcgcattgcgccgttcctatccgaccaggtgagtgcgcgtatacgtgagcgtgtggccgaatcgcaagtgttcagccttggccacatccgcatgacaaccagtcagctgcatacggtcaaaccgttggacgttgatatcccgcgcggccggctcgtggcggtgaccggcgtctccggctccggcaaaaccacgatggtactcgaatcgctgattcccgcactcaaagcgcaggcggcgggggagctgttgccggaacacgtgcgcgagcttgagaccgagggcatccgtcgtgcgaatctcatcgatgccacgccgatcggcgcgaacgtgcgttctaccgtggccacttatgccgatattcacgacgaattgcggcgcgcctttgcccgatgtgaggcggctaagacgggcggctggaaggccggcgatttctcgtacaacaccggccgactgcgttgccctacgtgcgacggcaccggttcgatctcgctcgacgtgcagttcctgccggacgttaccatcgaatgcccggattgcggcggatcccggtatgcgcccgaagccggcgcgattcggcgtgccgttaagggagaatctcacctttcgttgagtctgccgcagctgatggcgatgagcgtggaccaggtgctgtccgtgaccggcgacctcaagaaggtccacgcgcgcctgaccaccttgcgtgatttgggcctcggctacctgacacttggcgagccgacaccggcgctttcgggcggcgaagcccagcggctgaaactcgccagcgaaatgggcagggcgcagtcggacgcggtattcgtgttcgatgagccgaccatcggtctgcacccgcttgatgtgcgcgtgctgctgggtgtgtttgaccgactcgtggcgagtggcgcgactgtcgtggtcatcgagcatgacctcgacgtgattgccagtgcggattggattatcgatatggggccgggcggcggagaaagcggcggacacatcgttgccacaggaactccggaacaagtcgcggccaatccgaacagcatcaccgggcggtatttgcactgacttgtatggcggtcacgcgcctttgcataggaccctgcgcgagtaggatagccgtccatggtgcagattcatggcattagacgcgcaagcgcggacgcgaaatatcggcagatgaccgggcagccggtcaaaccgctgatcctcaaactatgcctgccggccgtcatttccaatctggtgactactgcatacaacctgactgatacctttttcatcggccagctcggcaccgcgcagtccggtgctatcggcatcgcgttctccatcatgaccgtgatgcaggcgctcggcttcttcttcggcaacggcgcgggcaactcgatgagccgcgaactcggcaaacagaacaatgagcgcgcctcccgactactggccgtgggcttcgcgggcgcggtgctctctggtttggtgattgccgcaatcggattgctgaccctgcggccgctggtcgtcatgctgggatcgacctcgacgatcgccccatacgccgtgcaatacctgacgccgttgttggtcgccgcaccctgtgtatgcgggtcgttcgcgctcaacggactgctgcgataccaagggcaatcggcgttcggcatgatcgggctggtttcgggcgcattgctgaatttcctgctcgcgccgttgtttatcttcgtgctgcacctcggaatttttggtgccggcctggccaccgccatctgccagacggtgagcttcacgattctgaccacgatgagccgcaaattcggcgtaatgaagctgtccttgcgcaattgcaggccggatgtgctgctcatgcgcgaagtggccggcggcggcctgccttcgctgattcgccaaggtaccggctcgatctctgtgacctgtgtgaacatcgccgccaacccgttcggcgatgcggccatcgccggcatggccattgtgatgcgtatcatgttgggcgccaattcggtgatcgtgggcctcggccaaggtttccagccggtgtgcggatacaactacggggccggcctgttcgcgcgagtcaaagagggatattggttctgcgtgcggctcgccacctgcgtgctcgtggcgttggcagcgctgctgtggattttcgcgccgcaactggtcgagatctttcgttccgacccggccgtggtggcggtgggcgtggctgcgctacatattcaatgctgcacggtgattctcaacggctttaacatgatgggcaatatgatgacccagaccatgggccgcaccggcatcgcctcgttcctggccttgtgcaggcaaggcctgttcctggcgccaatcgtgctgattttgccgatgatgttcggcgtgctcggcgtggaaatggcccaatcggtgtccgacgtgctgacgttcgtggtcaccatcccgttcatgcggcgaatcctgcatgaattgcggtgaatggtagatggcaactatgaataatcgaagtgcaaagcgggtgccgggcgttccttctcccgcgtatatcgaatcgctgtaccgcaccatggctgccgcccttggcccgaccggatggtggccggctgaaaccacattcgagattatggtgggcgcggtgctgacgcagaatacggcgtggggcaatgtgaatcgttcgcttgcggcgttgaacgcggagggtgtgctcgaaccccataagctggcgattatggggccagcgcatctgcaggaacttattcgcccgtccggcttttatgtcaacaaatccaagacggtacagtcactgagccgatggtatgtggagcgttgcggagcctcacctgagggcgcggcagatattcccgacgccgaattgcggaccgaattgctcggattatttggtatcgggggcgaaacggccgacgacctgatgctatatgtgttttcgcgccgcacattcgtggccgatacttatgctcgccgactattcgccttcctcggatttgatgtgccagccggctatctggcattccacaaggcctattcgcccgtggtgctggatacgagcctcagtgtcaaggatttgcaggaattccatgggctcattgacgagttcggcaaggcctaccgcgacgacgcggccaaaagcgagtcctttttgggtggatggagggcttgactgcacggcgaatcgttctcaataagaaaagtgtgaggcccgcacggtgccaatcgcacatctgaatccttgactggctgcgctcgatgctgggtgtcgaaaacgagtctgtgacagaatagttcgaccgacgcaatcgccaaaacgccgaacaggagccaatgatgaccgaagacaagccgatcgccaagccgattatcgatgatgcgacgcgcgagaaaatggcgcttatgttctctggcgaggtctacctgccggatgatgtggacggcttttttgatctgcaggccgcccagcgtgatctccagctcgaactcaacgccacgccgctgaccaacccgaagcgccgtaccgaactcatgcaggcgttcttcggcgcggcgggggagggtctgtacctcgaatgcccggtgtatgcgaactggggctgcaatacttattggggcgagcgctgttacgccaacttcaacctgacgctggtggacgatggtgagatcttcatcggatcccacaccatgatcggccccaacgtcacgcttgtagccaccggccatcccgtgcgtccggacctgcgctatcagggtgcccagtattcgttgcccgtccacatcggcgagaacgtctggatcggcgcgaatgtcaccgtgctgcccggggtcaccatcggggacaacgcggtcattggcgccaactcgctggtcaccaaggacatccccgccaacacggtcgcctatggcagcccgtgcaaggtaattcgcgaaatcaacgaacgcgacgacgtctactactggcgcgaccgccaattcagtgagcgttttaagctcaaagagcagtagcgcgaaagctcactcccacacgtcgagcttgcgatttttgtagaaatactcgcggtccttgtcgccgatttcacgcacgacctcgcagggcgcgccgtaggtgacggagttggcggggatggaatgtgtcacgaccgaaccggcgccaatcacgcaattgtcgccgatggtcactcccggcagaatcgacacgttcgcgccgacccacacgttgcgcccgctgatcaccggaatgcaatacgtgtaatggtgctcgcgcagcaccggcaacacggggtggccggcggcgcattagcacggggaacggttgaacgagaagtggattggcatgtgatggtatcgaacatactgatgcgtgtgccgccgagcctgtccagatggctgcctatatgaaccagtgacagaaaagcacgggaacgcgagcgagaggagtgtgcatggggcagttcggcgtcatgattggccagttagtcggatttctgatcatgctgatggtcgggtatggatgtgtgaggcttcgattctacggtcaggcggcgttggacggcatgtgctcgttgctgctcaacgtgctcatccccgtgcttgtgttttcgaacgccgtcgatggtgcggaccgcgcgcagcttgcctctaactggggcgtgatgctgctgaccgccgtgatgtacgcgctgctcatcctggtgttctggctggtcgccgaactgttgcggctcaaaggttcgcgtagccatgtatttcaggcgtcgcttattttcggcaacgccggattcatcggcattccgttgattatggcactttggccgcagaacggcgcgatttacgtggcgctgatgtcgatcatcgaccagacgctgctctggacgtacggcgtatggctgtgcgagccggtcgacgaaacgactggcggcaacgcaattggcgcgcgaggtgcggtcgtgaacggttcggtgaacggcgccggttcggtgggcaatgctggttcggcgagcaatgccgcaaacggtggttctccggccgtcgtccgcccctcgccaggcacccgcgtcctcggcctgcttaaacgattcgtcaatcccgccttcgtcggcgtgatgctcgccctgattctgattctgctcggcgtcaaggtgccggacatcatcctgaagccgctgcacaccatcggcaatatggccacgccgatgtcgctaatctacttgggcggcctgttcgcgctgaccaagtggtggggtgtcctcaaacgctacgaactctatgctggcctagtcgccaagatgatcgcattcccgctcgccttctacgcgctactgaccgcgctgaccggcgcattgccgcaactgccgatcacccatgacatggtgctgatgattacggtcatcgccggactgccgaccatgaccaccattgccatgttcaccggtcgcaagaacaacatgcccgagtatgcggtcggcttcgtgctcgtaagcacgctgttctcgctggcctccctgacgattgtgtcggcagttgtgttctgaattgtccccttcgacgaaaagaatgccgggggcctccggcgcttggaatttcatcgacgccgccaacgactcggcatccgaggcggccgtgccgtatttcaaggagatattcgattacgcgcgcacgctcgatccgcagcatcgtcctctgacctacaccaatctgatgatggccgccgcaggcaaagacaagtgccatcaattcgcggatgtcatctgcctgaaccggtattacggctggtatatgcaaggcgggtatcagctcatcggagccaagaaggccttcatcgacgagatgaaccaatggatgaacaccgaacccaacaagccattcctgttcaccgaatacgttgcggacaccgatgccggtgcgcacaagctgccaagcgtgcagtggagtgaggaataccagtgtgagtacctcaccatgcagcacgaagtgttcgacatgttcgaggcagtggtgggcgagcaggtatggaacctctgcgacttccaaaccggtgaaggcatcatgcgcgtcgacggcaacaagaagggcgtcttcactcgcgaccgtcagcccaaagccgccgcctatgtactcaaggagcgttgggagactaagtagcggcccgcccctggaatattccaggagcaacgcacatcgcataacatacaacgcaacatacgaaaaagaacctcgtgaaacgaatttcacgaggttctttctagttacgctgaatgactcccattagactcccacaagagaagagcaatggcgaaatcccaacgttgctaagctctcaaactcagatgtggaagtagagctcgtactcgagcggggtcggagacaggcgagcctggtcgatctcgtcgcgcttgaggccaatccaggtctcgatcaggtcgtcggtgaacacgtcgccggcggtgaggaagtcgtggtcctcttccagggcgtccatagcctcagccagggagctcggcacctgcttgatgccagcgtgctcttccggcggcagctcgtagaggtccttgtcgaccggctccggaggctcgatgtggttcaggatgccgtccaggccagccatcagctgagcggagaaggccaagaacgggttgcaggacggatccggagcgcggaactcgatgcgcttggcagccggggaggtgccggccagcggaatacggatggcggcagaacggttacgagcggagtacaccaggttgaccggagcctcgaagcccggaaccagacggtggtaggagttcagggacgggttggtgaaggccagcacggaggaggagtgcttgatcagaccgccgatgtaccagcgggccagatcggacaggccagcgtagcccttctcgtcgtagaacagcggcttgccgtccttccacagggactggtggcagtgcataccagtgccgttgtcgccggcgatcggcttcggcatgaaggtcgcagccttgccggccagagcggcggtctcgtggacgacgtacttgtacttcatcaggtcatcgcctgcgtgctgcagggtgttgaagcggtagttgatctcctgctgaccagcgccggccacctcgtggtgggaacgctcgagaatcaggccgaccttctgcaggttggcgaccatatcgtcgcgcagatcctgagtgtggtcaatcggcggaaccgggaagtagcccttcttgacgcggttcttgaaaccgatgttcggggtgccgtcttcctcaacgtcaacaccggagttccacggagcttcgatggagtcgacctcgtagaaggagcggttcatgccgttctcgaagcggaccttgtcgaagatgaagaactcggcctcaggagcgaaggaggcggtgtcggcgataccggtggacttcaggtaggcctcggccttgccagcaacctgacgcgggtcgcgggagtacggctcgtcggtcagcgggtcgacgatggagaaggccacgtcaagggtcttgtgcttgcggaacgggtcaatgaaagcggtctcaacgtccgggaccagcttcatgtcggactcgttgatggcttggaagccctgaacggaggaaccatcgaacggcatgccgtcggtgaaagcgtccttcaggaattcgctagccggcacggtgaagtgctgctgaacgccgataagatcggtgaaacggacggagacatactcgatgccttccttgttgataagggcctcggcgtcttccttggacttgagttcggtcacgggaccgctcctttcgtatgaaatataacggtatccatcgtaaaatcgcgcgtttcgccggctcgaaacttgggttacgagaatgtttcgtgactgtggccgacaatcgcgcaggcgcgttatttcaacgaaacatcattacagaatggaaacggaggctatcgggggagtgggtagaggtgtccgcaacgtggacagtggatattgacaggtgacgtaggtggatgtatgtggacgcgattatgagacatatgacgaagccccggaaccgattgaacggattccggggcttctgtgcgatttggtggtgtgctgccgatcagcgaccgcgcatcgcgcggcgggagatcttctgcgggtggttcgggtccatgcccttggggatggcataacccttcttggcctgcagcgtgcgcagacgatcgttcagcgtttccatctcggccttggtcagcaggaagcgacgacgcggatgaatcttggcgatcagtgcgttcttgtggttcgtgggctcatagctcttggacttggtcaccgtgctacgcagcttgtccagtggcacctgcttggggccgtggcccacggagatgcggtacaccggaatggaggagccggcggtgacgcccttgatatcgtgttcctgacgatccatcgccttcatgatgcgaccgtattcgccttcgccgatcaggtagatgccgttcatcgaagtgccgcgccagatggcatccttggtcttcgggtcgatccacaccggttcctgcgggaagttaaagccggctttctgcatgttgctcagcacgccgatggcggcaccaggcttgccgtcaatctgcttgtagccgactgcatccgcgcggcgggtgagcatcatggtggccagtagcatgccgagcatgatggcggtgatcatggtgaagatccaggtcagccaggtccacttggcaatcagaccgatgatgatcatcacgactacaggcagcaggaaagcaccggcctcaagccacggcagggccttgtcttccttagccgtgtacttgtagatctggatgatctgcttgattgtgctctgcttcttcggcttcgcgtccttttccgccatcacttcttcctttgttgggacgaaacacactaggcaacatcttatcaggtgcgctggtccgaacttgtttgtgctggttggtctcagcgtgtgtgtaacggccgtccgtcggccttgagcagcgcctcgccgagcgtttcactgaacgtgggatgcgggtgaacgaggcgggctgcgtcggcgagcggcacatggttgccgaccagctgttcggcttcggcgatgatgtcggaggccatctgggagaccatgtgcacgccgagcacgcgcggggtgtccgggttggccgcgtcgcagccggagacgatggtcagtgaaccggccgtgccgctcatcagcatgcgcgcgttcgccagcatcggatagttggtctccttgatttcaatgagatcctctctcgcctgcgcctgttcgacggtgagcccgaccgacgccgcttcggggaaggagaacacgatttgcggcacggtggcttcgtccaccggcttgggattgagtccggcgatggtctccgcgatgacgatgccttgctcaaaagcacgatgcgccagcgcgtgaccggccgtcacatcgcccaccgcccatacgcccggtttgtcggtgcggccgtacgcatccgtggcgacatgtccgtggtcgtcaatcgtcacgccccatgctgggtcggtgatcgggtcacgcccgatggcgacaagggcgatttcgccccagacgctttgttcgccgtcctggccttcgcgcgtgtagtgcacggtggcaccaaggttcgcgccggtgtccacatgggtgacgctggcgcgggtgatgatgttcacgccatgacgtttgagctcacgggtcagcgtggtgccggctctccggtcccaggctgagagcacacggtccttgcgaatcagcaaggtcaccttcgaaccggcggcgttccacatcgaggcgaattcaagggcgatggccccggcgccgataatcaccgccgacgagggaaattcgttgacttccagcgcctgtgtggagtcgatgagggcgccggcgaacgggttgccgggcaatgggcgtggcttggcaccggtggcgatgacgatgttcgtggccgtgaggtccatcgtggggccgctgggctcggggacatcggccttgtgataggtgaggatgtcgctttggtcgggggaagggacgaggtggacgatgtggttggaagttgctggagcggtctcatccgcatggaacgcggcattggctcggaacacggtgatgccgcgatgggcaagcagtccggccagtcctcccaccatcgtcttgaccacgcgcaggcgatagtcgcgcagcgtgccgaagtcgatgccattcaccgaggcgttgacgccgagctcggccgcacggtgcacggtgtcgatggtgtgggtggcggtgatgagcgccttggaggggatgcagccacggttgagacaggtgccgcccacggtggcgtcacgctcgatgagtgccactttcatgccgagttcggcggcgcgcagggctgtggaatagccgccggggccggccccgatgatgaccagatcaaactgttcgctcatgattgcctccttggtgcatataagtatggctcccatgctagggagccatatgtggctatcgccgccacttcgcctaaaaacagtccactggactgttttctttacggctcagcccctcaacgaggggagccagagtatatatggacatcagtctgccggccagtgaccgcgcttcgggtaacgcggcttgggaagcctccaacgacgcatctgaatcgaacggctccaagcgtaggagaaggagcgggagcccttggacacggactgttcgccgtacttggcgatgagcttggccttgagcttgcgccacatcagccatacgtcgatgatcacggcaatcaggtaaccgtacataagcgccatcatgatgatggaagcccactggttctgcatcaaagaagtgacgaacatggagacgatcagaatcgcgaaggccaccgggatgaaccattcgccaaggttgaaacgggcatccacataatcacggatgtagatacgccaaggcaggcgttccgccttgggcatgtggttgatatcgcccttctgcatcgcctcgtactcggcgttctccttctcacgcagacgggctttggcggccttggcgctggccttgcggtccaccggaaccagcggacggataccggcggcctgagcctgcttcatcttcggggtaggacggccttttttctcagaaggatcggcggtcttcttcggggcctgctcaacgggaacttgggcctcttcttttttcctaaacggattccatgtcatgctttgaggttacggtgacgttcagacacttgtatactggcgcagccattgcaatgacgccgcttacacacatataaaggaggaccatcatggcaacgctcaccgctgacgagattcgttcgcgcgtcgaaaccgattggaaccgcatcgtcaaggtgctggccgaaaaggttgcgctgcagtcgatttccgccaagggcatcaccgccgaacatatgaagcgctccgctgaattcgtggcagacgaactgcgcctcgtgggtgtggatgccaaggtggtccaggcttccaatgccgacggcactccgggcgcatgggaggtcatcggctcgcatatcgtttctccggacgcccccaccgtgctgctctacgcccatcacgacgtgcagcctgttccggacccggccgagtggaacaccgacccgttcgtggccaccgaaatcgacggccgtctttacggccgtggctccgccgatgacggcggcggcatcgccatccactccggtgcgctgaaggctttgggcgacgacctcaacgtcaatatcaaagtgttcatcgaaggcgaagaggagatgggctcgccaagcttcattcccttcatcgaggctcaccgcgacgaattcgccgccgacgtgattatcgtggccgattccggcaactggtcggcggacattccttctttgaccacctcgctgcgcggcaacacctgcgtggacgtgaccgtgcagggccttgagcacccggtgcactccggtcagtacggcggcccgattcttgactccaacacgttggccgccatgctcatcgcttccatgtatgacgagaacggcgatctggccgtacccggcgtggccgcggaagagccgatcggcggtttgcagcacgaccttgacgaaaccaccgtgcgcgaggattctggcgtggtggccggttacgagttcgccggcaccggctcgctggcctcacgcctgtggactaagccgtccgtgaccgtgatcggcttcgacgcccacccggtcgagggatccttcaacgtgatcgccccggagacccgcttccgtctgtcgctgcgcaccgcgcccacccagcaccctgaagaagcgcaggaagcactggctgcattcctcgaatcccacgcgccgttcggtgccaaggtcactgtcgaacgcggcgaaaacggcatgggctgggccatggatccgaccgccgtggccaccaaggacgcgctggaagccatgaccgaggccttcggcgttgagcccatcaacaagggcgaaggcggctccattccgttcatccccgaactgcagcgcattttccccaacgctcaggtgctggtcaccggtcccgaagacccgaaggccaacgcccacagccccaatgagtccatctccctgcccggcctcaagaacaacgtgatcaccgaggctttgctgctggacaagctcggcaagtagccgaaccgcatcggtaatggtagtgagccgccgtcaggtaggtcacagatgtggctattgcctttgacggcggcttgctttatagtcgggagttgacacgggagctgccgttgggcggctgagaggagactcatagtctcgaccgatggaacgtgaccggataatgccggcgcacggaaatgtcgctcttacctacccgtgcctgaaccaacccgcgcgtggccacgaacatatgcatcatgtgcgtacatatatccacgtatgttcggcctgcgtgcgagcagaagaaaggcacattcatgactgaagctgtggccaaagccaattacaagtggcgcgtcgtcgatatcgtcgtcgccgcaatcatcgccgtcgcatccggcgtcattttctggggctgggacattgtctgctccgccccgctggccctgtttgaaggcgtgacccccggtttcgagggtctgctcaacggattctggctgttcgccggcccgctcgctgcaatcattgtgcgcaagcccggtgccgcactgtttgccgaaaccctcgccgccttccttgagcttacgctgggcaaccagtggggcgtcggcggctcgctgatcgtcggcatcatccagggtctgggtgccgaaattgccttcgccgtcttcgcttggaagaagtggaacatcggcaccaccatcctgtccggtgcgctcgccggcgtgggctgctgggcctactactgggccaccaacccgggctggaacggcctgcgcgtcacttggtatctggtgggctccatcatctccggcgtcgtgatcgccggcgtggtggtctggtacttgtctcgtgcgctcgccgtcaccggtgctctggagcgttttgaatccggccgcagcaaggcgcgcgtctgatgcagattaatccggctgcggtagaggccagcggctggggatggcggcacgccacgcgtaaggacttcgcgttgcgtgccgtcgatttcaccatccggccaggtgaacgtgtgttgctgctcggtgcttcgggcgcgggcaaaagcacgatgatggccggtctcgcaggcgtacttggcggcgatgaggaaggcgagcaggagggctcgctcaccatcgatggcgtcgatgcgcgcgaggcgcgaggtcgcgtgggactggtgcttcaggacccggactcgcagatcattcttgaacgactgggcgatgacgcggccttcggctgcgaaaacctcaacgtgccgcgcgaggagatttggcagcgagtgcgcgaatcattggatatggtgggactcggcggactcgaactggatcggtccacccgccatctgtccggcggtcagcgtcaacgtctcgcgttggccggcgtgctggctatgaagcccggtctgctgttgttggacgaaccgaccgccaacctcgatcccgaaggcgtggtcgaagtgcatgacgcggtcaaaaaggtcatcgaggccaccggacagaccatggttgtggtcgaacatcatatcgatgtatggctcgatctggtcgatcgcgtgattgtgctcggccgacccgatgcaagttcgcccacgggtgcggtcattgccgacggcaagccggacgaggtgttcgccgagatgggcgacgtgttggccgccggtggcgcgtgggtgccgggccgtgcgattcccgattactcaccgaagcaggagtctgcgcacgatgcgccggtgctcagcaccgagaacttaagctttggccgtggggccgctcttggcgttggtatcaatctggatttttatcccggcgaagtaacggctctgatgggtccgaacggcgcgggcaaatcgaccttggccttgaccttggccgggctactcaagcctatcgccggcaaggtgctcatcgccgacaacctcaagcccgcgcatgccgggcgtgagccgatcgactggaaaagcaaggaactgctgggccgtatcggcatggtgttccaggagcccgaacaccagttcgctgccaactttgtgcgtgacgaggtatccatcggccccaagtcgatggggcagagccaagacgaggcttatcagaccgccgaccgcatgcttgagcagatgaatctcacgcgcttcgccaaagccaacccgtacaccttgtctggcggggagaagcggcgactgtccgtggcctccatgctggccgccgcacccaaagtgttggtgatggacgagccgacattcggacaggatttcagtacgtggaatgaaatggtcaagctgatcgccgccatccgcgaccaaggctcgtgcgtgatcatggtgacgcacgatgaggcgctggtggatgcgctgggcgcacgacgtgtgatgttcgaggaggcgaaggcatgagtgacgtggtaaccgtcagcccgcaggaaacgcgcgtggagccggtcaaagcctcatcgccctcatggttcatcgcgcgcatcaacgcggtcagtcgcatcatcggtgcgctgttgctgtgcattccgatgttcatcagtctggatgcggtatccgcatccacggcgctcggcatcgaattcgtgctgctgtggattggtggcgtggctccgtggaccgtatgccgtaagacctggccggtatggatcgccgccgccggcagttttatctccgtgttcctctacggccgcacctcgggcgagatcctgtggcagggtggctggattgtgatcagcgagggatccatcaatctggccatcgccacggctatcagggtggcggccattgccgtacccggcgtgattctggccttgggcctcgatcccactgatttggcggacggtctggttgagattctgcacttctcaccgcgattcgtatacggcggattggccggattgcgcatgtttacgctgctgcaggaagattggcgcgcactcggcttgtcccagcgttcgcgcggccttggtgacggtaacgccatcgcccgtgccctctcccaagcgttcggactgctggtgctctccatccggcgtgccaccaaacttgccaccgccatggaagcgcgcggcttcggctccggcgccccacgttcccaagcccgcatctcgcgtctgaagcctatcgactggatcttctacgtcatctgtctggccgtcccgctggcctccataggcgtagccgtcggcaccgggaattggcacttcgcctttcagggtgtctgaaaggcggcagactggcacagtgcctttcagggtgtctgaaaggcgacagattagcacagtgcctttcaaggtgtctgaacgccttatgatgcccccgctggcgggggctgtcggcgtagccgactggggtggttccagcctcgaccaccctcagtctcgcgactgacgtaatgacccggcagtagggtagtggctatgcccatcaacgcccagattcttgataatccgaaatccgaccgcgtgcgccgcatcgccgatctgacccgcgccaaaggccgcgaacgttcgggccgttttcttatcgaaggcccgcaatccgtgcgcgaggccgtcacttggcggccggacgtggtgcaggacctgtatgtagaggtttcgcaggcgctggaacatccgcgtatcatctcctccacgttggagaagatcgtcgaaacctcgcaggatgccacgatttatgtgcactactgcaccggcgacgtgatgcgccgcatcagtccggacgcccaaggcatcgcggccgtcggcaatgccgagtccatgcacgccggagccgatgacgtcgaacttggcaagaacggtcgggccccgcagattgccgccttctggcaggtgcgcgacccgggcaacgccggcatcgtgatccgtgcggccgatgcggccggctgcgacgccgtaatcttcgtggacgactgcgtggacgtgctgaaccccaaggtcatccgctccaccgcaggctccctgttccatctgccggtactcgccatgagcaccgacgaattcttcacctggacaggcgaccataatatggacgtctgggccgccgacgtatacggcaccgaagaacgcaagccggaaagcctgcccgcagtactggcggacaaggcggcggtcgaggctccgaaagccgtgctgttcggcaatgaggcgcgtggcttggaaccggacatcctcacgcgctgcggccgcatcgtctccatcccgctttatggcaaggccgaatcgctgaacctcggcacctcggccgcggtgatgctgatgtcgctgtctatgtcgggtcatgttgaaagaatgtgaaaccggtaaaaacgctgtgaaacgctgagaaaacatcagacgaaagggttctcgtggcagaacaaatggtgttcgacgccgaccaggtgaccgctgaggttgccgagggcatcgagaaaatccagaacgcctccaacctggaggagctcaaggccatcaagacaacgtacgcaggtgccgattcggcgatgaccaaggccagcaaggccattggctccctgcccgccgaccagaagaaggaagccggcaagctcatgggcaagctgcgcgccgacttcggccgcgcctatggtcccaaggaggtcgagctcaaggaagccgccgagaaggccgcgcttgccgccgaaaccgtggatatgacgctgccggtgagccgtaagcctctgggcgcccgtcacccgctgcctaagctgatggaggacgtcgaggacttcttcatctccatgggctggcagatctcctccggcccggaaatcgaagccgaatggtacaacttcgactccctgaatttcggcccggaccatccggcccgccagatgcaggacaccttctacgtcaagggcaatcaagccaaggacgccgccggtttcgtcggctccaacatggtggtgcgtacgcagacctcctccgatcaggtccgtgccctcctgacccgtggagtgccgctgtacatcgcgtccccgggccgcgtgttccgcaccgatgagctggacgccacccatactccggtgttccaccagtgcgaagccctcgccgtcgacaagcacctgaccatggccgacctgaagggcgtgctggacaagctcgccgtcgccatgttcggccctgaagccaagacgcgcctgcgcccgagctacttcccgttcactgagccgagcgccgaactcgacctgtggttccccgacaagaagggcggccccggctggctcgagtggggcggctgcggcatggtgaacccgaacgtgctgaagtccgccggcatcgacccggacgtctacaccggtttcgccttcggcgtcggcatggagcgcacgctcctgctgcgcagcgacatcaacgacatgcacgacctggtcgaaggtgacgtgcgtttcgccgaacagtttgtgatgggggagtgattcagccatgcctatgatcgatatcgattggctcaaggaccatgtcgaggttcccgaaggcctgacctacgaacagctcgccaaggaccttgtcaaggtgggtcttgaggaagaggagattcactcctctcaggtgaccggcccgattgtggtcggctacgtggtcgacgccacccccgaaccgcagaagaacggcaagaccatcaactggtgccacgtggactgcggcgacgaatggaacgagaccgacgaagacggcaacaaggtgccgcgcggcatcatctgcggcgcgcccaacatgaaggccggcgaaaaggtcgtcgtcaccctgcccggtgccgtgctgcccggcgacttcaagatcgaaccgcgcaagacctacggccacatctccaacggcatgtgtgcctccgaacgtgagctgggtctgggcgacaaccacaatggcatcatcctgctgcgtcagtatggcttctccgaggctgaatacgaggctctgaagcctggtcaggacgccatgcacctgctgcacctcgaccagcctctgcttgagatcaacatcaccccggaccgtggctacacgctgtcctaccgtggcgtggcccgcgaataccaccactccaccggtgccgcctacgccgatccggccgtggcactcaacgagaaggccccggaacctgctgactaccagcccggcaccccggtggacatcgatgttgaaatcgacgataacaatccgattcacggcgtgcccggttgcgaccgctactacgcgcgtatcgtcaaggacttcaatcccaacgcccacacgcccaactggatgcgccgccgcctgatccgcgccggcatgcgctccatctccttggccgtggacgtgaccaactacgtgatgcttgacctcggccagccgatgcacgcctacgacctcgacaagctcgaaggcccgattgtcgtgcgccgcgccaacgagggtgagaaactcaccaccctggacggcaaggaacatgacctgagcgtcgaagacctgcttatcaccgattcgccgaacggcgaacgcggctcgcgcatcctcggccttgccggtgtgatgggcggcctgtatggcgaagtgaccgccgacaccaagaacattcttctggaggccgcgcacttcgatcaggtgaccatcgcccgttcggcccgtcgccacaagattccatccgaggcctcccgccgcttcgaacgtggcgtcgacaccgcgctgcagcctgccgccacccagatggccgccgaactcatggccaagtacggcaacggcgagcccagcgaacacccgaacgacgtgaacaacacgccgcgcgccaaggccatccacttcaaggcctccgaagtggcccgcgtagccggcctcgacgtggacatcaaccgcatctccgacatcctgaccgacattggctgcacggtggccggtggcggcaacggtgagttcgccgtaaccgcgccgagctggcgtccggacttgaacgagccgtgcgacctggtcgaggagatcgcccgactggtcggctacgaccagattccgatcaccgtgccgccggcaccggtcgagggtctggtgggcctgaccccggaccagcagcgtcgccgtcgcgtggcggacgagctcgccgagttcggcatggtcgaatcgctgagctacccgttcgtgggtgacgacgattacaaggccttcggcttcgacccggaagccaccaagaaggtcagcgtcgagatcgccaacccgctctacggcgaccgtccgtacctgcgtcgcgagattctgccgaccctggccaccaccgtgcagcgcaacatccgccgcggcatcgaaaacgtgtccctgtacgagctcggccacgtctacctgtgggatccgaacgcgcccgccatcccggcactgcccggcggcgtgcgccccaccgacgaacagctcgccgcgcttgacgccggtctgcccgaacagcccgaccatgtggccggcatcctgaccggtctggccgaggacgacggctggatgggcggcaagcgcccggtcgactggtccgacgccgtcgaggccgtgcgccgcatcgccggccgtatcggtgccgcaatcgaactcgaccagcccgccgccgacgatgtgccagtccaatggcaccccggccgcgccgcccgcgtcatggtgggcgacgtcttcaccggctgggttggtgaactgcacccgcgcgtcaacgaggcgctcggcttcccggcccattccgcggccttcgagctgaacctcaccgcgctgttcgccacgctgaccggcaagcccgtccaggccaagccgatctccacgttcccgccggtcaagcaggatttggccttcaccgtggacgagaccgtgaccgcaggccagcttgagaacgtgattcgcaaggccgccggcgcgaacctcgaatccatcgaactgttcgacgtgttcaccggcgaacaggtgggcgagggcaagaagtccctggcctatgcggtggtgttccgttcaccgagcaagacgctgtccgccgaagacagcgacgccatccgcaaggccatcgtggctgaggccgccgaaatcggcgcccagctgcgcgcctgacccaaccaatcatccgaatcgaggagcgccatgagccaagcggagcaggacaagccgaaatacgggcagtaccagcagcctgaatatggtgctatgtctggccaatacgggccgaattacaacccgtatatttatggcgctcccgagccggatactaagaaggattccgccgcagccgctggcgataacggtggcgcggcacaatctcagcaggctggccagccgtatggtcagcagccggcgtggcccggcaatcagcaggcgggcggctggccgtacgctcaaggcggccaacagtccggtccgggcgcatatccgggcgggtacccgggcatgcagggccagccgtatggtcaacagccgaacggtcagcctcaccagccgcattattaccacggcatcgacctgaacgatccaaaccagaacccactctacgggcactgggattcgtatgcgatcatctcctttatcctcgccctgttcttcccggtgccagtgctctcggcactgatgggcgcggtggcaatgtggcgcacgcgcactttccatatgaagggcttcggtttggccgtggccgccgtggtaatcaacgtgctgtacaccatcgccgtcatctggatggccttcaatggctatgacgccatgagcctttaccaggaagccctccagcaactgaccggcggcaccggctcctcctccgactccatctccgcataagtagcgttcacataccaacacacccactgcataaatatgcaatagtctgcataatcgcgtatactcatccgaagacacatcagtgaaaagagatgagtatggcgaaatatacagtggccgtggccggtgccacgggctatgccggcggtgaagcgctgcgcattctggccgcgcaccccgacttcgacatcacctgcgtggcaggccattcctcagtgggggagtcgatggccaagcacatgccgcatattccccaactggccaatctggtcgttgaagataccacgcccgaagtgctgaacgggcatgacgttatcatcctcgcactgccgcacggtgcttcgggcaagctcgcctcgcagctcgatccgaatgccgtggttgtggatttgggcgccgaccatcgcctcgaagaacaggccgcttgggatgagttctacggcggcgatttctatgagcattggacctacggcatgcccgagctcatcaccggcaaagctgcggacggctcctacacccgccagcgtgcggcgcttcctggcaccaagcgcatcgcaggtcctggctgcaacgtcaccgccaccacgctggccctccagcccggcatcgccgaaggactggttgaatcgcaggatatcgtggccgatctggtcgtcggatactcgggtgccggcaagaatctcaagcgcaccaacctgcttgccgccgaggccctgcaatccgccctgccgtattcggtgggcggcaagcaccgccacattcccgaaatcctgcagaacttcgcccacgcggccggcaagagcgcggccgaagccagcgaattcacgctcggcttcacaccgattctcgcccccatgtcccgaggtatcctcgccaccgtgtccgcccgcatgacggacaaggccaagacactgagcgatgaggagattcgcgccgtatggtccaaggcctatgaaggtcaggacttcatggtgctgctgcccgagggcacgctgcccgccaccggcaacatcatcggatccaacgcagcccacctgcaggtcgtcaccgaccgcaaggccggccgcatctacgcttttgccgccatcgacaacctcaaccgtggtaccgccggacaagcggtccaatcactgaacatcgcactaggcctgccggaagacgcgggcctgaccaagatcggagtagcaccgtgagcgttacatttgcacaaggtttctccgccgccggcgtggcggctggtatttcatccgtcgaaggcaagaaggacttggccctcgtggtcaacaacggcccgctcgacgcggctgcaggcgtgttcacctcgaaccgtttctgtgccgccccggtgcagtggagccgtaaggtcgtcgccgacggtcacgtcaaggccgtgattctgaactccggcggtgccaacgcctgcaccggcgaggccggttacgcccagtccgtcgccaccgcggaaacggtcgccgggctcatcggcgccgaaccgaatgatgtggctgtctgctccaccggtctcatcggtgaactgctgccgttggacaacgtgctggctggtgccaagagtgcccatgaggctcttgccgccaccgccgaagccggcaccgacgcctcccacgccatcatgaccaccgacaccaagccgaagacggtcgaactgaccggctccaacggctggaagatcggcggcatggtcaagggctcgggcatgattgccccgcagctggccaccatgttgtgcgtcatcaccaccgatgcggttgtctccgccggtcagatgcaggccgcactcgctgtggctgccgaacattcgttcaaccgcatcgacgtggacggctgcatgtccaccaacgacacggtcctgctgctcgcctccggtgcctctggcatcgaaccggacaaggacgaattcaacaagctggtgcgtgaggcctgcgcatccctgtcccgccagatcatcggcgacggcgaaggtgcctcccacgacatccgtatcaccgtcaccggtgccaccagcgaagacgcggcacttgcctgtggtcgtgccgtcgccgcctcgaacctgctcaagtgcgccatctccggcaacgatccgaactggggccgcatcgtcagctccctgggcactgtgccgcctgaagtcgcgccttacgattcgaacaaggtgaccgtggacgtcaacggcgtgcgcatctgcgagaacggcggtgccggccgcgaccgtagcgaggtcgacatgaccccgcgcgaagtccacattgacatcgacctgaacaccggctcggacgccgaggccaccgtctggaccgacgatctcacccacgaatacgtccacatcaacgccgactacgaaagctgacaaacagcccagtgggctgtttgtagcagccggcagcgatagcgtcgccggcgtcgcagaaaagagaaaaattgtctacagaattgaagggacctgggttccatttcgacgtgcacaccgatttgcgcgccgatcagaaggcagaagtgcttattgaagcgctgccatggctggaggagttcgccggccagcgtatcgtcgtcaaatacggcggcaatgccatggtcgatgaccatctgaagcagtgcttcgccgaagacatggtctttctgcgtcaggtgggtctgcacccgatcgtcgtgcacggcggcggtccgcagatttcccacatgctcaaggccctcggcatcaaatccgaattcaaaggcggcctgagggtcaccacccccgaggccatggatgtggtgcgcatggttctgaccggcaaggtgtcacgcgaactggtaggcctgatcaacgcgcacggcccgctggccgtaggtctgtccggtgaagacggcggcctgttctcggccatgcagcgcaggcccgtcatcgatggcaagcccaccgatatcggcctggtcggcgacgtggtttccgtcgatgcctcggcagtcgaggatctggtggctgccggtcgtatcccggtcgtctcttccgtggctccgaacgaagaagatgccactgaagtgctcaacgtgaacgctgattccgccgccgccgctttggctgccgctgtgggcgcgcacaagctcgttatcttgactgatgtggatggtctgtacgccgattggccggataagaattctctgattggccggatcggtgtggaaaacctgcgcgatatgctgccggacctggaatccggtatgcgacccaagatggaggcctgtgtcagggccatcgacggtggcgtgccccaagcccatgtcatcgacgggcgcaagccgcattcgattttgaacgagatattcacctccgcaggcatcggtaccatggttatgcccgatgaaggactggaaatgaggagctcttatggctactgagcatgaggaaaaactaggtacggaagacagcaagtggctgggagagtactctcaggtccacatgaatgtgttcggtacgccgttgcgcgtcatggatcacggccaaggtgcccacatctgggatgttgacggtaacgaatacctcgatttcctggcaggcatcgccgtcaattccctcggatacgcccaccccaagtgggtcaaggcggttgccgatcaggctgccaaggtggcgcatatcagcaactatttcgcgtccgagccgcaaattgaattggcatcaaaactggtcaagctggctggtgcacctgaaggctccaaagtctacttcggcaactccggtgctgaaggcaatgaagctgccctcaagctcgccaagctgtatggacgcaccttgcctggtgccctgccttccatcggcggcaagcccgcacgcattctcgcaatgactcacggcttccatggccgtacgatgggtgcgctgtccgccacgtggaaacccggtatccgcaagccgtatgatccgctggtgccgaacatcgaattcgtgcgcgccggcgacaaggtcgccctgcacgacgcttttgcacagaccggtctcggtcgctatggcaagggtccggtggctgctgtgattctggaacttatccaaggcgaagccggcgtgcagccgttgggcgccgattacgtcaagttcgtgcgcgaactgtgcgatatcaaccacgcgctgcttatcatcgatgaagtacagaccggtatcggacgtaccggcaagtggttcgcattccagcgtgacgatctgtccggcggcgtgacgccggatatggtgactttcgccaagggtgtggcaggcggattcccgatgggcggcatgatcgctttcggcgagaaacttgcggctctgttcactcctggttcccacggctccacctttgccggcaatccgctgggtgcggctgcgggactcgccactcttgacgtgattgaagacgagaatctggtggccaacgccgaagctcgcggcgaacagctgcgcgatggcattatggccaccggtaatccgctgttcgtttccgtacgcggccgtggtttgctggacgccgtcgagctcaagcatccctgctcccacgcggtgatgaactactgcctcgaacacgggctcatcgtcaacgcggtggctcccaatgcgctgcgtttcgcaccgccgctgattgtaaccgcacaagacgtggaccaggcacttgccatcctcaaggatgtgcctacggacctgcccgacgactgatttctctctgtcactgccgacccaccgatccaaggagatcatcatgaccccagaacttcgccacatgctgcgtgacgacgacctcaaccatgaggaacagaagcaggtgctcgaacttgccatcaagttccaccacgaccgcttctacaagcagccgttcgccggtccgcaggccgtcgctgtactgttcgacaagccctccacccgcacccgttccagcttctccatcggcgttgccgagcttggcggctacccgctggtcatcgacaagtccggctcccagctgggccgtggcgagcccgtggccgataccgctcgtgtgctcaaccgcatggcttacggtgtggtgtggcgcaccttcggccagggccgcgtcgaagaaatggccaagtactccacccatccggtggtcaacgccctgaccgatgacttccatccctgccagattctcgccgacttccagaccatcgccgagcaccgaggcggcgtcgacaacctgaagaaccagaccatcgcctacctcggtgacgcggccaacaacatggccaactcctacctgctcggcggtgccgtggccggcatggacgtgcgcgtggccggcccctacggctacctgccccgcccggacatcgtggccgacgccaagcgcatcgcggccgagaccggcggctccatcctggtcaccaccgatgccaaggaagcggtgaaggacgccgattgcgtgttcaccgacacctgggtctccatgggcgaggaagccgaatacgccatccgttccaagccgttctgggattaccaggtcaacaccgaacttatggcattggccaagccggatgcgctcttccagcactgtctgcccgcctaccgcggcaaggaagtcaccgctgaagtgatcgacggcccgcagtccgtggtgtgggacgaggccgagaaccgtctgcacgcacagaaagcgttgctgacttggttgaccggcaaggcccgtggagacgaaagcctgctcgcatgagtgaaaccggtccgtccctgcagcgccctgccagcagggcggcgcggctgagtgccatagaacaggcgctcgccacgcatatcatcacctcgcaatcacagctgtccaaaatccttatcgacgagggtattgcggtgactcaggcgaccctgagccgcgatcttgatgagatgcatgcggtgaagacccggctgaaggacggcacggtggcctacacggtgggtcgcagcgtcgttgcttcggaaggtgaggatgtaggggagcgcggtgaggcacagatgtctcgcgtgctgaacggactggtcacctcggtggccgccgccagaaatctggtcgtggtgcacacgccttccggtgccgcacaatacgtggcctcggtgattgacaagcagtcgatcgaaggcgtgctaggcaccatcgccggagacgacaccgtcatggtgatctgcaccaatgacgacaccgccgtcttccgctccgactggctactaagcctcgcctccaaataaccaacacgccgtgcataaatatacagtcttctgtatatacttgcatcagttcgtttttcagaccttgaacgaaagggaaccaatggcagataacaagcgcattgttctggcctactccggcggtcttgacacatccgtcgccatctcgtacctgaaggagcgcaccggcaaggacgtcgtggccgtgtccctcgacgtcggccagggcggcgaaagccttgagaccatcaagcagcgcgccctcgcctgcggagccgtcgaatcctacgtggtcgacgcccgtgacgagttcgccaacgaatattgcatgaaggccctcaaggccaacgccatgtacgaaggcgtctacccgctggtctccgccatctcccgtccgctgatctccaagcacctcgtgcgcgccgcccaccagttcggtgccgacaccatctcccacggttgcaccggcaagggtaacgaccaggttcgtttcgaggtctccattgcctccatcgacccgacgctgaaggccatcagcccgattcgcgacctgtccctgacccgcgacgtcgagattgcgttcgccaaggagcacaagctgccgatcacccagaccgagaagtccccgtactccatcgaccagaacgtgtggggccgcgccattgagaccggcttccttgaggatccgtggaacggcccgaccaaggactgctactcctacaccgacgacccggccttcccgccggtcgaagatgaagtcgtcatcgagttcaaggaaggcgtgccggtcaagatcgacggacgtgacgtcactccgctgcaggccatcgaagagatgaaccgccgcgccggagcccagggcgtcggccgcatcgacctcatcgaggaccgcctggtcggcatcaagtcccgcgagctgtacgaggccccgggtgccgtggccctgattaccgctcatcaggagcttgagaactgctgcctcgaacgcgaacagcaccgcatcaagcgcgacatcgacaagcgctggggcgagttggtctacgatgcgcagtggttctccccggcgactcagtcgctcaacgcgttcatcgaggacacccagaagtacgtgtccggtgagattcgcatggtcctgcacggcggtcgcgccgtcgtgaccggccgtcgttccgactcctcgctgtacgactacaagctcgccacctatgattccggcgataccttcgaccagaagtcctccaacggcttcatcgacatctacggcctgccgtcccgcgtggccgcagcgcgcgacgtcaagttcggcaacggcatcgaggtcccggagaacaccgtcgagtaatcatttactttggctcccctcgttgaggggccgcgccgtaaagcaaacagcccagtgggctgtttgcaggtgaggtgcgaacgacagtgagccaacaatcagcagccgtcaggctgtccgtaattacaggacgctgtcgccgcagatgactgaggggagtacgagcaaagattatgctcgtgctcccctcgtttttttgccgatgacggaagaagctcagtgctctccgtaatgagttcggcagacggctatttccaggttttgaacatcgttacccgtaatgcggtatacgatgcggttcttttcatcaatacgacgtgaccagtatccctgacattgccgccatggaatacgaacaacttgaatccaccggtatgtagcccaacgctgatagtctgacaagcagtctgatttgtttgcaatccatggtttcaaggagccttcatgactgagaacaacgaacatctggccctgtggggtggtcgctttacgtctggtccgtcgccggaattggcccgactgtccaagtccacgcagttcgactggcgcttggccgacgacgacatcgccggttcccgcgcccacgcccgtgctctcggccgtgcgggacttctgaccgccgacgagctgcagcgcatggaggatgcgctcgacacgctccagcgccacgttgacgatggctccttcgcccccatcgaagacgatgaggacgaggccaccgccctcgaacgcggtctgattgacattgccggcgatgaactcggcggcaagctcagggccggccgttcccgcaacgaccagatcgcctgcctgattcgcatgtggttgcgccgtcactcccgcgtaatcgccggactcctgcttgacctcgtcaacgccctgatcgagcagagcgaaaaggccggccgcaccgtgatgccgggccgcacccacatgcagcacgcccagcccgtgctgctcgcgcaccagctcatggcccacgcttggccgctgattcgcgacgtgcagcgactgatcgactgggacaagcgcatcaacgcctccccgtacggctccggcgcactggccggcaacacgctcggcctcgacccggaggccgtggcacgtgagctcggcttctcccgcgtgaccgacaactccatcgatggcaccgccgcacgtgatctcgtggccgaattcgcgttcgtggccgccatgaccggcgtggacatctcccgcctgtccgaggagatcatcatctggaacacccaggagttcgccttcgtcaagctcgacgacggctattccaccggctcctccatcatgccgcagaagaagaacccggatatcgccgagctcgcccgcggcaagtccggccgactcatcggcgatctgaccggcctgctggccaccctgaagggcctgcccaccgcctacgctcgcgatctgcaggaagacaaggaggccgtgttcgaccaggtcgatacgctcgaagtgctgctgcccgccttcaccggcatggtcaggaccatgcacttcgacggcgaccgcctggaagaggaagctccgaccggcttcgcgctggccaccgacatcgccgaatggctcgtcaagaacggggtgccgttccgccacgcgcacgagctctctggtgcctgcgtcaagctcgccgaaggccgcggccaggaactgtgggatctgaccgacaatgacttcatcgagaccttcgccgcgttcctgccggccgacaaggctccgggagtacgcgaagtgctctccagccacggttcggtcgactcccgcaacggcaagggcggcaccgcttacggtcgcgtgcgcgagcagatcgccgacgccaaggccgaggtcgaagaactcaagctcttccccgcatccacgtcggatggctccgcctacaaagcccccggcacgttctagtcccaatgaagctccctctgatgagggagctctattttgttgttgtcactgcaacggcatacactgagaaaccgtaacgaacgggagccgtgaggctgagaggaagtcgccagacttcgaccggggaacttgacgcgggtcatgccgccgtaaggaatcgttgtcgcagatttgccgggttctccgatacagctttcattccgtttgcataattcagccgtgagacggtcgtgatggagccaatacatcacagcggtcgaacggtcgcatgattgggttcatgaatgggcgcaccacttaaggtacggttcgtttcgtgcacccttttttactatctgaaaggatattatgcaggtcaacggagagcaggtcacgctcgagacgccggtcagcgtcgccgattatctcgaagcgcacggattccgcgccgagcgtgtggccatcgaactcaatggtgagattatcccgcgcgataagcgtgccgacgccatgctcgacgaccagtgcgtcatggaaattgtgcagtttgtacagggtggatgaaaggaaaagctatgagcaatattaatccggttactgaagcatctgttgaggcgactccgctgccgccgcagcccgccgtcaccaatccggtcggcaccgccgcgccgattctcccggtggaagacaagccgctgaacctgggcggtcacgagttccagtcgcgattcattctgggctccggccgctacgacctgaacctcatcaaggctacggtcgaacatgcaggcacgcaaatcgtcaccatggcactgcgccgcgcgcagaccaccgagaacagcgtgctcgactacattcccgaaggcattacgctgctgcccaacacctccggtgcgcgcaacgccgaggaagccgtgcgtatcgcccgactggcacgcgaagtgtgccacaccgacttcgtcaaggtcgaaatcgaacacgagaccaagtacctcttgccggacaacgccgaaaccatccgagccaccgaaatgctggccaaggaaggcttcgtggtcatgccctacatgttcccggacccgattgcggcccgtcagctggaggaggccggtgccgctgccgttatgccgctcggttcgttgatcggctccaatatgggcctgcgcatgcgtgacttcatcgaaatcatcatcgccaacgcgcatgtgccggtcatcatcgacgctggtatcggccgtccgagccaggcctgcgatgcgatggagatgggtgcggatgcggtgatggcgtacacggccgttgcctctgctggcaatatcccgctgatggctgaggcgttcaagcacgccatcgatgctggtcgtgcggcgtatttgtctggccttggcaaagtgaccgagggacaggctgtgccgtccagcccgactacggggtatttgcactgacacttttattagctcccctctctgaggggagctggccgcgtagcggactgaggggagatggaaacatggagaaaacatggcattgactgatgaacaggtggagcggtacgcgcgccatctgattttgaagggtgtgggggtcaaagggcaaaagcggttgctggcctccagcgtgctcatcatcggagcgggcggtcttggttctccggccgccctgtatctggcggcggccggcgtcggccatatcggactggtggacggcgatgtggtggatatgagcaatctgcaacgccaaatcatccataccactgcacgtgtcggagcgcccaaagtggaatccgcggccacagccatccgcgcgctcaacccggatgtgacggttgatacctactacgagctcgtcgacgcgagcaacatcgccggcctcatcgaaccgtacgatctggtgatcgatgccaccgacaacttcgccgcaaaattcctcatcaatgacgcctgcgtgctggccggcaagccgtatatccatgccggcgtggtcggattcgccggtcaggtgatgaccgtcattcccggcgaaggcccctgctaccgctgcatcttccgcgacctgcccgccgccggtgagattccgacctgcaaggaagccggcgtactgggcgcggtggtcggcgtgatcggcagtctggaggcgactgaggccgtcaagctgattgccggcgtgggggagccgctcgtggctcgcatgctcactgtggatgccctgaccatgaatattcgacgggtcccactgccaaagcatgtgccggattgcccggtgtgcggtgagcagccgaccattactgctattgatccggccaactatattcagccggcctgcgcgatttagagctatgtggtgcccctccttgaggggtgccaagatcagaacgagaggggaagaacatgcctattgctttgcataatgcggtcgatgacgatgagagcagtgaagcatcgtaccgccgcatcacgccggcggaatttgccaagctcgacccgaatacggtcacgctgctcgacttgagggaaccagccgacttcgccgcccacccggtcgaaggtgccatcaatgcaccactcgaccctctggcccatgtgctcaaaaccgtgcccacagatcgaactgtcgtagtctattgtgctcaaggatggtggagcgaggaagtagctgaaatccttgccgatcgcggctacgatgtagcaagcctcgatggcggttttcaaggttatctcgactatcttgaaacccaccacgattaacggttcccgttgtcgttcttttggatgagtgtgcacggacatatttgtgccctacaatcggtcacggtattactcgatggattcttgaatatcgccgggtaatcgtaattcacaacaggggattgcactgaaccaacccaaaacgggaaggaccgaaaatcgtgggacatctgctcacccgaacgcagattcaacgcctggtcgccaagcacggccgtgaggtcatcgagcatcgccacatgcagatcgaacgctgctgctaccagcacggcaatgtcaccacgttcgaacattccgtgcgtgtcgcctgcctggctgtgtggatggccgaccgcgcacacctgtggtaccgcgtcgacctcaaatccctgattcgcgcggccctcctgcacgattacttcctgtacgactggcacgactgggataacggcgaacaccagtggcatggcttcacccatggccacgccgccctggtcaatgccctgaaggacttcaagctcaacgatatcgaacgcaacagcatcgagaaccacatgttcccgatgaccccggtgccgccgcgctatatcgaaggctatctggtcaccttggcggacaaatgctccgccaccgccgagaccttctcgttcgaccggttcaacaagcgcgcgttgcccgccgcgaagccttacgccgagatcgaagcccgtcgatgatcatcacactcgaacattatttcctctggtttctgttctacagtttcgtcggctggatgtacgagtccattctcgtctcctgccaacagcaccgcttggtcaaccgagggttcctcaacggcccgctgtgcccgatctacggcaccggcgcgatactcggcgtcgccattctcggcaacgtacataacccgatcatcatcttcctgatttcgatggtgggcgccacgatactcgaatacacaacctcgtgggtcatggagcagctgttccacgcccgctggtgggattactcgaacttccgcttcaacctccaaggccgcgtctgcctgctgggcgcgttgattttcggcctcggcggcgtgggcgtggtacttggttcgcagccatatgtcgagcgggtcacggatatgattccgctgccgatgctgcatacgctggtcacggtactggccctgatcaccatcatcgacttggcggtcacggttgcgggcatgctcgaattcgagcgggtgctcgattccgtctctcaggtggtgcaggatgtggcggcacgcgccggtggcacgtggcagtggggctccagtgcggtatccgacaggatgcgtgagctttcgcaggatacggttgagcgtctgcgctgggccgtcaatggcgtcatcaacgcacagcagaagcgtatgctcaagtccttcccgaagttccaggtgccggatcgtcaggacatcatcgactctttgcgcgaacttatgggcccgcgccgctagaataaggcgttttactgaatcgcgcggctcggctggtgttcggcactgtcgccatgttctgcgaaacttgactgtgcccgattgggcagtcttattcacaattcgatagggagaagcgacaagctatggctcacgtcaccgacttcaaggaagcgggtttcaacaccctgcttgaggaactggaatggcgcgggttgatttcccagtccacggaccgggatcgactcgcagaagcactgaacggcgagcccatcacctattattgtggcttcgatcccaccgctgcatcgttgcatatcggcaacctcgtgcagctcatcaacatgcgtcacctgcagcttgcgggccatcatccgatcgctttggtcggtggcgccaccggactcatcggcgacccgcgccagtccggcgaacgtacgcttaacccgaaggacgtggtggccggctgggccgatcgcctgaagaatcagatcggcggcattctggacaccgaaggcgcgaacgccgtacgtttcgtgtccaattacgattggaccgcctcgatgaccgtcatcgacttcctgcgtgacgtcggcaagaacttccgtctgggcaccatgctcgccaaggacacggtcgcccgccgcctgaactctgaggaaggcatctccttcaccgagttcagctaccaggtgctgcagggcaacgacttcctccacctgtttgacgaataccactgcacgctggaactcggcggctccgaccagtggggcaacctcacctccggcctggacctgatccacaaggtgcgcggtgtggacgtcaacgtgttcaccagcccgattatcaccgatgcttccggcaagaagttcggcaagtccgagggcaacgccgtctggctcgacgccacgatgctcagcccgtacaagttctaccagttctggatcaaccgcccggacgtggagatggaaagcctgctgaaggcgttcaccttcctgcccaaggccgaaatcgaacgactggtcgaggaatccaagaccaaccccggcaagcgcgaggcccagaagacccttgcctgggaggtcaccagcttcgtgcatggcgaggccgctacccaggctgccatcgatgcttccggtgcgctgttcggccgcggtggcaacctcgaagacatcgacgaggaaatgctggaatccgtgctcgacggtttcaaggtggtcgacgagaacggcgagcacgtcttccccgtctccaagcccggcgatcgcgtaatcgacgccgcccaggctgccggactgttcaagtccgcttccgaggcacgccgcgccatcaagtccggtggcgtgtatctcaacaacaaccgtatcgaggatgaggagcaggtgctggccgaagccgacttcctggcaggccgcttcgcgcttatccgtcgtggcaagaaggcgctcggcgccgtggaaaaccgttaatcaacaacgaattaaggaaaacaagtaatggcagaaggtaacgagcgttccggcaagtcttacggcggcggccataaggggtatggcgatcgccgaccgggcaaccgcggcggcaagggtttcaagccgcgcggcaagggcggtttcaagccgcgtcatgatggtgagggtttcaagccgcgtcgccgtgaggatggcgagggctacgcgccgcgccgtgacggtgatggcgagggccacggcggctaccgcaagtcgtacggcaagtccggcggcttccacaagggcggccgctccggcttcggcggcaagggcggttaccgcggcaatggtccgcgccgtgacggcgaaggcttcaagccgcgccgcgaaggcggctaccgttcccacgaaggcgagaacggcgagaatccgcgctaccagcaccgtgataacgatcgtcgtgatttccgccgcgatggtgagcgtcgcagcttccgccgcaacgacgaccgccgagatttccgtagggacgaccgtcgcgatggggaccgtcgtgacttccgtcgtgacaatgaccgtcgtgacttccgtcgcgatgaccgcagggataacgatcgtcgtgatttccgccgcgatggtgagcgtcgcaacttccgtcgcgacgacgatcgccgtgatggcgaccgccgcaacttccgcagggacgaccgccgcgatgatcgtcgtgacttccgccgtgacgatcgccgcgacaacaaccgtcgtgacggcgaattccgcgagttttcgcaggaagagaagcgccagtaccgtgaggagaagcgctctgaatacatgaggcgcccgcgccgtaactccgacggcacgatgagcttcccctcgcagaacccgtacaccgaccgtcgtcccgacgagcccaagatgcccaagggcatggaatggtcgatgctgtccaaggatgagcgcgaacgtctgcgcggcctgtccaaggagcacgcggagaacattggtctgcacatcctcgccgctttcgcgctggaggagagcgaccccgaacttgccttggagcacgccaagtgggtggcccgtcaggcctcccgcatcgacttcgcccgcgagacgcttgcgttcgtggcctaccgtcagggcgactacaagctggccctgcgtgagttccgcaccgcctaccgtatgaacggcttcctcgactacctgccgttcatcgctgactgcgagcgtggcgtcggagagccgaagaaggccgtggaactggcgctgtccgatgagggcaagcagctgcatggcgctcccaaggtcgagatgttcctggtgtacgccggtgcccttggcgatttggagatgtgggacaaggccattgaagtggttcacaccgtcggccgttcccaggggctgccgggtgagtaccgcatgcgtgccgtgcaggccgagcagtacttccttgaagaggccggccgcagcaaggaagccgagcagctcaacgacctgctggaccgtcttgaggaccagtatgccgacgaggagattgacgaaaacagcgacgacgtggtgatcgatcacgatctcgaagacatcaccgacgactccgacgtgctcgaaaagctcggcatcgatccggatgaggcgcagtacgccccggatccggagcaggaatacggcgatgaggatgacgaggctgaagacggtgatgccgagtctgatgaggccgacgagaccgagaccgattccgccaatgactccgaggctgacgattccgccgaatccgccgactccgactccaccgaacccgaaaccgaggagtgaacggcgtaatgacccgtttcctcaaaggcaccgatcgcccgctcgccgaggcctatcagcttgcgctgctggacctcgacggcgtggtgtatcgcggcaagaatccggtcgaatacgcggccgattccattcgtgcggccgaagccgccggcatgaccatcgaatacaccacgaacaactcctcgcgcttccagcacgtggtggccgaccagctcaagggcttcggcttggacgtggagccgtggcaggtcatcacctcttcggtggtggccgcccgtatggtggccaaggcgttgcccgccggcgcgcgcgtacaggtattgggcgccgagcatttgcgcgatgaggtcacccgcaacggcctgaccatcgtggacggtcctcaggaccgcccgcaggccgtcattcagggctggtatccggatatgacttggcagatgatggccgatgccgcgttcgcggtcgaggccggagccacgtatttcgtgaccaaccgcgacctaacgattcctcgtgaactgggcatcgcccccggttgcggatcgatgattcgcgccgtgatcacggccaccggcgtcgaaccggtcgcctccgctggcaagccggaagcgtacatgtatgatgaggcccgcgaactgaacgccgccgaaggccacgatttggtgcccaaggaggcgtccatcgccattggcgaccgcctcgacaccgatatcgaggccggtaaccgcggcgactacgattcgctggcggtgctgaccggtgtcaccaacccgaccgaactgatgctggctccgtcacacctgaggcccacattcatcgcccctgatctgcgtgaactcggcgaagcccaaccggagccggtccgcgatgagagcggtacttgggaatgccgcaaggctagcgcttggtttgaaaacggccaggtacacgtcagcgaccccaccagtatggacggcctgcgcgccgccgtatgcgccgcatgggaagccgccgaccaaggcgcacagcttagcgaggccacggtaccggtgttcgccatcgaggcatagtcctatgcctacggatagcgaacatgcgccggtcaccgagcgataccccgaacttgcggatatcgatgaacaagacaacgaccgcaagcttgagacctatcgcaacgtgctggaatccttacaacacgagcttgataacagccgcagctagcagaggtgattcattctcccgccagcggaagatgacgtgaagtgctggatggtggctccatgccgagccaccccgttggtggatggtgggccgaaaggaagatatatgaccgagcagcatatcgatcccgcgactccacttgaccgacttgacatgatgctcgtggcttcgggactggtcgaatcgcgggccaaagcgcagcgactcatcaaggccgggcatgtgcgcgtggacggcgagaccatcaccaagccatcgttcatggtcaaagccgggcacagcgaactcgccgtggataagggcgacgactacgtctcccgaggcgcttacaaactcttgggcgcgttcgaaacctttgccggcaatggccttaccgggccggaaggcttggaatgtctggacatcggtgcctccaccggtggcttcaccgacgtactgttgcgcgggggagcggccaaagtcgtagcgctcgacgttgggcacggccagctcgacccgcgcatcgccaatgacgagcacgtcatcgaaatgagcggcgtcaacattcgcgaagtagaggccgacgacctgccttaccggccggcgatgatcgtttccgacgtctcctttatttccctgacctatgtgatcccggtaatcgcgcgcatcgcggctcccggtgcgcagattgtgttactggtcaaaccgcagttcgaggtcggccgggcaggactcggcaaaaacggcatcgttgaagatccggcattgcgggagcgggcattacacgacgtggtcgcctgtgctgaacagcacggacttgacgtggtggccactgccgatagtcccatcatcggcacccacggtaatgaggaatacctgctttacgctgtcttgagatgaatgcgttggcagtctccgttcaccagcagcacgctggaggtacggtcgatgcctagtgcggtggcacacgtggcgctttccaccgcactgccgttgcgtagcatggcggagtccgccgtcaaagtccggcattgcagatggttggcttcaaccgtgacggctgtgatatggcgaaccgtgctgccatcctcatacccatccatatcaaaacgggaaaacatcgtactgcggagtggatgaacttccagagccctgctgttgacgtcatgacccttcaacacgccgttcaagcggactgtctgaccgctaatatgacgggtgcctagggagccattgacggacagatttccggaacaaacgatatcgccgttgcatcgtagtttgccggtaaaggttatttcatcgcaaataatgtcgccgccgacttcgatgtcgccgctgccgctgatgctggatacgcgaatatcaccatcacaccgcacaatgccacttttgatgaccagtttgtccccttctataactgaggcctcgagggtgctggtcacaatcatggtgtgaaaatgcgcgccatcggcaagacgggaacgttggtccactcctatggtgccgtagactcctttgcctatcagcgtgcaattctgcgtatgcttgcccatgatgataaaactccccttattaatatggacgtacagctttatggcttattgccacaataatgagcgcatccatgttgagggggttatatcggtcacgatgtgagcagatagggggtatagcgagcgcagttagggggttagccttggatgaagtggtcgatctgatcctgcttgcccatgaggatgagttcgtcgttgcgatgcatgaccagttccttggagccgtactggaactccttgcctggggccttgaggcccaccacggtcacgccgtacttgtcatgtacttgtacgtcctcgatgctgcggcctaccgcgtacaggggcgtgtggaccttgacgacggtgtacggcccgtcgatttcgatgtaatccagataattgccggccaccagatggcccacgcgcttgccggcatcggtctccgcgttgatgatgtggcgggcgccgatgcgctgcagaatgcgcgcatgctcctgggacacggacttggcccacaggtcggaaacgccggcgtccagcaggttgccggtgatgatcaccgaagcctcgatgctgtcgccgatggccacgacggccgtgtcgaactgggaggcgtcgatctgctcgatggccagcacatcggtcatatcggcctgaatggtgggcagatgcgcggaccaacgggccacaagctccgggttcttgtccactgcgagcacatcctgacccatctggtcgagggtggcggccacggacccgccgaaacggcccagtccgatgaccagcacgcttttgttgccgctcggttttgctgccatgatgatggtcctctctatgtcagattgctgggcgccgattgaatggccgatcagccaacgataatgttttcctgcggataacgaataggttcgggagccatcggtcggctgatggagtaggcgatggtcaacgggccaagtcgtccgacaatcatctcggcggacagaataaacaggctggccggattgccggcgcttgccacgcccaccgaataaccacccaacgagaaggccgagcaggcttcgaacacggcgtccacgaacgcgcagccggtggtgaacatcagcatcatcgcaccgaccataaccaacgcaaagcaggccgtggtcacggacacggcggtcatctgaatacggcgggggatacggcggcggaacacggtgacatcgcgatggccggtgaatgcggcgcggcaaatcaagagaatcaccgcgaacgtggtgacacggatgccgccagcggtggatgaggaacctgcgccgatgaacatgagtatgctcatgaacaccttggtctcattcgtgacttcgggcacccaggaaatatcgaaaccggcggagcggggcatgacggcggcgctcatcgcacggcgcatcttcatgccggggtcatctgcggggaacaggccggtattgctccactcgaccagcaggaaccaagccagtgaggtggccaccagcacagcggtggtcaccaaagtgagtttggtgtgcaatgtccaacgtttcgggctgagccgccggcgtgcgcactgcaccagattcagcaccacggggaagccgagcgttccgatgaatgcactgatgagaatcggcagccccacgccccaacggttcacatgcagaccagtggcatccggcgtgaaaccggtgttgttataggccgacaccgcgtagaacagcgcctgccacaaggtacgccccatattgccatggttcacgcggaacaggtcgggcagcagcagcacgaaggtcagcacctcggcgatgatggaggtgcccagcaccacggtgagcacgcctttgacctcggaaagcttcgtggtgcccagctcgttcgcggtgagcatacgctgggagaccttgagtctgcgggaaacgccaagagccaccatcgaggcgaaggtcatgactcccagaccgccgaactggatggagaacaggacgacgacctggccgaacatcgaccagtattcgccggtgttcaccaccggaatgccgcaggtggacagggccgagacggcggtgaagaacgcgatcgggaaattggtgaagatgatgtccgatgtggagatcggcagcagcagcaaaccggtgacgatgatgatcagtgcgccgaaatacaccatggacagacggcccgggtgcctgagcagacggtcggtgatgctgatacgtcgaatgcgcttggcggttttatcgcttttgtctcggctcagtacatcggctgaataccaccatgacagtcccttcgaggcctcctcattggcggaggattcgtcgaagtcattggccatgggtcctcaagctcctcaactgatactgctgtacggtcatacggcatgccatcgcgctgcgcacggcacgcgtacggtgattgcgcggctgtacgccattgtatgccgaagccttacgataatcgactctgtggaacgttgccggcgacgcgccacgaagcagcatttttcgaacacctgtacgactgatgacggtgtctgcggttagaataatgagcagtgcgaccgaatcgacaggaggatgccatggccaagcgcaacgcggtggtggtgacgcataccaggctcaggcagaccggaaccgtagtggccgaggcggtgagccagctgcgagtggccggtttcgaagtcgccatcatcgacaacaccgaggcccccgatttcggcgtgcagccgccgtgcgtgtcggacgacaccgaaatcgtcgtggtcctgggcggcgacggcacgatactgcgcgccgccgaactcgtccactgcacccaagtgccgattctcggcgtgaacatggggcatgtcggcttcttggccgaattcgaaagcttccagatcgacgaggcgatccgccgggtctccacccacgactattcgatcgacgaacgcatgatcgcccatgtggacgtctggctgcccggcgccaccaagcccattgaggattgggcgctgaacgacatcacactggaacgcgccgaccggggcaagatggtcgaactgtccatccgcgtggacgatgtggagatgaactcgttcggcgcggacggcgtcatcgtctccacgcccaccggttccaccgcctacgccttctccgcgggcggtccggtcatgtggccgaacgtcaaggccctgcagttgattccgttggccgcgcacgccctgttcgccaggccgctgatcatcggctccggctcgaccttcaccatcgatattctggacgattccatgtccgaaggctggatttgctgcgatggacgccgtcagcgcgccctgccgcagggtacgcgcgtcatggtgcgcgaatcgcgcgataccttgcgcctcgcccgactctccggcgtgccgttcaccaaccgtctggtctccaagttcgatctgcccgtggtcggttggcgcgagcacgcgcgcaacgaggcctcgagccagtcgctgcatcacgggcacacgttcccggcggccgcgtatgcggctggcgttgccgttgccggtgacgctggcgtcgctggtaccgagcccgacaagccgggcgaacgtgacggcaaggcaggatcctgatgctcgaagaactcgatatccgcaatctggggccgattcgagaagccaccattgcgccggccgcaggcatgaccgccatcaccggtgagaccggtgccggcaaatccatgctgctctccgcgatccgactggtctccggcggggccgccgaatcctcgcgcgtctcggccggggcggacgaggcttgggcccaggcgattttcgcgctctcggatgatgccgtcgcatctgaacattccggcgacaccaacgatgccggttctggcgatgccgacagtgggttcaccggtgctgccgcggccgtggccaaggcccatgacgcgggcgtcgaccccgaagacggcgaactgttcctttcccgcaccgtacgcgcttccggacgttcgcgggctgtgctcggcggcaagtccgtaccgcgttcggtgctgggggccatcgccggcgaactggttaccattcatggccagaccgatcagctgaaaatcgcggcctcctcacggcaacgcgagtttctggaccgggtggccggagacgaagccgaactggccgcctaccgcaaggcgtgggatgcgctggccgccatggatgagcggctggaacgcctgcgctcgcaggaatcctctgcccgccaacaggccgactacctgcgcgaatccatcgaccgcatcaaccgaatcgacccgcagccgggggaggatgaggagctgaaggcgcgccgcgaacgcatcgaaaacgcggccgacatcgcccaaggcgtgggttcggcgctgggcgcgctggatgcctcgcaggtggatgtggacgccgccgacggcgcttcggccgtggaactcatcaatcatgcggtgacctcgttgcgcgcgattcgcgtcggcggcacgttctccgagcaggccgatcggcttgaatccatcaatgccgatttgggcgacgtggtgttcgccctgagccaggagctgggcgacgaaggcagcgtggaggatctggaccagatcaacggccgtatccacgagcttggcgacctcgcccgtcggtggggccccaccttggccgacgtgctcgcttggcgggacaaggcggcgttcgatctggaggatctggatgcctcgccggaaaaggtcgccgaactcgaatccgaacggcagacgctgtacgatgcggccctcgccgccgccgacgtgctgagcgccgcgcgcgtggctgccgctgccgacttgggtgcgcgcgtcactgaagaactcggctcgctcgccatgctgggcgcctccttggaagtgcgcgtcacgccgcgagacaaggccgatgatccgctcggcccgtatggtcgcgacgatatcgcgttcctgtttacgccgttcgaggggtcgccgcagttgccgatgggcaaaagcgcttcgggcggtgaactgagccgactgatgctggccttggagctggtggccgccgacacgcgcggcggtgccgaccagaccttcatcttcgacgaggttgacgccggcgtgggtggcaaggccgcggtcgaactgggcaaacgtctggcacggctggcccgcagcgcgcaggtcatcgtcgtcacccacttggcgcaggtcgcctcgtgggcggacgcgcagttcgtggtcaccaaggagccgccggatgccgatgacgacgatttgggcgtggtcaccaccatcgccgaagtcaacggcgaaacccgcgtccacgaaatcgcccgcatgctctccggcagcgaatccgaagcctccctggaccacgcccgagaactcctatccgattctcgacttacgctcccgctggcgggagctggcgccgcaggcgactgagggtggttgaagaagatggagattagcaaatgaccaaggccgccatattcgacctcgatggcaccctcctagactccatgggagtctgggaccaagtcgacatcgacttcctgaacaagcgcggaatcgaagtgccgcccgactacatgaccaaagtttccgccatgcaattccgccagatcgccgaatacaccatcgcacgcttcggccttacagacacgcccgaagagctcatgcaggaatgggacgacatggccagcgtcgcctattccaccacggtcgaagccaaacccggcgcgcttgactatctgcgcgatctgaaagactccggtgtcaaactgggtgtcgccacctcgctgcccccgcgtctgcgtgagccggcgctacgccacgtcggcatgttcgatttgttcaacgatatcgtctccgtcgatgacgcgaacgacgtcggcaaggaccagcccgacgtctacctgctcgccgccaggcgcctaggcgccgcgccggtcgactgcacggtgttcgaagacctgctggtcggcatgaagtcggccaaatcggtcggcatgaaggtctgggccatgcacgacgactcctccgcctccgattggcccgaaatctgccacctggccgacggtgtcctcttcgacttccatgacgccccgcgcgtgctgtgataaaaaagttacgcccccgctggcggggctgtcggcgggggcgttgttgggcatgggtacccctttccgaggccattgtaggcacgagtcatgtttcgacactataagctgacgatgtatttgctcactgtttgactgttatgtaacacaccttgacagttaagcagaacagttatactgtgttgtataacagctaaacagctggggtgctagtcaaccacaatcgaaaggggcataggtgaaactgatcatctcatccgtgtccggtgaacccatctacgagcaaatcaaaacccaaatccgttcggcggtgctcagcggcgagttgaaggcgggcgaggccctgccttccttgaggaaactcgccaaggagttgcgcatctccgtactcaccgtcaccagggcgtacaacgaactggccgatgagggcgtggtgcagaacatccaaggcaaaggcactttcgtgatggacaagggcaacgaactgatgcaacgtcagctcaaaacccagattcgcgaaagcctggccgaggcaagccggggcgccaaagccgccggcattccgctggacgcattggaccgcatgctcgaagaggaataccgcaagaaataacctcgagaaaggaccatggccatgaccgccatatccgaatccgacgcgatggcgttgcaggtcaccgacgtcaccaaacactatgattccggcttcacgctggacgacgtgaccttcgacctgcccaagggctacatcatgggactgatcggcccgaacggcgccggcaaatccaccctcatcaaactcatcctcaacatgatccaccgcgacgccgggtcgattcacgtgctcggcctcgacaacatcgccaacgaggagctcgtcaaagaacaactcggtgtggtgttcgacttcagctacatgcatgaacagtggcaagtcaagaacattgaacgtattgtcgcgccactgtatccatcatgggacggtggatgctatcgcaagtatctggatacttttggccttggtgacgcacagaacggcaagaaacatatcaaggatctttcccgcggcatgcagatgaagctgatgctggccatcgcattgagtcatgatgccaagctgctgattctcgacgagccgaccagcggactcgatgtgcttgcccgcgacgaactcatggatatcctgcatgcctacattgaggatggcgagcattcggtactgttcagcacccatatcactgccgacctcgaacgtgccgctgacttcattacctacatcaccgatggccgtctctactacaccggtccgaaagacgagtttgaggaatcgttccgcctgattaagggcggtccagacgaactggcacaactgcctgcggacgtagtgctgggctcacatacgtatgccaccggattcgatgcgctggtccggtcagacaggcttgatgctgttgcgtcggtggtttcggggcttgtcgttgaatcggcttccattgatgacatcattcgactgaccaatgcccatgattccaatcgtgacttgagcgggaggtgagcggccatggaggcaatactgagggtgtcgcggtctcggcaacatgcattgaccactgcattgcgcgtcgatatggcctacctgtgcgtcggcgaacggactgtgttctcgttgttgttggcaccgttgttctccgtcatctttcaaggtgaagcttatggtgatggcttcggctatcgcatgggtgtcatcatgacggtattcatctgcgccatgtgggtgctaaccatggcggttgctgacttacagaacggatatcgacttcgtggcattattccggcttcgaggaagagtcaggtggccgcgcgatatgtggttggattggtgatttccgtattgtcgatagcgatgattgttctgattgacgggttgcaagtgctggtcaatccggattggtcattcgcgggcaatctgtgggcggcgccgttgggaggtttctgcaccgcgctgatggtcgcgcttatcgtgcccacgggttatctgtggaccaaactaggcggtcttcgagtcacgatgatggtgatttatgtcgttgtattggctgtatccatactgctatctatttcgcctgcttcggtgaccagaggattggcccatgccgcgaatgccatcatcgcgcaacgattgtggctggttattgcggtattggcaacgacggttgtggcatatggaatctcgtatgtaattgcctctcgcatatttgcttcaagggaatggtgacgatgagctggaaatccgtagtaaagcaatgtcgattcgattgtgtcgggacgggtctgtttagcgtggcgaatatggtatttctgctggttttcccggtgctgtctatcgtggtgtcgctggtgacgataccgacccacgtcgatgaacacgttgccagtggtctgatgggcggactcggaggtttggcatcggcgatggcatgtatgagtgcattggggcctgcgtcatccgaggaatctgcagggcacagtgccatgcgagggctgattcctgtttcacgcactgcacaagttgtaggtcggtacctttttctgttggtggttggcctgctctgggctttggacgtggtgatatgcggcggcgtcttcattgtctttggcgatatagcagatatggggtggatcggtaccttggcagcaggtgctttcatcttcgctttggctgtcattcttgggtcggtgctgctggcctgtgcataccggttcaccttccgcaagatgatggtggcctctgtcgcggtcatggttggcttgtatgccgtcattgcgctgctggcccgattgcctgtcgactggcaatggcttttgctgaatattaccgatttcctgacgatctggtggcatacggcgcttgttctcgccgtgctgtgtctgctcgcatattttggctccatgcttatagccatccgcatctaccgagccaaagaactctagccgcgcatttgtccgaccgcgaatgaaaagagaccgacaggaatctgtcggtctctttccgttatcggtgtgttatcagtccaccagatccagagcgattggctggtgcggttgctgggaatcgctttcattggccgtgcggcgcgcgcggatggcggcggctgcgcgcttgacggtcttgataacttcctgcagcaccaccacgccgaaaccgaccgcgatgattttcagccacatgtcgatcggcagcggcacggtgcggaacatcgcgccgccgaattgcaccactagcacctgaagtgcgaacatcagcgcgaacacgccgatcatcaccttattgcgcagcagattggcgaacaggctggcgttgcccagctcgcggctgttgaaggcgttgaacagctggaataccacgaacagcgtgaacagaatggtcgactgctgttcggcggtgccgcccatgaagttcgtccagctttgcgccatgaacaccacggcgatgaacgcgccggagacgatgatgcgctccagcatgccgcgcgagacgatgccggcgtcacggcgggtgggcctgcggtccataagattgtcgcgaatcggctccataccgagcgtcagcgcgggcgggccatccatgatgatgttgacccacagcagctgcaatgcggtgaacggcgcggccagaccactgaacagcgaggcgagtaccacgaccaccgaagacaggttcacggtgagctggaactggatgaatcgctggaaattctcgtaaatgccacggccccagtgcacggccttgacaatggtggcaaaggaatcgtccagcatcacgatatcgctggcttccttggacacctcggtgccggcgatgcccatggcgatgcccacgtccgcgttcttgatggcgggcgcgtcgttgatgccgtcgccggtcaccgccaccacattgccctgggctttcagagcgttcaccacgcgcatcttgataaccggcgtgctgcgggcgatcacgcggatgcggccgatttcgcgggacagttcctcgtcgctcatttcctcgatctggcgcgcctcgacggcgatatgccgctcgtccagaatgccgagttcgttggcgatggccgtggcggtcacgatgttgtcgccggtgagcatcttgagctcgatgcccgccttgcggcagcgctccacggcaccgggcacatcctcgcgcaggggatccacgatggccacgaagccgtcgaacatcatgccggattccaagccggcgcggtcggcagcgtaatcgagagccgcagtgtcggcgtccttatcggaaatatggcggtgggcgaagccgagcactcggcaggactgcgcctggaacttcgcgatctcccgttcgatttcgccgcgcgtcttggcgtcgacggcgcacaggtcgagcatcttctccgggctgcctttggcgaacacggtaatgccgtcgccgtcacgcaccacagtggtcatgctcttggtctccgacgagaacggatacgtgtggagcaccgtcgcgcgctcgcggcgaatccggtagtcgagtccggccttgtgcgcggcgaccaacagtgcgcattcggtggggttgccgatgaattccggcatcgcgccggcctcggcttcggtggcgcccgggaaggtcacgtcggcggtgccgttgacgcagaagttctccagcagcatgcggttcctgatctgctcgggcttctccaaggcgcggcccggtgcattgtacgcctcgatcacggtcatgcggttctgggtcaatgtgccggttttgtccgagcagatcacgttgatgcagccgatggtctcgcacgccaccatcttcttgaccagcgcgttctgcttggacattttgatgatgttcaccgcgaggcacgcggccacgatggtcggcaggccttcgggcacggcggccacgatcagcgttatggaggtgatgaacgcctcggaaatcgtgtcgaacgaggcggtgccggaagccacgaaccgggccacctgaagcacgaacaccagtgcggccacaatcgagcccaccacggcgatcaccttgccgagcttcgcgagcttctcctgcagcggcgtcataccggtgttggcggcgcgcagttcgcgggcgatcttgccgaactcggtgtcgtcgcccacggcggtgaccacggcacggccattgccggcggtcacgaagcagccggaatagagcatgttcgtgcggtcggccaccggggtcttcgggtcggtgaacacggcgtcggcggctttggcactcggcacgctttcgccggtgagcgcggattcgtcggcggtcagatcgttcgattcgatgaggcgcgcatcggccggcagcttgtcgccggtgctgatctgcagtacgtcgccgatggtgatgtctcgctgcgacaccagcgtgacctcgccatcgcgcaccacggtgacggtcgtgtcgtcattgatgtcgttcagcgcttcgaatgccttggcgctgcgaccctccatcaccacggtgattgtcacggacagggcgatggcgaagaagatgcccacgcattcgagaatgtcggcgtggccgccggccatggcgcgggtgatgttgacgcccagggtgatggccgccgcgatcataagcatgatgagcatcgggtcggcggccgtcttgacgatgcgggaaagcatcgattccggcttcggcttggtgaaggcgttgggaccgtactggttcaggttgtgcgcggcctgttcgctggtcaggccttgatgtgcatcggtgcccagcgtgctgatgactgctggcgcatcctgcatgaatggtgcgggcgtctgcccgttggccgtggtcatatgttcctctcgtttggttgacacaccgcactgaaacccgcgtaatatcactcgcgtaccgcgcaacatggcggcacgcagccaaacgaatcgttgacgaccatgtatcgcatactccgcggtacatgagtctcgtcatttaaggcaaagccagaccgtaacggaactgccgacggccacgatgttgacttgccacattgcggtttgggccgagcccttcgccgcaatgctgtctactccctcatgggactattcagttgcagaaacagaacctaacaaaccacatggattttcccgttcgccggcagcatggcgattcccgccttcctagaaaaaacaagcaacacgccattggctcgttgcaggtgaaaagccgcaagaaagccgcgcgtgacaaggctcggacatgcttgaacatgcctggaccttcgacttgtgacatcagaaaacaaaaaaaccgatacatgctggtaaagcatgtatcggttgggaattgtcagttagtgccgtcagcggactatcacagcgcctgggcggccttctccacgtagtcctccatgccgtcgatggccacgacgtccttgaaccgcacgtcggcggtctcaagaccacgcagggcggccggggcggtggtgccggtctcgtgggccagcacatccatgcactcgaagtcggtgccggtggcgtcgaagcccaatgcctcgttcaccacgcgcgggaacttgtaggggctggcggtggagagcagcacgcgcggggtcagcgggtcgcgcggcatctgctcaagcaggtagtagccgcaggcggtgtgcgggtcgatcacgtagtggttctcgtcccaacagtgcttgatggactcgcgtacctgatcctcatcggcccaaccggtgccgaagatctgacgaatcttggccagcagttcttccgggatctcgtacgtgccccacttgttgaggtcgttcatcagcatggagatcagacgggtgtcgccctcggacaagtagtacagcatgcgctccaggttggaggagatgaggatgtccatcgagggggagatggtctggaagaacgggcgctggcggttgtaggtaccggtggtcaggaagtcgaacagcacgttgttcttgtcggaagccaccacgaggtgcttgaccggcagaccgagcagcttggcatagtagccggcgaggatatcgccgaagttgccggtcgggaccacaaactcgacctcatcgccgacgttgatcacctggtcggcgagcagttgggcgtaagcggagaagtagtagacgacctgcggcaccagacggcccacgttgatggagttggcggaggaaagcaccacgtgcgaattgccggcgagacgctcggccagggcgcggtcgccgaagatgcgcttgaccgcggactgggcgtcgtcgaagttgccttccacggcggccacctgcacgttggagccggcttgcgtggtcatctgcagctcctggacctgggagaccttgccttccgggtagaagacggtgatcgcggtgcccggggcgtccgcgaagccggccagcgcggccttgccggtgtcgccggaggtggcggtgaggatcatgatcttctcgtccgcgtcgccatcggccggcgtggtgtgcgccatgaagcgcggcaggatctgcagcgccacgtccttgaacgcggaagtcgggccgttgaacagttcgagcacgtaatcgtcgcccaggggcttgagcggggtgatgcgctcgtcggaccactgttcgccgtaggcgtcggcgatgcactggcccagctcctcggccgtgaagtccggcagcagcgcgcccagcacctcggcggcgatttgctggtacgacttgcccggcagggaggccacgtccaccttggtcttgcccaacgcgtccgaaacgaacaggccgccgtcatcggcgatgcccttacgaatcgcctgcttggcggtcagcgaatcggtggtgctacgggtggaatggaaggtggttgtcacgatgaatccttctgcctgaaagggatgatgaatccacatcagtctagcgtgggccgtgggcagaagggccgtccgtctcgcataaccgaccggtcgcaccggcgaaaatcaccattgccatcgaacggggaccggccatatcatgaaacaggccggctgcaaacgggccatacggtaaggcgacaacggcgaatcaattgtcgcttataccaaagagcacccatgaccgcttcaccccttgcgcagaaggcaaccgatgctttcaacgcgccgatctgcgaaaccgatcctgagatcgccgaactgctggactccgaactgggccgccagcgcagtggccttgagatgatcgcctctgagaacttcgtgccgcgagcggtactgcaatgccagggctccgtgctgaccaacaaatacgccgaaggctaccccggccgtttctaccacgccgaggcgtacggcgtgaaccccgagaccttccgcaccgacccggagatcatccgccagcgcacgctcgacggtgccaagatccttgccgaacgactactggccgacgacgtcaaggccaacggcatctccgtgctgaccggcggcaccgatgtgcatctggtgatggtcgacctgcgcaacagcgagatggacggccagcagggcgaggatctgctcgccgcctgcggcatcaccatcaaccgcaacaccgtgcccttcgacccgcgcccggcctcggtggcctcgggcctgagaatcggcacgtccgccctggccacccgcggcttcggaccgaaggaatacgaggaggtggccgacatcatcggcaccgcgctcgccgccggcccgtccgccgacgtgaccgcgctgaaggcccgcgtcgacaagctcgccgaagacttcccgctctaccccgacctggaccagattcactgattttttgcggatgtacgcagctccctcatcagagggagccgcgcttatatccccggctatcttcggtgcaatatgggtcgaaacgggcaatgcggcccattgtgggttactcttgttttttatgagcgatgaattgagtcctgaggtgttcgacgcggtgtgccgccaggccgatcaggccgcacgcgcacaggagcgtcttgcacaggcaaataccgaagccaaaaacgaactgttgcttgccattgcggacgcgttggacgagcatgctgcggacatcgaagccgccaacgcgctggacatgctcgaatccaaggaaaacggcatggatgcgggcaagctcgaccgcctgctgttcgacgtgccgcgcgtggccgccgccgcccaaggcgtgcgccatgtggccaccctgcccgatccggtcggcgagatcgtgcgcggatacaacctgcccaacggtctgcgccttacccagacgcgcgtgccgatgggcgtcatcggcatgatctacgaggcccggccgaacgtcactgtggacgtggccagcctgtgcctcaagtccggcaatgccgcgttgctgcgaggcggccacgccgccgaacgcactaacgccgccacgttgggcgtcatcgccccggtgcttgaagcccacggtttcgaatccgcactggtgcaatccgtcgaccagtacgggcgcgccggcgccaccgccatgatggaggcgcgaggccatatcgacgtgctcgtgccgcgaggaggagcgggtctgatccaagccgtcgtgcgcaactccaaagtgccggtcatcgaaaccggtgccggcaacgtgcatatctatatcgacaagtccggtgatctcgccaaggccatcccgatcatcatcaacgccaaaacccagcgcgtgggcgtgtgcaacgccgccgaaaagctattggttcataaggatgtcgccgccgaattcctgccgcagatcgccgccactctggccgaggcgaacgtcgtgctgcagaccgacaccacgtcgtacggcatcatctccggcgcggcaatcgagggccttgacctcaaccacgccgccgaagaggattgggacaccgaatacctggccctcaaaatgggcatcaaggtggtgtcggacctggacgcggccatcgaccacatcaacacgcattccacaggccacaccgaatccatcatcgccgaggattatgcggccatcgaggaattcaccaagcgcatcgactcggccgtggtcatggtcaacgcctccacccgcttcaccgacggcggcgtgttcggctttggtgccgagcttggcatctccacgcagaagatgcacgcacgcggtcccatgggattgcgggagatgaccaccaccaagtggatcggttacggaacaggacaggtgcgcgcatgaacgaggacggcaacatgaacattacggctgacacggcaaacaaggcaagcgaactgcggcccgacatcgacctcaacgatcccaagctcggcctgaagatcgcggccgaacggctcagcatcgtccgctacgtgttccttgtgcagatcgaggacggcatcgcctccgccgcccagcgtgcgtcgctcgaatacgcggacgccgtgctcatcggttggcccgagaccgattcgcccgaagtcgcggacctcgacgatgcccagctcaagatcgtgcgcgaacacatggagctcatggaaggctacatcggcaaatacagccagatggagcacgacggtgaccttgacggcatgaccgacacgctcatccgcatcaccgagcgtgtggccgaggtccgccgcctctaccagccggacttcccgctgcccaccttcgccgaaattcgtcgcgtggtccaggacgaatgggatgaagacatgggcaagatcgatcccagggaagacaatcccaccgccggcgaaatcgaagaggaaaccgaatcagccgatgacgccgccggcgagggcgaccaggcatgagtggtgttaccgacagccacaaaacggctgcgtcagttcagtccgaaaaatcagtggaatccgccgagcccgccgaaatcgttgccgtcacccaaggcgaaaccgaacggcgcatgtctgacctgtccgcgccggccggggccagcagccatggcaaaggcaggctttccgcacgcggcaactggcatacgcgcctgcgcgtcggcatcatgggcggcacgttcgacccgattcacaacggccacttggtcgccgcctccgaagtagcttgggtatacgacctcgatgaggtgattttcgtacccaccggccgacctgtgttcaagctggacaagcacgtcaccaacgccgaagatcggtatctgatgactgtgatcgccaccgcatccaaccccaaattcaccgtctcgcgtgtcgacatcgaccgtccgggcgtcacctacaccatcgacaccctgcgcgatatccgcgcccaacatcccgacgccgagctgttcttcatcaccggcgcagacgccgtggccgaaattatgcagtggaaggacgccgacctcatgtgggacctcgcccacttcgtggccgtcacgcgccccggctactccagtccggacggcgtgaccttgcccgaaggaaaggtcgatacgcttgagatcccggccttggccatctcttcgaccgatgtacgccgccgcgccgaacacgacgagccggtctggtatctggtgcctgacggcgtggtgcaatacatcggcaagcatggtctgtattcatacgaggactgacgattcgtacgaggactagtgtgcatttgtacgagggctggtgaggattagcgcgaatcagtgcgcatcaatcctcaccagtgcaaaggataagcagtcaggccagtcccatcttgattttcaatgccattacgcgagtcgccgccgccgtcactttcgaagcgaaagccggatcggacttcgcccgttcgttgaggccgtccacaattggctttacgtaatccgtctgaccgatgcaggacatgtcgccgcccgcctcgacaagctttactcccaattggcttacatcgtagctgcttaacgcttcggcagacatcgaatccgaaatcaccacgcccgtgtacttcagggcgttgcgaatatgaccgtcgataatcgtagaagaaaacaccgccggattattcgggtcgatggattgatacgtggccaacgacatcatcaccatcgcaggatcggtcttggtgatcgcctggtcaaaggcacctgcctcggccccgcccaacgtggtggtcgtatccagaatgccttcggtggtgaagtcggtattgccgcttaccgcgcccaacccaggataatgtttgaccgccgcgccgacctgagcgtctcgcaaaccttcaataacggcgatgccatgttcggcgttgccggccgcatccaatccgaaatcacgatccagcgcgccaatcggagcatttgaggcacgatcgcccaccaccgtgccgagcaccggtgccaaatcgacatttatgccagcagcagctaattgcgaaccccacgtgcctgccgattgacgcaatgcgtcagcggacattgtgccctgctcaacggcactgggcattgtgtcgaaaccggtaccagtcagatgctgcacctgaccaccctcctgatcggtggcgatgatgagacgattgccggccggcgcatatccttggagttgcgcggtcgcggtcttgaccgtatcggcgccggtattccaattgccaatgagaatggccgagccaatgtgctcatcggcgattgttgaagccaacgaggagggatcggaaccggcaagcaacggcaccatcactaactgtcccacacgttcctcaagtgtcatggcggataccgcacgttgggcttgtgcggccggttcgttcttcttcggggaaggaacgtcggcgcgtggtaacgcacttgtctgggaggtctggggagtggtggtgttgccgtttgatgtggatttggcgaaccatccgacatgccatccgtaggctgccacgccggccaacaccactgccaaagcacatattgtcgccacgattggagtgctcctgtgccgaagttggcgtgtggcgtgtgctgagggacgcatatgttgtggccgttggctgttcataccggcaagcgtagaacggagcgtagaacagaacgctgcctcattctgtgctcagggcataacctacctcccgccctttcgataggcttgagttatgtcttttaacgatcctttctcaatactgttcggcaatggcggcgattcacgacgcaacaatgcgaacaatgacgatccgatcatcctcgatgtcgaggccgatggggacggtccggcccgcaacaccaacgccggcccctccgggtcatcccgccctccacgtggcccggccaatccgcgtatcacccgtaagccagcgtccggtggctcaggaggcagccgtggcagcaagattctgatcggcgtggtgctggccttggccatcatcgtcggtctgttcttcggcctgtcccgattcatcaccgatctgatgtggtacggccagctcggcttccagtccgtggtctggacccagctcggggtgaaaatcggtctgtgggtggcctacgcgctgctcatggccttgaccggcttcgtttccgcctggctggccattcgagcacgccctgattcggccgacggttccaccattcgcattaacggcgatgtggtcgaggtcggcaaatccgtcagctcgaaaaccgctcgccgcgtggccgtggtgatttcgctgatcgtcggcgtcatcttcggctctcagttcaacgcgaactggagcgagattctgctcatgttcaacgcgcagtcgttcggcaccaccgatccgcagttcggtctggacaacggcttctacgtgttcgtgctgccgggcctgaagctcgtgctcgccgccgtggccatgctgctgggcgtgggccttgtgttttccgtggtcactcatgtgctgatgggtggtatccgcattactatgccggttaacggacgcggcctgttctccatcaccaagcgttgccgtcgccagcttggcatctggctgatgctcaacatgttcgcttgggcagtgcgccagatgatcggcgtcttcgaccagctcaccgtgcagggttcacgcatcaccggtgcctcctacaccgccgtgcatgccaacatccccgtcaccttcatcatggccgcgctgaccgccatcctcggcgtggtgctgggcatctggctcatgcgttcccacacgctcgaaggccaggcgtccatcggcgtgcgcgcctccgccgcgctcaaggcctggcgtgtgccggtgacctccattgccgtcgtggtcgtggtgggtcttgtgctcaccgtggcatggccggtgctgttgcagcgcttccgcgtcaacccgaacgcacaggagatggaatccacctacattcagcgcaatatcgacgccacccgcgccgcctacggtcttgacaagctcaagaccgagcaatacaaggtaaccgacaagggcgagcagggcgctctggccaaggagggcgacaccaccgcgcagattcgtctgctcgacccgcaggtcgtcagccccacattcaaacagctgcagcagtccaagcagtactacaccttcgccgacactttggcagtcgacaagtacgagatcgacggcgtttcccaagacaccgtgattgccgcccgcgagcttgacctggccggcaacgacaaccgcaattgggtcaatgaccacaccgtgtacacccacggttacggcgtggtggccgcttacggtaacaaggtgaccgccgacggccagcctgaattcttcgaatccggcatccccactcagggcaagctcactgaatccgaaaagtatgagcctcgcatctacttctcgccgaacaccaccgaatactcgatcgtcggcgcaccggagggcacgcaggcttgggagttcgactacccgaccggttcggaaggcgccctgaccacgttcaagggcgacggcggcccctcggttggcaacctgttctcccgtattctctacgcaatccgcttcggctccgatcagattctcttctccgaccgtgtgaccagcgaatcgcagattctttacgatcgttcccccaaggagcgcgtggccaaggtggcgccgtacctgacgcttgacggccgtgtgtatccggccgtggtcgatggccgcgtcaagtggatcgtcgacggctacaccacctccgacgcctacccgtactcgcagatgaccgacctcggctccgccaccaaggattccaccaccgtctcttccgcaacggtctcatccttgggctcgcagaaggccaactacatccgcaactcggtcaaggccaccgtggacgcctacgacggttccgtggatctgtacgtatgggatcaatccgacccggtaatcaaggcatgggagaagatcttccccggccagtaccaccagctctccgatatctccggcgacctgatgagccacatgcgctacccggaaagcctgttcaaggtgcagcgcgagctgctctccaagtaccacgtgacctccgccaaccagtactactccggcgaggacttctggcagacgccggtcgacccgaccgaatcccagtcccagcaggaccaggacatcctgcagccgccgtactacctgaccttgcagaccggtggcaccaaggaaccggtgttctcgctgagctccacctacattccggctggccagtccacccgtgagatcctcaccggcttcctgtcggtcgactcggatgccggcaatgagaagggcaagataggctcaaactacggcaccatccgattgcaggagctgcccaaggattcgaacgtaccgggccccggccaggcgcagaacaacttcaacgccaacgccgacgtgtccaaggaactgaacctgctgcaatccggcgacacgcaagtggtgcgcggcaacctgctcaccctgccgctcggtggcggactggtgtacgtgcagcccgtgtacgtcaagtcttcgggtgcgacttcattcccgctgctcaagaagacgctggtcgcgttcggtgatcaggtaggatttgcggatacgttggatgaggccttggatcaggtgttcggtggtgattccggcgcggccgcaggcgatgccgagaacgtgtccggtgacggatcgtctggtgaccagtcgtccggcatatccggtgaccaatctggttccgataccaatggtggccagtccggcaccacggacggcaagtcggattccggctcgtcttccgaccgtagccccgaactccagcaggcgctgaacgatgccgcccaagccatgaaggacagccagtccgccatgaagaacggcgactggaccgcctacggcaaggcgcagaaggagcttgaagacgccctcaacaaggccatcgagctcgacaagtagttccgacaggaattggctcccctcagggtgaggggagccatcgccgaaggcgactgaagggagtcggttacctcaactgacatagcccgtccttatcataaggacgggctatttgcgtattcaaaggaacctcatgccatacaccttccgtccggccgtcgaatccgacgtccaagccatcgccgacatctacaacgcctcagtgatggccggcggtgcgaccgccgacctcaccccgcgcaccttcgaccaacgccgcgcctgggtcgaatcccatacgccgccctacggcgtttttgttgtggaatcggaagacggttcaatcattggcttcggtgcgctctccgtgttctatgaccgcgcaggatatgacggtgtcaccgatttggcctattacatcgatccggcatggcaaggcaggggagtaggcacgttcatgcttgacaggctgctcaccgaggcgctggcccgccacatgcgcaaggcctgcggcatcattttcgccgataacgccggctccattgccctcatgcaccgcttcggcttcacccaattcggactcatgcccgccgctgccaccgactccaccggcaccatgcgggacatgtcctactggtatttggacctgtagccttgcagtaagtcatttcagtcaagaaaagtgtgaggatgccggagcaaacgagcttgacggcggcgttgagtacaatcttgacggttggatccggccgggcatgggccagtgcgcgaggcgaacgcgcgcatgacgtacggaacgtacagaacgtgcatacgggaataaaggaagacggacgaggagcggattatggcatcggatttctggctgattgcgggactgggcaaccccggcaaaaaatatgaggacacgcggcacaacatgggcttcatgaccgccgacgtgctcgccgaacgttggacggtgaacttcgccgatcacaagggcttggccatgctcggtaaaagcgtgatgaacctggacggccgcaccgtcaagttctttctggccaagccgctgacttatatgaatgattccggcaatgcggtggcttccattagcgcctattaccagatcgagcccgaccatattgtggtgattcacgatgacatggacttggaattcggccgtatcaaggtcaaggcaggcggctccgcaggcggccacaacggcatcaagtcgattgaccgttccctcggcacgccgaaatacgcgcgtgtgcgcatgggcgtcggtcactccaagcgcggtgcgaacgcgcatgacaacacggtgaactgggtgctgggcggattcggtccggaccagcgcaagcagctgcccgaattcctggctgacggcgccgacgccgccgaggacatcatcttccacggtcttgccaagacccaggagaagttcaatggccggtgaggcgacgcacccggacctgatcaacggctcactggtaggcatcctgtctgagctggaacaggacaagaccttcctgaagctcgccgccggcgacatcgaggcttcggacgacgtcgacaactccgtcctggccggcatccccgaaggtttgcgcccggctttggccgccgccatcgggcagggtgtggccggcaaacccggcaagccggtcgtgctggtcgtggcctccggccgcgaagccgaagagaccgtgggctcgctgcgctcctggtatgatggcgacccgaacgacatcgcccagctcgaagcctgggaaaccctgccgcacgagcgtctgagcccgcgcgcggacaccgtggccagccgcatggccgtgttccgcagactcaagcatccgagcgataccgattcgatgttcggcccgattcgcattctcgtcatgccgatccgctcgctcatccagccagtcgtccaaggactgggcgatgtcgagccgctcgtgttcaccgtgggggaggacctgcccctcgacgaagccgccaaacgtctgatcgaaaacgcctacacgcgcgtggacctggtcatggaccgtggcgagttcgcggtgcgcggaggcattcttgacgtattcccgcccaccgcaccgcacccggtgcgtatcgaattcttcggcgacgaaattgacaccatcaaggaattccacgcctccgaccagcgtacctacggcgacggcctcaagaccatctgggccaccgcatgccgtgaactgcagctgaccgacgccgtgcgcacccgcgccaaagccttggtcggttcgattcccaatgctgaggacatgctcgaatccatcgccaacgccattccggtcgaaggcatggaatccctgatgcccgcactcgtggaccatctggaaccggtgggctccatgcttcccaagcacgccgtgatcctcctgagcgacccggagaaactgcgccgctccgccgaagacttggcaaaaaccgcgaacgagttcctggccgcaagctggcatgtggccgcctccggccacggcgccggcgcgcccatcagcttcgacgaagccagcttcctcgactatgcggaaaccatcagctccctcgaatactccgaacatccggtgattcgcctcaccagtttcggcgtggacaccacgttgaccggccatgtgcagctcgacgcccagaacccggccgaattccgaggggatgaggccaaggcctcccaaggcatcgaaggcctgctcgatgccggcttccacgtcaccatcaccgccgctgcggccggcaccttggccaggctcaagcgtgcgatcaacactaccggcatcgccaatttcgacgtcatccgctctcaggccatcgacggcttcgtggacaaagccgccaaaatcgccctgctcaccgaacgcgacctgaccggccgcacttcagccgtggccgtggccaaaacgccgaaacgccggcgcaaggccatcgacttggtggagctcaaaaaaggcgattacgtggtgcacgagcagcacggcattggccggttcatcgaaatgcgtcagcgcatcatcggcaccggcgccaacaaaaccactcgcgaatacctggtcatcgaatatgcgccttccaagcgcggcgccccggcggacaaactgttcatccccaccgaccagctcgaccaggtcagcaaatacatcggcgccgaagcccccaagctcaacaagctcggcggctccgactgggcggccaccaaggccaaggcccgcaagcacgtccacgagatcgccgacgacctgatcaagctgtactccgcccgccagcgcgccaagggcttcgcgttcagcccggacaccccatggcagaaagagctggaagacgccttcccctatcaggaaaccgccgaccagctcaccaccatcgacgaagttaaatccgacatggaaaagcccgtgccgatggaccgcctcatctgcggcgacgtgggcttcggcaaaaccgaaatcgcactgcgtgccgccttcaaggccgtgcaggacggcaagcaggtggccgtgctcgtgcccaccacgctgcttgtccagcagcattacgagacgttcagcgaacgattcgagggtttcccggtcaatgtggcggccatgagccgattccagaccaccaaagagatcaacgaggccatcgaggggctggaaaccggcacggtggacgtggtcatcggcacgcacaagctgctgaacccgaaaatcaagttcaaggatctgggactcgtcatcatcgatgaggagcagcgtttcggcgtggaacacaaggagacgctgaaagccctgcgcaccaacgtggacgtgctgtccctgtctgccacgcctatcccgcgcacgctggaaatggccgtgaccggcattcgcgagatgtccacgctcgccaccccgcccgaagaccggttgccggtgctgacctatgtgggcgcctacgaggatgcgcaggtcaccgcagccgtacgccgcgaactgctgcgaggcggccaggtgttctatgtccacaatcgtgtgcaggacatctcgtccatcgccgacaagattcacacgctggtgcccgaggcgcacgtcggcatcgcccacggcaagatgggggagaagcagctcgaccagatcatccgcgacttctggcatcgcgacatcgacgtgctcgtgtgtaccacaatcatcgagaccggtcttgatatctccaatgcgaacacgctgatcgtcgaccatgccgaccgtttcggcttgagccagctccatcagctgcgtggccgcgtcggtcgcggccgcgagcgcgcgtacgcctacttcttgtacgacccgtccaagccgatgaccgagcagtcccatgaccggctcgccaccatcgcgcagaacacggcgctcggctccggtttcgatgtggccatgaaggacttggaattgcgcggcaccggtaaccttctgggcgacgagcagtccggccatatcgagggcgtgggcttcgacctgtacgtacgcatggtgtccgaagccgtggaaaagtacaaggagcccgaagagaacgtcgagccggtggccgtgtccatcgacctgcccatcgaagcgtcgattccgatcgagtacatcgattcggacaagctgcgtctggaagcgtaccgcaagctcgcctccgtccgcaacgaggccgatctgaaggatttggaagaggaacttaccgaccgttacggcaagccgccggtcgaattcgagaccctgttcgacgtggcccgtctgaagttcaaggcccgcaagctcggcatttcggagattctcgcgcaatccaaccgcgtgcgcatcggtcgcatcgacccgcccgaatccatccagatgcgtatgggccgtatttacaaaggcacccaataccgcccggtcacccaccagctcatcgtccccaccccgttcaccggctccctgggccaaggccccatgagctccgaccaggtagtcctctggaccaaccagttacttgatgatttggcatggaccccgtcgtcaagcaaacggcagagccgtttgtagacggggtgcgaggcggcagtcgagccagctatggctcaccgggcaacctccggtgagccatattcatattcatgccgtcgtttgtgacgatgattcaccccagacggaatcgttccggctgtccagcgagcgggattaagtgactgctatgagcgaaacgactacgaaccgcacgaaccagagcgcgaccacggcaacacttgccggctatgagattccccgcctcggcatgggcacgatggcgctcgccatcgaggggcgcccctccaaccgtgatcaggcaatcgagaccatccatgccgcgctcgatgccggagtccgttatttggacacggcttggtcctattatctgcccagcgcacccggcaccggcgaaccggaggatatgggctatggtgaatatctggtccgcgatgctctgcactcgtggcatggccccaaagatcaggtgctcgtagccaccaaaaccggctggctgcgcacgcttgacggcaacggcaactacggctggcaggccgacgcccgacctgaaaccatgatcgccaatgccaaggaatcagcccgccgcctcggtgtcgatacgctcgatctgctctactcgcactgcaatgatccgcaggtgccgtacgaagaccagatgggcgcactcaagcagctcgtggacgaaggtgtggccaaagcggttggtatctccagaatcgacaacgcggacatcgaaaccgcccgcaatattttgggcgatcgtctcgtggccgtccagaaccagttctccccggttcaccgcgaccccgaacacacgttggaaacctgcgaaaagctcggtttggcttttgtctgctggtcgccgctcggtggattccttgacccgttcaacgagcatctgttcgaccggttccgcgaagtcgccaagattcacgactgctcctaccagcgcgtcacgctcgcgtgggaacttgcgcaataccaatatctgttcacgattccctcggccagaaacccgcaggagattcaggactcgttcaaagccagcgaactgaaattgtccgacagtgagatcggctacctcaatggcaaggacgttgactgagcgatttcgtccgtactgccttgcaatcaggcggcacactggcattgtgagcgctaacgctaaattttgggcgtgttgttcacaacgtccacaaatcgcactactcttaagaatgtcattcaagatacacaaccgttttaaggagtagttgtggcagtaattgaaagcgtgtacgcgcgtcagattctcgattcccgtggcaacccgaccgttcaggtcgttctggacaccgaagacggcgcccagggcctgggcctggttccgtccggcgcctccaccggtgaggctgaggcttgggagcgtcgcgatggcgacaagtccgtctacggcggcaagggtgttcttaacgcggtcaaggccgtgaacgaggtcatcgctccgaaggtcatcggcatggacgctgctgaccagcgcgctctggacgacctgatgatcgagctcgacggcaccccgaacaagggcaagctgggcgccaacgccatcttgggcgtctccctggctgctctgtacgcttccgccgagtccgccggcctgccgctgtaccgctacatcggcggcaccaacggccacatcctgccggtcccgaacatgaacatcatgaacggtggcgctcacgctgacttcgccaccgacattcaggagtacatgatctccccgtacggcttcgacacctactccgaggctctgcgcgctggcgttgaggtctaccacaccctgaagaacgtcctgaagaaggaaggcctgaacaccggcctcggcgacgagggcggcttcgccccgaagatgaagtccaacgaggactccctcaagtacatcatggacgccatctccgccgccggctacgagcctggcaagcagatcggcatctgcctggatgtcgcctcctccgagttctacaacaaggagaccggcaagtaccgcttcgacggtgaagagcgtgactccgcctacatgctcgactactacgagaacctcatcaacgagtacccgatcgtctccatcgaggacccgttcaacgaggaaggctgggaagactgggctgccatcaccgctcgcctcggcgatcgtctgcagttcgtcggcgacgacctgctggtcaccaacccggctcgtctgcagaaggccatcgacctcggcgccgccaactccctgctggtcaagctgaaccagatcggttccgtcactgagaccctcgacgccatcgagctggccaccgccaacggctacacctccatggtttcccaccgctccggcgagaccccggacaccaccatctccgacctggctgttgctaagaacacccgccagatcaagaccggtgccccggcccgtggcgagcgcgttgccaagtacaaccgcctgctcgagatcgaggaggagctcggctccaccgctcagtacgccggctacagcgccttcaaggcctgcaagaagtacctggccaagtgagctgaaacgcccgtaaaggcgtgagtttccactgaagctcgatacccgtcgtattcgtcaagtcgaatgcggcgggtattttcgtgtgacatgagcaagtcgtcccgtaccggcaaacctggcaaaaccggcaaagcacgagttaggaaaaaagggtcggcggggcctatagcgttcttcgtctccctgttcattatcgcccttggcaccatccagctggtctccaccttccacacctatgccctgaacctggccgaactcaatggtctcaagcgtgaggaggcttcgctgatcgccaaaaagcaggagttggaaaacgacatcaagcgttgggatgacaaggcctacatcaccgcccaggcccgtgaacgcctcggcttcgtattccccggcgaacaggccgtgcgtgtgcttcatcccgaagccgtgaccggctccgatagcgaatcccagaaaacggaagattccagtagcagcaacaaaaaagtcctgccatggtacagcgaactgtcttactcgctcaaaaaggccgatgagcctgtgaccgatagcgagtccggcaaatccgatatttccggttcctctgactcgtcatccaacgactcatccaagcggtccgataagtcagaccagaacacccaatccgatcagaacacccaacagaatacccaacagaacacaggggagggaacccaacagtgaccatcgatatcgccgccaaggccaaggcccttgtcgataccgtgcttgccgagcccgccaacgatcatgacatcgacctggtgcagcgtcagctcggccgatacccgcgcggcatggtcgccgtgggggcgcgatgcgtctgcggtaggccacttgccgtaatcacccgtccggtgttgcccggcggaatccctttccccaccacgtgctatctgaccggtccggaagccgtcaaggccgcctcccatgtcgaggccgccggcgtgatgcagcaatacaacgacatgttggccttggacgaggagctcaaggccgcatatgagcaggcccataacctgtatctggcattccgccacgaactggcaggacgtcttggcgacagtgaggagcatattgaaggcacttcggccggcggcatgccggtgcgcgtcaagtgcctgcatgccctgctggcccagtccttggttatggggccgggcgtcaaccccattggcgatttggtactggaacgcgtcaaagacgaattcgatccgaccgtctgccgctgcacgctggacgattgatcaacagatgagccagcgcgaacagtccattcatacgcactaagggatacgaggagaaggcaatgagcaaggaatccgtaaccgtcgccggcattgattgcggcacgaactccattcgactgaaaatcgcacgtgtcgatgccgatggcatgcatgaggtggtgccgcgcatcctgcgtgtgatccgtctcggccaggatgtggacaagacccatcgttttgccgacgaagcgttggaacgcgcctatgtggccgctcgggaattcgccggtgtgattgccgaacatcccatcgacggcctgcgtttcgttgccacctctgcaactcgtgacgcggaaaaccgtgaggagttcgaggatgagatcgaacgtatcctcggcgtgcgccccgaagtcattcccggcaccgaagaagccgacctgagcttccttggtgccacttccgtggtcaatcgcgacgatctgcccgccccctatctggtggttgatctcggcggcgggtccaccgagctggtcatcggtggcaacggcgtcagtgcgcccactacccaggttcagggcgcgttttccatgaacatcggttccgtgcgcatgaccgaacgtcatctgaccaatgatccgccgacccagacacagatcgatgaggccgttgcggacgtcgatgaacatatcgatgaggccttccgcaccgtggacgcaggcaaggcccgtaccatcattggcgtgtccggcacggtgaccacgatgaccgccttggccatgggattgaaggaatacgaccacaccgtggtcgacgggcatcggttgagccttgaagacgcctatgccgtggacgacaagttccttaggatgacgcgcgccgagcgccgcgaatacaagaccatccaccccggccgtatcgatgtggtcggcggcggcgctgtggtctggagccgtgtgctggcgcgtgtcagcgaagccgccaaggccgatcatggtgaagccatcgattcgttcgttgccagcgaacacggtctgctggacggcattgtgctcgattatggtcgccggttgctggctcaatagcgtaagtggtaagtgcctccagcgggctgagccgttaagcaaacagcccggtgggctgtttgtaggcgaggggagcggctatgccgcgacggctgcacgaagtgcagcaacccgcaagcaatgctcagggcaggagatagcttataatagaaaagttggcctccgtggcgaaatggtatacgcagtcgacttaaaatcgatcgcttcggcttgtgggttcgagtcccaccggaggcaccttgaaatcggcctgtggccgatgccgttttgcggctgtgccgtggtctctccccagtcggcttcgccgacagcccccctcgtcagagggggctcgcagctcactatgtggagagcttataaggccgaaacaaaaggccgttaggctatgtggcgttgtgacgatgtacctgatgaaacgaggaatccacatggcttcacgctggaccgatgtcgaacgagtcgaacaaggcgccctgcccaccatgcttgcccaagccgtcattgcgggcactgcactcaccgttggtgccatcgcctgctcgggattctatctgtccatgatcggcaatgtggccgcactcctgccatgggcgactatcgtgatactgatcgccgtggcgttcacctacatcgtcggcttcgccctgttgtggtgtgccgaagccctgaccctgcgtgccaacgacaaactcaagccatggctgtacggcgtcgtcggattaatcggctacggcgtgtggggcatgttcgtgatgagcgcgatgatgaacacgctgaaccagccgctgaacggcgtggtgttgtcgaacggcgatgtgatggccctgaccgtcaactacgcggtgttcggcttcatcgccttcctgttggcacaggcgtacgcgcccaaaatcgccaccaagaagggactgaccatcgggctgatggtggtgcagatcgtattggccatcatcggtatcatcgtactggtcatgatgttctccgcactgtctcactgactgacttatcgctcgccggcatgacgcgcgcggccatcatcgcacaaggcgaaagcgattccgggcgctgggctgggatacgatatcgtgatggcatgacgcctggtaacaccggcatgccgaaccagcaggggagaaggagccaaatgttcagtgtgcttgacatgttcaccatcggcgtcggaccttcatcctcgcacaccgtaggcccgatggtcgcggcacatgctttcgcctcctcgttgcaggccgaccatttggtcgatcgcaccgcacgtgtcaaaatcacgctttatggttctctggcgctgaccggtctcggccacggcaccgatcgtgctgcgatggctgggctcgaaggcaatctgccggccaccgtggataccgaccacatgatgcacatccgcgagatctgcgcgttggatgatactctgaacctcgccggcctcaaacgcatccatttcgactacgaccgtgacgtggtgttcgaacaatggaagcgcatggccgcgcaccccaatggcatgcgattccaggcgttcgacgccgccgcaagcttggtcgacgaacaggtctggtattccatcggcggcggattcgtgcgcaaaggcgctcccgaagacccgatgatcggcattcatgaacgccctccggaaggcgcctcctttgccgatgcggacgagtcatcatccactgatttcggcgtcgaggcaccctacccgttctcatcatgcactgaactggtgtcgttatgccgggaacatcatctcagcatcgccgaacttgtatgggccaacgaaaccgcttcacgctcgggcatccaggtccgatccgatattgatgccatctggcgtgttatgcgcgcctgtgtggaccacggatgcacctcggcggaacccacattgcccggtggccttgacgtaccccgccgcgcgccgaaaatgtatcggcgtctcgcctcgaattccgatgtgctgcgccgcgacagccggcgcaaagacgccgtgctcgagtcttccgacgccgcatgggtggatctcttcgccttggccgtctctgaggagaatgccggaggcgggcgcatcgtaaccgctccgaccaacggttccgccggcatcattcccgccgtgcttcactattactggcatttcgtggacaacgccaatgaacagggcgtggtcacgtttctgctgaccgccggtgccatcggatacctgttcaaacgcaacgcctcaatttccggtgcggaagtcggttgccagggcgaagtcggctcggcctgttcgatggcggcggccggacttgccgcagtcgtaggcggcacgccggaacaggtggaaaatgctgctgagatcggcatcgaacacaacttgggtctgacttgcgatccggtgggcggattggtgcagattccatgcatcgagcgcaatgccatggccgccaacaccgccatcaacgccgtgcgtatggccatgctcggcgacggctcacacatcgtgacccttgatcaggccatcgaaaccatgaagcagaccggtgaagacatgatggccaaatacaaggagacctccaagggtggacttgccgtcaatgtcgtcgaatgctgattgacatgtccggtattcaccagcatgatgaccggaattgacgtatacggccagcgtgtcgtatcgcacagggatgaaggactaccgccgattcgccgatggtgctaaggtagggcgcattgtgtctttgaaggaggactaatgacagatcagatgcctcaggtgaacgccgaatttggcaccacgcccgttatcgagttcccgacgcccgaagccccgaagggcctcaaggttgtggagctgaccgagggagacggcccgatcgtgcgtcgcggcgacaccgtcaccgtgaactaccacggcgtggtgtggggtaaggacaccccattcgactccagcttcgaccgtcatcagcccgccagtttcggcatcggcgtgggacaggtcatcaagggctgggaccagactgtgccgggccataacgtgggttcgcgtctggtggtttccattccgccggaatacggctacggttcccgcggcatcccgcaggccggcatcggcggcgaggacacgctggtgttcgtcatcgacattatttccacccgctgaccataggtcagcacatgacgaacgccggggtcatagccggcgttttgtcataaataacgaagattgtttcagcatcgacaacggttcaggaggacgatatggctgaggacaaggtctacctgctgacgcaggaagcatacaacaagatgaaggaagagctcgcccatcgtgaaggtgagctgcgtgaggaaatcgcgcacaagatcgccgtggcgcgtgccgagggcgacttgtccgagaacggcggctaccaggccgcccgtgaggcgcagagcaagaacgagggccgcatcaccgagctcaccgtcaagctgcgcgattccaagatcatcgagaatgctccggaaggcaccgtgggcgagggctctgtggtgaccatcgagctcaacggcaacgagatgacctacgtgctcggcagccgtgacatcgtggccggcaccgactacgacatcatgaccccggattccccgattggcaaggccatcgagggcgccaaggtgggcgacgtcgtttcctacaccgcaccgaacggccgcgagctgtccgtgactgtcaaggccgccaagccgctggcctgagttaagtgactggtatgcccccgtaggcgggggcatacttatatgtcgtagcgcttattgccacagcgagacgatcaccatgtagatggccaccatatggcaggcatatccggccaccgttccgcagtggaaaatctcatggaatccgaagacgcgaggccaagggtcgggcttgcgcaaggcgtagacgatggcgccgaggatgtagcaggcaccgccggcgcacagcagcaccaccacggctggccccgcatacggcgaattccagaacatcaccatataagccaggccgtagatgccgaagatgatgtacaccaccgtatacagccagcgtggtgcattgatccagatcacatgaatcacgatggcgatggccgtgcacgcccacatcgatatgatgatcacattgcgccagaacggttccagcgcaaacgaaaccggggtatacgtgccggcaatgagcaggaagatgttgacatgatcgatacgccgcagcacatcggtgacgcgcgggctccaatcgcccagatggtagcaggccgaattggtgaacagaatcagcgacgctgtcatgaacacggcacacgcccacttcagactcgcgccatgtgccaagcatataagcacgatgcctgccgccaatgacaggggagcggcaatcgcgtgaatccagccgcgcatcaacggctttggccgtccgtgcacgtcgagacgaatcttgcgttccacttccgcaggggcaatgccctcgattttcagcgcacggttctccgctttggcgagcttgtgccgggccttctcctcggctttggctcgaatggcctcggccttgaactgggccttggcccgtacggcatcagccttggcctgcaacgcctgttcgcgcgcctcgatagccgcctgacgcttggatgcgatggtggcatcctctgcaatcgtcgcgctgttatgagcgtcgtgatgcatcgtcttttccgagtcgccggttgttgatgccatggtgatgcccccgtttcacgagttgacgatacgcttcttacgctgccgtaacctacgttagcgtaacttttatgcttgtcaataccgactcgcgcgaacactatcacccaatggcggcgatactatggaatccgaagatgagaacgtcgcagcaataaagggctcggcgatggtgtattgcacggagtgtgggtttgccaacgagcaaggaaatgccttctgttcgcagtgcggaagcccattggagcagcccgaggccaatccggcggcccctgcttctcctgaacctcccgccgggcgtcctggcgtcgatcacaccaaagcggtggtgattgtgctcatcgcgctgatttgtgtcgtggcgttagtcatcggcttgttcatcacccatagcatgggattgtggggagctcagccgcaggcgcaaacatcggcacagtcgaccggggccgatgcgttggattccgccgatgatggcacgacggattcttctgacgccaagtccaaggccaagaagaacacgtctgatagcgccaaagacaagaacagcgacgattcgtccaagaaaagctcgacggagaagtcgaagccttccactccggtgatcacatccagccagttgtctgacatcgcggattcatactcgtcctccgatgtggccgtctccgccatggtcatcgatggaacatccgccgactcctcagaggacgccaccatcgcgaccacgtcgcagtccggcaagcaattcgtggctgccgatttctatctgccggtctatcttgcggcccaggacaatggcgatgacaacgtcaaagcgcaggcaaacgcgatgatgggttccatggacacagcaatgccggcaatatggtggcggcttcggatatcaaactgtacgtgatgcttgccgtgtacgataagcaacatgccggcaccttggccacgggcgggaagccgtgcaacgcgattggcgcggtattgaagatgcgatgtcgtcatagtcgccgtacttgcccgtgtggcttgccgcgacggcggcggtgcgtctgcgtatgatagggatatggctgatttttcacatatccttgcaacgcgccccgacttcgacgacgaggaccgcgagtggctgcatcatcttgtcgccgattggcaggtgatcgccgatttgagctttgccgatctgctgctgctggtacaggatggcgatggcaaatacgtggtggccgagcaatgccgtccatccaccgttatgacgctgcgggcggaagacgtggtgggaaacgtcatgccggacgacatggtcggcgaattggacgccgccatgctctccagcgtggtgttccgctccacggtattgagaaccgtgggcaaggcgaccgtctgcaacgtgtacgcgccggttcggcacaatggcaagaccttgggcttggtcgtgcgtgagaccaatatggccacacgagaatccaacggccgatatgagtcggaaagcatcaacgccggcaagcatctgtacgagatgattccgcgaggccaattcccctacaaggattcggtgatgagccaacgccatatcgctcgcgtggcggacggcttcatcatcctgaccatggacggcgtggttcgatacgcagccccgaacgccatcagctgctttaggcgtctcggtctgctgaccaccatgcctggccattacctcagcgaactcggcacacagctattgaaggagaacgaccctgttccggaaaccctgccgttggtgttgacaggcaaagccgcggtcgactccgaactcaacgccaaccgttccgccgtctcgatgcgctcgttgcccttgtatgacaacaacggccgtatcggagcgattctgctatgccgtgacgtcaccgagctgcgccgtcgtgagcaggagctgcagaccaaggacgctacgatttccgagattcaccatcgtgtcaagaacaacctgcaggccgtctccgcattgctgaggcttcaggctcgtaagaccaagtcggatgaggtcaagaaggaattgcaggaggcgcaacgccgcgtgcagaccattgccatggtgcatgagggattgagccagaccgccgacgaggtcgtcgacttcgacaaggtgatcgccaacctgctgcgcatggccgtggacctagccacgatgaaagaccagcacatcgatatcaactacatgggcaagttcggcatgatgcccgctcaggatgccacgccgctgtccctcgtgctgaccgagctcatcaccaattcggtggagcatgggttcgaaggccgcaaggatggccatatcacgatttccgtgggccgctccggcccgaacctcaatgtggtggtcgaggatgacggttccggtctcggctccgaagaacagggtggattggctcgttcttccggttccggtttgggcacgcagatcatcaacacctttgtgaccaatgatttcggtggttccgtgcattgggagccgcgccgcgaaggcggcacccgcgtggtgcttgatatgaagctcagggctgctcaggacgagtgatgcgaagcccgaaatgaggaaaccctcccaagcgggagggtttcctagtatgacgaagcgataatcaaaacatcagatttgcatctgcatggcctgagaacggcgggcgcgcatggcgcggcgcttcagcgcacgacgctcatcttcgctcaagccgccccacacgccgtaatcctgattggtgtccagtgcgcacttcaggcatgcgtcaatcactttgcaggtgcggcacacggccttggcctcctcaatctgctgataggctgcaccggtgttgcccaccgggaagaagagttccggatccttgtcacgacatgcggccttggctcgccaatcaaaagcgctgctcattgcttgcctcccttaaaagccccgtggctggtgttgttccttaagtccagtaccaaggtaaccacgaaccgtggtgattttcaagaggttttgccgagaaaaaaccgaagttttcacgaagcgcactgcaccagacatgccgatgtgccctcgatgagcacggcccggcccgcgttgtcggcatcgatatgactcatcatatccaataggcgagcggggactccggccataagatcggacgttctctccccgcacgggaacacgattctggtattgcaatgctccggtatacgtatcgggcgaatcgtgctgacggcgaataccacgctgacggactcatcggccaacgcatgtgtgaaagacagcgcctgctcgtcggtgcggaatgggtcgaacaactcatcggcgtcgtcgacgaaccacacgatatgcggaggcggtggtgcatccgagctggcatacggcgtgcagcggccgccatgaagccattgcgagctccatacccgacgatgcggggaactgacacgtaccgccaagccatcagccatgctggcgtgtcgagccaatgttttcagcaacgtggttttgccgcgcccctgcgggccgatgacaccgatattgccaccggtgagggataccgtcgcctctcgcagattgatgccatcgtcggcaagtccaaatcgaatgcgttgcggtgcgtggtcggccacagtccggtcttttacgtgccgggggagtggcgcggtaaacagggacggttgcggcgggcttccgacgaaccgcgatgcgaacgcgatctggcggcacaccgcatcgatatcgcgtgccgttgcacagcggaatgccgtcacctgttcggaatcgttgcagaacgccgcaccgggcattgccggactgaggtcggcggcacgaccatcgccaagcagctcgcatgattgcagacggtcccgaacccgtaaacaaatgctgacggacatattcgccttcatatcggcactgacctgacccatgggattctgcgtacaggcgatcagatacatgcccagtgacctgccgagcgaggcaatacgcaccagacgattcacataatccgggagctggtccttcagggcatggaattcgtcaatgaccacgatcaggcgcggtggtggattgaccatatcgcggatatcggaagcatggacagcggcggacagctgttcacggcgtgtcagttcggcttccagcgcacgcaacgcgcgtacggcatgcgccagatccagatcgcatacgctgcccacggtatgcggcaaccgttcgagtttgcggaacgcggaaccgcctttgaaatccaagaacacgaaattcagatgctcaggcccgttcatcgaggcgagcgccagacaccagctttgcagcaacacggattttccggaaccagtggtgccggccaccagagcatgcggcccctgacggttcagatcgagcatcagcggctcgcttccggtcatgccgatcggcaccgcaaggtcaaggggttcaagccagcggcccacaatggcgcgccatggcaggcgtgcgaagtgcagcagcgattctatcggctgcgacggcgcatgacggaggtctgcggcgcggtcatcggcgtcgcccgtgataccgacatcgatcgttgcctgttgcggatcgggagccttctccgggcctggaggcgaggggagcgtcagcagcagggacacgagacaggcgaatatgcccggtgcgatcatggcggcgaacagccattgcccgtgcaacagcagtatgaccatcatcaatgcctgcgcgatcatcgggcatgccgcggcaaacatggtcaggcgggcgcgcaatggcggcgcgcccaaacggtgcttcgcccgggatacggcggatgccgtatggacggaatgtcgcttcgaatcgttctgctgtgatgtcatgcttccagcgtgggggaacgcatgccgaaagcgcaagccgaatcaaggtatgtggttctagcttgccgagttatccacatgacattttgcccgtgcatgattggcggtgtaggcaacggtgacgatcatgcgccgatgatgaagccgatgggctccgggaaagcgtcggtcagccttccgccagattgcccacggtgccggccttatacgtgccgtcggcaagttgattgaacagttcggtgttcttggcatcgtcaagcagcaccgaggaaccaacgccatcaacgtaataatcggggtcggaccagtacacgctgccggagatgccattcgagccggtggcgcttttgaacgccaacgccatggtgagcaacgtgtaagggttggtcttctcgtccacggtgagtgcgctcatcgcggcattggacactgccacgattttggacggattggtcagggtctcactgctggaagccttcttgacgatggccgagatgacctgtcgctggcgttcgttgcgtccgaagtctcctcgcgcgtcggcatatcgcatacgagagaaggacaatgcggtggaaccatccgccgtatggcatcccgccttccagttcagtccggaataggaatcctgaacatcctcgtcatagcacagttcgataccgcccaaggcgttcaccacgttctgcagaccgccgaacttgatctgtgccacatgatcgattttctggccggtgatctgctcgacgttgcttaccaaagccttcttgcccgcaatcagcgccactgcattgattttcatgtactggttatcgacgttcatgagcgaatcgcggggaatggaaaccaacgaactcggcccgcttttgggcttgatcagcaccagaatcgtatcggtcctgaagccagagatattgtctacgccgccgtaatcggtggaaccgtcacgctcatcggagccaagaatcagccaagtcgaggccggcgtgttgggggtgtcggtcagccagtcgctccgattcagtttgctgtccacccattgccaggcaccgaaaacggaaagaatcaacgccgccaccagtaccgcgattgcgcatagggtgatgcgtaaggctcgcggacggcgtgccgttaccgttttcgccgttgccgccgccggccggccaagatggctgaacttcgtggacacgtttgctgctggcgatgagggccgggaaaccggcatatccgacggattgcgcacggcgttgcgggatgagccggaagacatccgcgctcgcgacggcggaatgctgcgcggtgcggcggcatccggagccgtgctgcgagtggcgcgtccggttttcggagaaaaactgggcggagtccgcctgccgttgtccgcgacgttggcgcttgccgtggcgttggcgttcagttgaggctcttcgatgtcatttcccgtgacggacggacgggccgatggagcttgacctgactggcgcgaggttcgggcgggggcgaaggagcgtggcacctgcccggaaggccgggtgcgtcgatttcccgcaggaatgaagcttggcgggttgatatgcggatccgccccacctgattcctgcgtcataacccctcctgaaactgtcgattgtctgaatgacactttgacacagcatccgccgggtgttcctgcgctatggtgttcctgcgcaggaacggcacaatatcatgtgcaacggcgtcagggcatcgcgttcacgccatagcacacagttccataaaaatgatgtaatgacacgagaaagaatttgacaaaaccgaaattgcatgtgtgtaatttagtccgtatgaaaagctcaataggcaaggagaatcgcatgtggggtgtggtcgacgattcagccgaagagccatggcacgaattgtggggactattccgacctgatggcgatgtatcttggcagcacaaggcgttgtgcgcgcaaaccgatccggaggcgttcttcccggaaaaggggggctcgacccgtgatgccaaacgtgtgtgcgcaaaatgcgaagtgcgtgagcaatgcctgaaatgggccatcgaccatgatgagcgattcggtatttggggtggcatgagcgagcgcgaacgccgtcgatataagcgagagcaccgggagcgggcgtagctccacacacccccttcaagtctggtgcgtacactgggagtttatgagtccgacaggtaatagcgatattcatgaggcgttggccgacgccatgtcttctcgaccatatacgcataggcaggatgtggataccggcattacggctgtgatcaccgttgaggaggatatgcgtttcctccggtctacattgcgttcggtattgacgcagaatgttcttccgggggtcgtcatcatcgccgacgcgaccgggcgcaccagttcgaggataaccacctcgttcgaggtcatcccctcgccatcggggccggtgatggaggtgccgcagtccaagcatgtgaccattcacatcgtctcggccaagggcgcacgctccttcggcgatgcggtcagccgggcattggatcgtgccgatctggatgacgctccccgcgcattgtggctgctccatgatgattcccgcccttcggatgactcatgccttgaacgattgcttgaggcgtggcgcaatacgccgggcgccagtgtgctcgggtgcaaacagtgcgattgggaaggctcccatctgcatgatgtcggtatgtatgcgggtcaccacgccgtgcattccctggtggtcgatggagaacccgatcaggagcagtatgacgggcggcaggatgtgtttgcggtgtcgctggcaggcgcgctggtgtccatgtcgcaattcacgcgactgcggggcatcaatgcctggctgaccacctacagcgaatcggttgatttctgccgccgtgtctgcctgagcggcggacgcgtggtggttgtcccgcaagcggagatatcacatcgtcgcgcacggtatgagggcattcgtacgcgaggcggggaaccgcttaaggacgatcacacggtcaatcatgcgatgacggtgcatcgctcccaacagcggtatctgtacacggacctggccatgtcgtcctggtttatcgtctggctgtggaggctgctccgcagttttggcatggccatatccatgatgttcggcaagaagccgtatgaagcatgggtgcaattgtgcctgccatggctggccttggccgatatcgcgggaaacatgaaatcacgcagtctggtggccagacaatcgaaggtcgccgcatcgtccctgcatgtcttgttcgcagacagccagcagatcaagcagttccatgatcgtcgggatgcattccaatcccagcagggcagagtgctgctcagtccgctggaacgtgcccatctgcggacacgcaccatatatcgctggagtgcggccgtggtgatggcgctggtgtgctttgcggccatcgcggtgatgtattggccggtgttccgttcgatattctccggcggatcgttgtattccgatgtgttgcttcccaccggtgccagcttcacgcaactggtgcagtccgccaccacgccgtgggtgtttggcagcggcaccggcattcctgcgccgcccacgccgtggctgctggtgctgatgctggcctcgttggtcacgctcggccatgtgaccgccgctttggcgatgatactgtttgtggccgcgccgctgagcgcattgtcgttctgggcgctggcgggcgtattcacccgctcggacgtggttcgtgtgctgggaggactgctgtgggcatccaccggcattatgttcggctggtatgcgcaggccaatatgccgatgcttaccgtaatggtgttcctgccggccgcgttcgcattcgtgttccgtgccgtgggcatgtaccataccgaagacccgctcaagccgcgcacatccgttcaggccgcggccatcgccgcactgtgcttcatccctgtggtggccgctgaaccgcagctgctgttcgcgctgatcgtcgtgttcctgatgttcctgctattcgtgcgtcgcaagcgcgccatgctgttgctaattccggttcctgccgcctttgcggtggctcctacgctcgtcaatgcggtgcgttacgccgatttgggcatgtggcgtcaactgttcggcgacatcacggtgccaacgtcatccgccaacgggtcgccggcgtcgctgagtctgcttgaggccgcacagcgtgcgctgggatggcgaatggggtcgactgattatgccgatttggcggtcactgtgctgtttggcgtcatcacgctgcttgctcttgcttcgctggtgctgccgttcgcgttgcggacctcgcgactgatgtgggtggtaatcgtctgcggaggcgcgctcgccctggtctccagccgtgtggccataaccgtggatgccgatggtgtcgtggccggttccgcgcagccgggcatcgcgatgatgatattgggcttcctcgcctgcgtgtgtctcgtcgctggtggggcggtgaagcgattccaaccgttgcatgcgtctggcagtgatcccgcatcgaaaaaggaccgtctgcatgtgctcatcgtgtctggccgtgtggtgcttgctctgatactggtgtgctgcattggcatccaatgcatgtatggcatcgaacgtcataaggatgcgggactgggcgtgtctgaaaacggcctgcccatggtcaccaccgattatctggaggccggtgccgatcatcgtgtgcttgccgtgagcgcggagacccgcaacatcgtcaactatgcggtgatgcgcacctcgcgcggcgatttgatcgacagctctccggtccagcgggcgcgcctgctgtccggcaagcatgatgcggttgacgaacaactggcccaggcctgtgcctcgctgctgtccaatcccgacgaagaggccatcgcggccatcagcgcgcttggattcggcggcatctacgtggttcccgagaccggcgattccttgaacgacatgccgtatgaacagttgagcgcgaatatcgccgcatcgaacggcacccagtccctggtctccacggatagcggcagctactatcgtctgacgctgcgtagcagcgcctcacagcaggtggatacctcatggcagcaacgtgcacagcatagtgtctggaggcacgcctggctgatatgcctaggtgtgatcacggcgttgtactgcttggtcgccatgcctcgcagacgaccgtcctacggattggaggagcaggcatgagcaacaaaacttctggtttcaaacgtgcgatcggcatcgtgctcggtgtgatcaccatgctggtgttgattgcgctgttcgtcgttctcgtcatggcccccatccccaatatctgggtggataaggtggccgcttccgataatgccatcgaccagaccgttagtccgacccagtccgaaacctactgcccggcacctataggattggccgataccggcacgtacggcgacagcgccttccaggccactgtcggcaatctgagcacacaagcgcgctatgcggcgttcggctccgtctacagcgccactgtctcggcgatcgggcaaaagtccagttcagatgacgtaactttgaaagacgccgattcgaccgacgattcctcggtgaaaaccggtgctcagaagatcaatcagggagctcgtctgatcaatacccgtatgctgcaggccgcagctggcaccggcaccgtcggcaccatcgcatcatgggccgatgatggcgatgtgagaggcatatcggcggcatcctgcgtatcgacctcgctcagccagtcgttcctgctctccgacagcacgaccggtaccacacagcagctcatcgtctcgaatctctccaccaagccgaccaccgtcgacattgccgtctggggttccgagacagccgggaaaatggcattgtccacccaatccacgctgtctgtgccagccgagggggagtcctcgatggaactgtccgccgcggtcgatgggcagcatggtctgttcgtgaccgtttccagcaaggagactcctatcgcgtccgtggtgcgcacggtgaccatggatggtctgacaccgaagggttctgatttcgcgctgccgctgccgaccgcatccaatgcatcggtggcgccgtccatcactgccggcgatgcggtcaccgcttatctgttcgccaaggcagacaccagcaccgggctgtcatggattaccgccaaaggcttggttcccgccaaagatgccaccgtcactgctgataaagtgacggcgatcgacttgggagaagctcctgatggggcgttgggcgtgatgtccaccgcagaggacgccgtgtcgttctccgtcaaggccacacgctccggtgactccggccaagccgatttcgcattggtcaatgccggcgagccatccgaattctcggggttggcccttcccgacggagtaaaggcctccatcacgctggccaatacgtccaatgcgcgcaggacggtcaccttgcgcgcctacgatgatgccggtgcttcggtaacctccaaggaaatcacactggatgcgaacgcagcacaaacgattgaagccggcaatctttccggcgatcatggcaccgcggtcgtgctgatgttggaggactcatccaagaaagtgagctggggagcgcggttcagtcacgattcgttgcaagacaaggacatcgccggattgtccgtcatcgacgcttcaacgctgatgcccgccacggttcatgtctgggctcggaacgattcctccatcgtcaagtagaagggtatgctcgccgaagcgtcagtctgatgatgtttcggcggcgatatagctgcgggccgtgccactaccttattacaagtgacacggcccgcagtgttgtcacaggccccagtcggggtcgatttcctcgggcctgcgcccatacaattccgctatgcgggccaccagctcatccctgacggccaattgcagttcgagcttggtaggtgcctcggtctgcaacggcatgcggtagagcacgactcgtgcgggaatgccgtggctggcggggaagcactgggacgtcatattcggctcggtctgccaaggcgtcggatccgaaggcggcacatcctccaccgcgaactggagcggacgtatcagttccggccacgcttggccgagcctgcgaacctgggccgccaccatatcgtcgaacatgccggtgcgagtgcggtaacggggcagacgggtgccgaacatcggggttcgtgtgccgcgaccgtggcggttgcggtagattcgtgcgttccaaggtggctgaagcatggttcccaccatagggcatggcggaggcaacatgcgttaggattggttcattggctgtgaacattcgtcaacgagggaggcacgacaaatggtggtacgttcgtggtccgaacttgatttcgataatgtctgctccaacgccaaggtgttcggtttcgatttggacaacacactggccagctcaaaacagccgatgaagcccgcgatgatcgaacggttctgtgcgttgctcgaccatacggtggtggccctgatctcagggggcggcatggcggtggtcacctcgcaggtgctggatgtactcaccccgaatgccaggcgcggcaatctgcatgtcatgcctacctccggctcccggtattaccggtgggatggcacgcaatgggccttggtgtatgcgcatgatctgtccgaagccaccgtggccgctgtctcggaaagtcttgagcgacatgcccgggaactgggattgtgggaacagcaggtatgggggcctcgaatcgagaacaggggcagccagatcaccttctccgctcttgggcagttcgcgcccgtagcggccaagcaggcatgggatcgcgataacacgaagaaacaggcgctggtcgaagcggtcaaggccgatctgccgcatatgcgggtcagggccggcggatacaccagtgtggatgtcagcgaatgcggcatcgataaggcctatgccgtgcgcaagctgacgcagacacttggcatacgggccgatgaaatggtgttcgtgggtgatcgcatgacgcctacgggtaatgactatcccgcggttgaggccggtgcgatcggtgttcgtgttgagaatccgcaagatacggtacaactgctggatgcactgcttgcgcgattcgatactccagctcgatagtgacgcgttatggacgggccgagcgtatacaagtggtggcatgcgatgtgggcacaggtctgcaatctgctgtttccacgcggctgcgctgggtgtgacgcgccggatgaggtattgtgtgcggcatgctgggccctgttcgcgcaatgccgggaacgggatgcagacagtggtggcggagcccgtatatggtccgcatcgatttatcagggagcggtacgtcgtgccattctcgactggaaggaccacgacgataccgagcttgacggcccgttcggccgcatcatggtgtcgctgctgaacaagacgccaataccatcatcatgcttgggtcatcgcgtattggtggttccggtgccatcatcgcgggcgtcaatgcgccgaagaggacgtgcccatacggcaccgttggccaaatcggtggcaggggcattgcgtgggtacggcgtcgatgcgcgaccatgcaatgccctgagctcctccaccaaggcacgctccgtgcagcaggtctcttcggcacagcgtgcccgtcgtatcaccggtcatgtcagggtgaagcgtgatctcatcggcaatggcgacgcggtgcttctcgttgatgatatcgtcaccacaggtgccactgtgcggcaatgcgttcaggcgtttcagcaggccggcaccaaggtggtgggcgtgctggtattggcggatgccgtggtgcgacggtccgatgacgatatcaacgggtgaatgacatcggtgacgatgccccagatagcaggcgaagcgccgttgctcggcatgtaatcggggtatcgcggattctcggcgtgcaatatggtgatgccggcccgtgaaaccagccgcttgatggcgatttcgtcgtccatgacagccgcaaccacatctccggggactggtgccaacgaacgatcgacaatcagcagatcgccgttgtgaatacccgcattgatcatggaatcgccggccatctgcataacaaacagcgtggcctcgtgcgccatggcctgtgactcggattgctgtgtcatgctgcgcctcccaccctgtattcgaacatctgttcgaatacagtatacggtaggacgtcggacaatatcagcgttcggcgatgtgatatttaggcaggatgatttcgaaatcggcacctcgcgtgtcgtcgaccactttgacggtgccaccgtgcaattgggccgcccagcgcgcgatggacaggccaagaccggtgccgcccgactcggtgccgggacccgtcttgcctttgacaaagcgccggaagatgtccaaacggtcggaaggcgcaatctgggagccgaaattcaccacattggtcacgatggtgccttggttttcgtcctcgtgggcgtcgaccagcacggtggtgccgtcggccgaatgtttcagcgcgttggcgatgatgttggtgaatagctggcgcaggcggtcctgatcgccttccatcgtgatgtcggccggcacggtgacgcggatgtcgtgggcgtggccaccatcggcgatttccaacggctcgatggtctcgtcaagaaagtcggcgaagttgaacttttcgatattcagactcgccgcaccggcctccatacggctcaggtccagtaggaaggcgatgagatcggagagacgctgcgtttgggtgaggatgctctccagattggtgggagtgggctcggtgacgccgtcggccatgttctcgaccatcgcctgcaaagcggaaacgggcgtgcgcagctcatggctcacattggcgatcatgtcgcggcgcattttatcggcatgctcgagttcgccggccatctcgttgaacgagcgagccagcttgccgacctcgtcatgacgatcctgatcgatatccacgcggaccgtgtaatcgccatccgccatggcttcggccacatcgcgcatctggcgtaggggagcggtgatgccgcgagagaagaaataggtgatgcccaaggccaccaccaaagtcagcggcatggcgatccaaccggaccagccgaatttcaggaggaaccagcacatggcaaacgcgatggcagtggcgataacgatcagtgcgctgagttccagcttcagagatgagaacaaatcaaccggcttgacgcgaggtttcatcgcatcaagccgggattgctgttgttttttggatgccatcacgcggtcggcggctcgaaagcgtagcccacgccatgcacggtgcggatggtatcggcaccgagcttatggcgcagcgccttgacgtggctgtcgacggtgcgggtgccggatgcgtcgacccagtcccagacctcttcgagcagcttttcgcgggtgagcaccgacttcgggcggcgggccagcgtggccagcagatcgaactcggtgggggtcagatgcacctgttcgccgttcacggtgacgatgcgctgggccgggtcgatgaccatcgaaccgaagtcgagcagcttctcgttctccgagttcttggcgatgaccttcgcacgctccacgcggcgcagcagcgccttgcagcgggcgataagctcgcgcatggagaacggcttggtcatgtaatcatcggcacccgctcccagaccgatgaccttgtcggcctcgtcatcacgtgcggtgaggatcagcaccggcaccggacgttcggcgacgatgcgtttggtggcctctagaccatccataaccggcagcatgatgtccatgatcaccagatcggggcgtagctgggacgcggcctggacggcggaagcgccgtccccggccacgcgagcggtccatccttcagcggtgatgcgctgggcgatggccgtggcgagcgtgggctcgtcctcgaccaccagcaccgtgcgcggtgtcgtattctgacgcgctgtggtattgagcataaataaaccggttacctttcagcctgttgaccagttcagtcttccggcttcaagaatacaactcccagagccggaacggtgatcttcgccgagaacggacgtgaatgatattcgccctcgaccgcttcgaaggtgccgttgtggatgtcggagccgccgtacttggcgtcatcggtggtgaacacttcggtccacttgccgccggtgggcagcgccacctggtaatcggaccaggcctcaccggagaagttgaccaccacagccaaggtctcgcccttggtaccgatgcgcaggaagctcagcgtgttgtggtcggcatcgtcgctggtcagccactggaagccggccgggtcgaagtcctggctccatagtgccggatgcgccttgtagaaggcgttaaggtcggcgaccatggtctggacctgacggtgctcctgccagttcaggcaatcccaatcgatggaggcgtcgtgatcccactcgccccactgggccagctcgttgcccatgaaggagagcttcttgcctgggtgagcccactgataggcgaacatcgaacgcacgccggccagcttctgccagtcatcgcccggcatcttgccgtacagggaacccttgccgtacacgacttcgtcgtggctgatgggcaatacgtagtgttcggagtaggcgtacaccatggagaaggtgatctcgttgtggtgccacttgcggttgatgggctcctcgtgcagatactcgagggtgtcgtgcatccagcccatgttccacttcatgccgaagccgatgccgccggcggaagtgggggcggtgatgcccggccatgcggtggactcctcggcgatcaccatgacgccggggttgttcttgtacgcggtggcggtggcctccttgaggaagtcgatggcctccaggttctcgcgtccgccgtagatgttcgggcgccaatggccgggttcgcggctgtagtcgaggtagagcatggagctgacggcatccacgcgcagtgcatcgacgtgcaggtcctcaagccagaacagggcgttggccaccaggaagttgcgtacttcgcggcgtccgaagttgaacacataggtgccccattcagggtgttcgccgcgcagcgggtccgggtcctcgtacagcggggtgccgtcgaagcggccgagcgcgaaggcatccttcgggaagtgggcgggcacccagtccatgatcacgccgatgccggcctgatggaactggtcgaccaggtaacggaagtcgtcgggggaaccgagacgggagtcgaccgcatagtagccggtgacctgatagccccaggagccggagaacgggtgctgggccagtggcatgaactccacgtgggtgaagccttcctgcttgacgtagtccacgagctgcttggccaggtcgcggtaggtcagtccctgcctccagctgccggcgtgcacctcatagatggagaccgggccatcatgcgggttggtggtgcggcggtgctgcatccaggcgtcatcgttccacttgtaggtggattcggtgacgatggaggcggtgttcggcggaacttcgtgctgacgctccatcgggtcagccttcatctcccatgtgtaattggcgttcaggatctggaacttgtaggtctcgcccgcgccgattccggggatgaagatctcccacacgccggaggagccgagctcgcgcatggcatgacggcggccatcccaagcgttgaagttaccgactacgcgcacggcatgggcgttcggggcccacacggagaatgcggtgcctaccacctgttcgccgggcgtgccgtctgcgccgcccatcggatcgtcatagcgcagcacatgcgcgccaagcgtctcccagagcttctcgtgacggccctcgccgaacagataggtgtccatgtcgccgactgtgggcatatagcgatatgggtcgtcctcaatgagcactgcgccgctttcccactcggtcctgacacggtagtcgggaatcgtgggctgcttcttagtgccggaagccggcacggtaaccacgaacacgccgttgtattcgtgggtcatcgggtattcgccatcctgggtgaggatggtcacggacttggcaagcggacgcagcacgcggattgtggcggtgtcggcatgcttgccgatgccgagatgcccgccgagaactccgtggggattgtagaattcagcattgctcaccgcatcgaggtcgccttgggcgacaggcacggtgacggtatcttccttgatcttcgtttcttcagccatgacccaaagtctacgtgcgttggagtcgtaaacgctacattggcgcgtcgaaaatggcgaattcttgcccttttcggtgtgtcttcgtggttgtgagcgctctcataggggcggtccaggccgcatggcataattattcgagtttttgtgtgtaagccgtcagttctcggagggtacatgtcttacaaagtcggcgatatggtcgtctatccgcgtcatggtgcagcgaaggtggaggccattaccgagcggacggtcaagggagtgacgcgcgaatatctgcagttgtccgtactctcttccgatggtttggtcatcaacgttcccgtggacaatgccaagaaggtcggtgtgcgtgacatcgtctccgcatccgaagtggccaaggtgttcggcatcctgcggaccccgatcatcgagaaagagatgaactggtctcgccgttacaagctgaacgtcgaaaagatcgccaccggcgatgtcaacaagatcgccgaagtggttcgcgatctcgcccagcgcgatgtcgacgagcacggcctgtccgcgggcgagaagcgcatgctcaccaaggcccgtgccattctgacttctgagatcgccttgtccgagaagatcgacgaggcggaagcccagcgtctgctcgacgtgaatctgggctacgagcccgctcagcccggtgacgacaagcatcacaccgccgagcccgaagaggccgcggccgatactttggctcgtgttgaagccgagaagaagtccaagaagaagtgatttgattgttttgaggccccggtcgtgtccttatgcgatgcgccggggcttcgtgattcataatcgtttgctgccgttcgtctgggcaacgccatcgaaggggactgcatggggtctgtaggagtgctgatagggcaaggttttgacgctcaccgttttgcgcctgctggctcaggccgtgaactgtggattgccgggctctactggccggtgcctgattcatgcagcgaggccgatgccgccaaatacgaggggatcgaaggcgattccgatggcgatgtggccgcgcacgctctgattgacgcgttgcttgccgccgcccgattgggagacattggttcactgttcggtgtcggtgcggacgcgcatggtgccggaatgcatggcatcgatatgttgcaagaagttgtggcgcatctggcatccaacgggtatacgccggcatcggcctcggtggcgatcatcggcaaccgcccgaaaatcggcacacgccgtgctgaagccgaagccgccctgtctgcggcggttggttgcccggtatcggttactgccaccaccaccgaccatatgggattcactggccgcggcgaaggcatcgccgccatcgccaatgccttggtggagaagatataacaaagcccccgctatgaattcgccagcgggggcaagaaaaaatggatgagattacttccgcatcgtctccacggctttggcgatagcccagaacagggtggaaagcgtcacgatgatgaagctcgggggagcggggaacatcgccgacagcacgagtccggcccaaatcgacaccaagcacagcacgctggcgatcaccattgccttgaatggggagccggccagaatattggcggtggccgcgggcgtaatcaccagtgcgaaaatcagcaaggtgcccactgccggcacggcgatggtgatcacaccggccataatcgccataaacgccacgttcatcagcccgatcggcacacccttggcctgtgccacctgctcatccagcgagctgaacagcagcgggcggtagatgatggccaacaatgccagcagcagtacgtcgaacacggcgaagccgatgatctggccggtggtgatggtcaggatcgagccgaagaggatcgactgcatctgctgggaggcggaactcgacaatcgcgcgaagaacagacccaagccggtggcgaaggccagcacggtgccggtggcgatttcacgctcggaaacgcgcttgcccaaagcaccgatcaccagtgcgccgcccagtgcgaacacgcccatgcccagtgacacgggcaggccgagcaacaccgcgccggtcgcgcccggcagaccgatatgggccagcgcatgggccgcgaaggtggaacgacgggcgatggtgaagtatcccatgacaccggcggctagggcaatgcacaggccggcgatgaaggcgttggtcatgaatggagcggacagtgtatccagccattcgggatcatacgaaaagttgatggtgctcatgtctctgtattttctccatgcctgagctgcagtccgttgatgggctgtgggtcggctcgcttgatgttatcgattctcggcgctgatggcggcactgccattggtggcattgccgtgctcgtgatggtgcaattgcgccacttcggctgccgtgtgcatatcctgcggctggtcctggagctcatccggcgtcggggtcacgaacatgtctccctgcggagtggtgaccacctgcacctgtgtgccgtagaggtgggtgagtaggtcggagtcgagcactttgtgcatatcggcgtagtgcgggtgaccgtcgagcaagtagacggcaccggtcagaatcggcaagagcatattgagatcgtgcgcaaccacctggatggtcatgttcagttcgcggttcagcttggccagcacgtgtacggtggcgcgctgactggccagatcgaggttggccaacggctcgtcaagcatcagcagttgtgggtcgcacaccaacgcctgggcgatggccacacgctggcgcaaaccgccggacagttcggacagacggtaccgcgccttgtcggcgatgccggtgaactccatcgcctcgagcgctttggctttctgggccttggtgatggggtggatgccgaatcgggtgccggtcaggcccagcaacacggattgttcggcggtgagattggaatcgacattcgccacatagctctgcggcacatatccgatgcgtttgttcatctcgcctgcgggcttgcccagcacggtcaggctgccatgacagagcggcaaaaggcccagctcggccctcatcatcgtggttttgccggtgccgttggtgccgacgatggccgtgaccgaaccggtgggaatggcgaaggtgccatgctgccagatgatatggtcgccacgcttgatggcggcatcgctgaacacgatgcaatcggaagtttcactcataacgcccgattgtggcaaacgatgctgacaatcgttctcaatatcgtgtacggatggtgataaccaaagagaagggttgtgcggccatctcgacaatggtcgcacaacccttctcatgcaaggcgtctattggcattggcacgaatccgatgccggtgtcctttgcttctaactatttgccggagtcggtctggtcgttgccggaggcatcgccggaatcgccattggcggcatcggcctttgccgaatcctgagatgagtcactggatgcggccgccttgcactgacggatgtacttggggtccgtgctggaaccggtgctggccttggagtcttgcgcattggcatcatccgtggcggagccttcggcgctggaatcatcggaattcgcgttgctgtccgcggtatcgccgtccgtggcgtcttcgcagccatagcttggatccaccgcgtcgatgatggtgttgatgagctggttgatccaggcgttcagcgtgtcggcgtccttgggcatttgttcggagacgtcgactaccggcacatcggcgcgaccggcagcgccagtgatcatattggtcgcgtcactggcttcctgcgtgttgttgaccagcacatccacgcccttgtcttcgatgagtttctggaaagactgcaggtccgcgggtgccggttcgccgccggaagcggtcgattgcgtataccccttgggcgtctgatctttgaacccaagatcggccatcagataatagaccacgggttcggtggctgcataggtgaggttggagtgggacttggtgaactcggacgcccatgtttccaacgatttctcgtccgcctgccatgccttgagccgcttctggaaggctttcttcttgctggggagtgcctttatatatgcatcggtgatggccgtggccatgctggatcgagcgtctttggagaaccacagatgcgggttatcgccctcgacggcacccatgacggaagcggcggatacgatattcgtggtcttggtcatcgatttggtggcccaggaatcgtagcccgcaccgttggccacgatgatttgggccttggacagcttggcgacatccgaggtctttggctcgaaatcgtgggcatccacattggtggagttcacgatggacgtgacttccacatcatcgccgcccagctcggcggccagcgagccccattgattgagggaggccaccacattgatcggcccggtcggtgcgggaacgctggtcttgttgtccggctcggtttcagcgggggaggtggctgcgcatgcggtggtcgcgaacaacaggacggcgctcaggccggctgcggcgagtcgcgtaagtcgtgtgatttgagtccccatggcacgccttcttcgtgagagcgaacgatatataatcctgacttgttccaacgatagcctatcgtttcgatagaatgcaccgaaactacaggggagggcgttgatgtccacaaaaatcgacggtaagcagattgcggccgaaatcaagaccaaccttgccgagcgagtgaacaagctcaaggcgcagggcatccaaccggggctgggcacgctgctggtgggcgaggaccccgggtcgatgaagtacgtggccggcaagcacgccgattgccaggaagtgggcattacctcagtcaagaaggaactgccggcggacgccagcttcgacgacatcgccgctgccgtacgcgaactcaacgaagatccggcttgcaccgggttcatcgtccagctgccgttgcccaagggcatcaacgagaacgcgatcatcgacatgatcgacccggccaaggatgccgacggcatgcacccgtacaacctcggcgaactggtgctgcatgtgcgcggcgacatttcgacgccgctgccttgcactccgcgcggtgtgctcgagctactcgacgcctatgacattgatctgaacggcaaggaagtgtgcgtgcttggccgcggcatcaccattggccgcacgattggcctaatgctcacgcgcaacgccgtcaacgccaccgtcaccctgtgccacaccggtacccgggatgtggccgaccacatgcgccgcgccgacgtgatcgtcgccgcaatgggttcggccggattcgtgacgcccgacaaaatcaaggacggcgccgtgctggtcgatgtgggcgtcagccgcgtctacgacgaagaagccggtcgctaccgcatcaagggcgacgtggacaaggcctgctacgacaaggcctccgcctacacccccaaccccggaggcgtgggtcccatgacccgagccatgctcctagccaacgtcgtggaaatggccgaacgacacgcctagagtttcctaggaaatttgggcagagttgcttgtattgtgagtatctgtatgcctgtagggtgtgcgtataactgaatatcgagaaattatccatccactattagaaaccatatatttacatggcagagaacaacactgaagtcaccaaggttgccatcaacgacatcggcaccgaagaggacttcatcaaggcagtcgattccaccatcaagaacttcgatgatggtgatctggttgagggcaccgtcgtcaagatcgatcacgacgaagtcctcctggacatcggctacaagaccgagggtgtcatcccctcccgcgagctttccatcaagaaggacgttgatcctgacgaagtcgtcgaggtcggcgacaccatcgaggcccttgtcgtcaccaaggaagacaaggaaggccgtctgattctgtccaagaagcgtgcccagtacgagcgcgcctggggcgacatcgagaagatcaaggaagctgacggcgtcgttgagggcaccgtcatcgaagccgtcaagggcggcctcatcgtcgacatcggtctgcgtggcttcctgcctgcctccctcgttgagatgcgtcgcgtccgcgacctctccccgtacatcggccagaagatcaaggccaagatccttgagctcgacaagaaccgcaacaacgtggtcctgtcccgtcgccagtacctcgaggagacccagtccgaggtccgcgagaccttcctgtcccagctcaagaagggccagatccgtgagggcgtggtgtcctccatcgttaacttcggcgctttcgtcgatctcggcggtgttgacggcctgatccacgtttccgagctgtcctggaagcacatcgaccacccgtctgaggtcgtcaaggtcggcgacaaggtcaccgtcgaggtgctcgacgtcgatctcgaccgtgagcgtatctctctgtccctgaaggcgactcaggaggatccgtggcagcgcttcgctcgcacccacgttcccggccagatcgtcaagggcaaggtcaccaagatcgtccagttcggtgtcttcatctccgtcgaggacggcatcgagggcctggtgcacatctccgagctcgccaaccgtcacgtcgagaacccggagaccgtggtcaagccgggcgagaccgtgttcgtcaaggtgatcgacgtcgacctcgatcgtcgccgcatctccctgtccctcaagcaggccaacgactccgttgacccggcttccgaggacttcgatccggccatctacggcatgccggccgagtacgacgagcagggcaactacaagtaccccgaaggcttcgacccgaacaccaacgagtggatcgctggttacgagaagcagcgcgaggagtgggagtctcagtacgccgccgctcacgagctgtgggaggagcacaaggagttcgtggccaaggagctggagaacgctgccgaatccgcagccgccgacggccagggcccgaaggaagagaagccggtcgaggagacctccaactactcttccgctgctccggctaccggtaccctcgccgactccgatcagctcgccgccctgcgcgaccagctgctcggcaagtgagtttgccgcgaagctagcgcttagcgtttaacggaaacccggtccgattgggccgggtttcttgtgtttttggagttatccgccaatgactcacctcagtctcgctacgcgagccggatcccctccctgaggggagctgtcggcgatagccgaccgaggggagcgccagctatcatgggcaccatgatgcgaataggactgaccggcggcatcgccgcgggcaaaagtacggtggcggcgcgactcaagcaactcggcgcgttgcatatcgactacgatgcgctggcgcatcagatcgtcgaacccgggggagtggcgctgccacagatcgtcgccgagttcggtcctgatgcattgctcgccgatggcactatgaaccggccatggattgccgatcatgtcttcggcgcgaacgccgcgccgggcgcacgtgaacggctcgacgccatcgagcacccattgatctatgccgaggcggcgcgactggagcatgagcaccccgaggcagccatcatcattcacgacattccactgctcgccgaggtcattgacgatattccattcgcctttgaccatatcgtcacggtcgaagctcccgtgtgcatgcggctcgaccgtatggtcgaggaacgcggcatgagcctggaacaggccgaggcccgcatccgccaccaatccagtgaggaggagcggcgggccatagccgatatcgtcatcgactccacccatccattgcccgagatgctggcccaagtgggtgagatatacgcaggatggtgcgcaggtcgctaagatgaggccctatgggattcaatatcgagcgcgcggacaagcctttcgtcgtcaaatcgccatataagccatccggcgaccagccgcaggccatcgccgaactggccgaacgcatcgaaaacggcgagaatgatgtggttcttatgggtgccaccggtaccggcaaaaccgcaaccaccgcctggctgatcgaaaagctgcagcgaccgaccctgattatcgagcccaacaagacgctcgctgcgcagctatgcgccgaattccgcgaactcatgccggacaacgccgtgagctacttcgtgagctactacgactactaccagcccgaggcatacatcccgcagaccgacacctatatagaaaaggactccaacatcaacgacgatgtggagcgcctgcgccaccaagccaccgcaaacctgctgacccgccgcgactgcgtggttgtggccaccgtctcctgcatctacggcttgggcacgccggaagaatacgccggtcgcatgctcttcctcaaagtcgggcaggaaatcaaccgcgacgacctgctgcgccaattcgtggccatgcagtacaagcgcaacgacatcgccttcacgcgcggcaccttccgcgtgcgcggcgatacggtcgaaatcatcccggtctacgaggaactggccgtgcgcatcgaattcttcggcgacgagatcgaccgcatctccacgctgcacccgctgaccggcgacgagatcgacgaggaaaacgaagtccacatcttcccggcctcccattatgtggccggccccgaacgcatggaacgggcgctcaaaaccattcgcgaggaactcgacgaacgcctggcagaactgcgcaaacaaggcaaggagctggaagcgcagcgcctcaacatgcgcaccacctacgatctggaaatgctcacccaagttggcgtgtgctcaggcgtcgaaaactattcgcgccacttcgacggccgcgccgctggcaccccgccgcacacgctgctcgacttcttccctgacgacttcctgctggtcatcgacgaatcacacgtcactgtgccgcagatcggtgccatgtacgagggcgatgcctcccgcaagcgcacgctggtcgaacacggcttccgcctgccctccgcgatggacaaccgaccactcaaatggccggaattcctgcagcgcgtcggccagaccgtgtacctgtccgccacgccaggcgactatgagatgggactgtccgatggggtggtcgaacagattatccgcccaaccggtctgctggacccgaagatcgacgtacgcccggtcaaggggcagatcgacgatctgctcgccgagatcaaggcccgtgtggccaagaacgagcgcgcgctggtcaccactctgaccaagaagatggccgaggacttgaccgactatctgctggaacgcggcatcaaggtcgaatacctgcattctgatgtggatacgttgcgccgcgtcgaactgctgcgcatgttgcgcgaaggcaagatcgatgtgattgtcggtatcaacctgctgcgtgagggcctcgatttgccggaagtatcgctggtggcgattcttgacgccgacaaggaaggattcctgcgctcctatcgttcgctcatccagaccatcggccgtgcggcccgaaacgtgtccggcacggtgatcatgtacgccgacgagaccaccgaagccatgcggcaagccatcgacgagactgaccgtcgccgtgccaagcagattgcctacaaccaggagcatggcatcgatcccaagcccctgatcaagaagatcagcgacgtcaacgacatgctcgccaaggaggatgtggacacccagaccttgcttgaaggtggctaccgcaacgcgggcaaggccggcaacacgcacctgggcgtgccggtactcgatcccaacgaggcagacaaacgccacgaggagatcctgaaggccggcctgcccgcgcaggacctcgccgacctgattcgccaactgagcgaacagatgcacaccgccgccgaacaactccagttcgaacttgcggcccgtctgcgcgacgagatccgagacctcaaaaaagaactccgtcaaatgacggaagccaacaagtaaccaaattcccatacccgaggcgggcagtcaggggatgcgttgtcgaccgtaaagacttggcctgagcggcccggagcgtgtcgaacaacacatcccctgactgcctggcgatcagcgctaccggaacggccccaaaaccgtcacatacataagttagtgtagggaatcatggcagaaaccccactcgcatttgaaatcatcaccttcgtggtgctcgcgttgttctttatcgtcgacctgttcgtcatcgggcgtcgaccgcatgtgccctccaccaaggaatgcgtgcagcatatcgccttcttcgtggttatggcgctgatcttcggcggatgcatctggttcttcgccggctccaagcccgccatcgagttctattccggctggctcaccgaatactcgttgtccatcgacaacctattcgtgttcgtcattatcatgtcgaacttcgcggtgcccaagcagattcagaagtatgtgctgtccatcggcatcaccattgctttgattttccgtggcattttcattctgatcggcgcggccctgatctcccgcttcacgtgggtgttcttcctgttcggtgccttcctgatctacaccgccgtcaaactggtgctcggcggcgatgaagatgaggaatatcacgagaacggcatcatccgtaatctgcgcaagatcatcaagattaccgacgactacgacggcgagaagctgcgcaccaccaagaacggcgtgcgttactggaccccgatgctcatcgtgttcctgaccatcggcaccaccgacgtcatgttcgctttcgactcgattcccgcgatcttcggcctgaccaaggatccgttcctggtgttcacctccaacgtgttcgcactgctcggcctgcagcagctgtacttcctgctgggtgctctgctcgacaagctcgtctacctgcctgccggcctgtccgtggtgctgggcttcatcggcgtcaagctcatcatggaggccctgcacggcaataccttgccgttcatcaacggcggcgaaggcgtccattgggtgccggaggtgcccacatggctgtcgctggctgtgattgtgctcgcaattggcggcgcatccgtggcttccgtgatcaagatgaagagcatggaaagcgctgaaaaggcctgaaatcgttagagaatacaacccttaaacccagtcaacacaacaatgtgagcgctcacaacacaccgtgaagaaaacttgtcatgagtcggctcgcgctagtagactgggtttcggcaaatggggcaatcgcgcctcgaaccaaattgaacaagaataggcaggcattcatgcgtaaagccaagatcgtagacaccatcggtccttccaccgaggattacgacaacctcctgaagctcgttgaagctggtatggacgttgctcgtctgaaccgctcccacggcacccccgaggatcacctcaaggtctacaacaacgtgcgcaaggccagcgaagccactggtcgcaacgttgccgcgctcgttgatttgcagggcccgaagattcgctgcggttggttcaagaagaacgccgatggcgaagacaaggttcagctgcagctcggccaggaattcgtcatcaccactgatgacgtcgagggcgacgagcacatcacctccaccaccttcaagggcctgccgggcgattgccacccgggcgacccgatcctgatcgatgacggcaaggtccgtcttgaggtcaccaaggtcgagggcaacaacgtgtacaccaaggtcgtcgtggccggtcctgtgtcctcccacaagggcatcaacctgccgggcgtcgccgtctccctgccggctctgaccgagaaggatgaggccgacctgcgttgggccatccgcaccggtgccgacatcatcgccatgtccttcgtgcgtttcgccaccgacatcgaccgcgcccacgagatcatggacgaggaaggccgtcgcatcccgatcattgccaagatcgagaagccgcaggctctggagaacctcgaagagatcgtcaagaccttcgacggcgtcatggccgcccgtggcgacatggccgttgagtgcccgctggaagaggtcccgctggccactaagcgcatcatcgagctggctcgccagtacgccaagccggtcatcgtggctaccgaagtcctcggctccatggtgaactccccggttccgactcgtgcagaggcttccgactgcgccaacgccatcctcgacggctccgacgccaccatgacctccaacgagaccgccgttggtaagtacccggatgtgaccgtggccaccatggcccgtatctccggctacgccaccgaccacggcttcgaccgtatcccggagctcaagaaccttgacatgtcctccaccggcgctgtctcctccgccgctgtggacctggccgacaagctcaacgccaaggccatcgttgcttacacccagaccggtgccaccgtgcaccgcgtctcccgtgagcgtccggccgccccgatctacggcctgaccagcaacgagcacacctaccactggctggctctgtcctggggcaccgaagccttcctgctcaaggaggactaccacgacaagtcccgcaaggatctcatggtctacacggacaaggtcctcaaggatgctggcaaggttgctgacggcgacaagatcgtcatcctgagctctgctcagggcgatcaccagccgggccgcactgactccatctacgtgcacaccgttggcgcttgcgactgatttcaggcttctggtagctgctgacagctagcatatagcacacgaaagcccccatccaaagtggatgggggctttcgttatctgttatgttgcgattgtgtggtgattgcaatggcccacagtcaccgcggtgatcgagcgtggcgatcagtcgttgagatgatcgagcgtgccgctcttcaggcgcaaaatggcgaccatggtcttggcatccacaatcgtgccattgaccaccatctcataggcatcgtccaccgacaccatacgcacgtcggaacgcggagtctccgggccgatttcctgacgggaagccggggtaagaccggtggcgaagaagattgcggtgtgctgggtggaatagctcggcgtgttcataaaacgggtgaactgcgtaagcttggtggcgtcgaaaccggcctcttcggccagcttgcgcttagctacatcggtcgggcgttcggacgggttgttggcgtgaccggccggaatctccaacgtccaacgatggttggcgatgcgatactgctcgaccagcggaatcatgccatcatcggtgacggccagcacagccacagtgtcgccattgttctcctgaacaaagtagcgttcaaacgaaccgatttgattcgactcataggagacgtgatcgacattgaaataatgcgtctccacaatctgtctacgggaaatctccttgaccggagaggggcgccagggatcgaactgacggtaagtttcgttgctcataagccctcctaacaaaagcgatacatcgaaactacagcccattgtaagcggtgaaaccacgcaggagaacgggcaacacacgggtgcgccgtccgcgatatcgacgtgtttcgcctgtttcaccggggggaatggaggattggcgcgtgtcttgtgtcgcaagagtcgaattggtatgctactctcttcagagtgctttggcacgccctcgtatcccaattggtagaggaagcagcctcaaaatctgcgcagtgtgggttcgagtcccaccgagggcaccaaaaagtccgggtcatacggcatcacgatggcgcggggcgaattgttcgctccgcgctttttcgtattctcggcatcgtctggcctcacgatgtagcgtggaccggcggcaccggccagctcttgggatgggattgcattatcaactgcgtactgagtacgcagctgataatggtctgatggcatggtgacattgttcgtcacgaggtatgcaacggagacattgaagaatgcggatagatatgcgagatcgtcggcgttccatcgaactttccctcccagcttcaggtttagagtggattgagtgatgtgcatggcattagcgatactcgtctgaggaacgcgatgacgctgcttaaggaaatatacgttgtcggtaataatttgacttaaaaccttaggtaggccgttgtcagtgatttctgtctttttgttcattggtgaagtactcataaagcaatgataccttcttctttattggtttgtccaataccatgctatgctataggtatgcccaatagaacgatagataaactgatggcggacagggtggaccgtttgcgtcgccaggccaatatgactcagcagagatatgcggctgaggtactgcattgctcgcagggcacggcttccacgaaattggctggaaagactcgcatgagttcgtcagatgtgttgaacagtgcgaaggcattcaatgtctccacggattatatttatggactttccgatagtcccgagcctggatgtcaagaaggggtgacggcatgagcgagagagtgttgtggcttcggttgtgcgtgaccggaccgactcccgagtgcggggagattgtcggattgcgcatcgtcgacaggcaggcgcatcgcacggtgttcgacgcgttcttccaccccgtcagggaagacggctggaagagcgtgccggcaggaggggtgaacgtgaacctagcgaaccgtctgccgttgaacatctacgtggatgggatcgaacggatcctatccggtgcgacgctgctgcgcggcgagcacgtggcacgcgacatccgtttcctgcgcgccgccggcgtccgtatcgaggaccaggtcgtggcgcgtagcgtcacggccgaacatcataagagacttgcgtcggggattgccgtccccacgcgcaccgggaaccaggcttgccggcccatcccggtgggatgaacaaaccatcccttacccgaaacaaacccatccaccacccatctgcagcgaaaagagagaaccaggaatgccaaccctacaagcgcgtgcggcccacggcggccacagcggatcgacgcccctcggcgaccgcggaagcgacgtcgtgaacgaacccatacgcgtcgtcacaggtcgcggcggcgagcacgatgccggacgagagcccggcatcgaacagctcgccgtccgtgatccccgtggacagcatccaacgcagcccatccatgacggcgggatccacgacattacggaacagaccatcggcgacggccatgcgataggccagccaggccagacgcgcccgccgcgcgagcaccgtttcgtcacgggccagcgcctcgtaccgaatcgcggctcggaccgtcacgatcggggagacatggagacgcaggggcatcgatgcgccctgcaggaacccggatatccggtccaccgtcatgagacggcggcggaggacgagggagaagcccgcatccgtgttgtcttccatcatgcccgccgatcgattgtgcttggagacgatatccgttccatccatccacgcgtcccacaggtgatatcggctgcgcgggccggcccgtgaaaaagaaaatgcccgcacacgaattgccgttcgcgtgcgggcgatggtcccatcctttacccatttgcattgccccttaccggacgaatccggctcgggcgaaggaaccagcagaagccaaccccaccaatcatcacatcagaaggagccggcaagaccgaccccgaccaatcgtcggaccagaagaccaatcgtcggaccagaaggagccaatcatgaccaattcttacatcaaccccacccagccgaccaccggcgaaccccgatattcacaggatgcccccgcatggcaggacgtggagatcgtcgacgtgcccgccgtggaggagccggactcggccgagggcgcgcccgagccgatccgcatcatagacgagccggaaccgggggaggccacggcaggcgacgcggtcatcgaatacacgcgcgaccacctgcccgtcaacatgggcgtcgacacgaaccacagcgatttcacgcgcgaacaggccgaacagctcgtcggcgacatccaggaacagctctacgagaccgcgaaaagccagaaacgccttcacgacctgatcgcccaggcatacgacgggcgcgcgtggatcgccctcggataccccgcgggactgatcggctggaaccagctatgccaggacaggttcaccgccgacgccgtacgcatgaccgtccagcaacgcaccaacctcatcctcagcttccaggacgacccgatcagcaacaggtccctcgcggccgcgctcggagtcagcgagggcacggtcaggaaggccgtcaaaaaggcgaagggcgccgccgcgaagccgaagccggtcgtgggcgcggatggcaaacgatacagcgtgccggagctcacgccggcggaacgcctcgaactcgacgcgaagatccatgacatgaacctgcccgtcgaggagggcggccagggcatgacccagcaggagatcgccgcgaagctcgacatggcgcaatccacgatctgcgcgagcatcaaacgcgagaccatgcggcgcatgagcgagggactcgaacccgcggcccccgcaccggtcgacgagaccggcgcgatcggcgtgctgcccgacgatactgcaatcgacctgggcggcgaccggctcgccgcggacgacatgaacttcgtggaagcgttccgcaccgccgcgggagacgcgaacgccggactggcccgcctcgtggagctgatgagctccgaacgctggcagccaggcagcgagatcgtcgacgagatcgtcacccgcgccggccgtgacatcaagggcgtgctggccaacgtgggcccgttcatgcgcctcgtcgaccacgacctcgaggacatgtggcccgccgacgagaacgaccgcagccgcgaccaggacgaggtcaacggactgttcgaccagatcctgaccgtcgcgtcggaatgcgcctgacccgttagcagagaaggccggccatgagggccggccggagaggaaccggtatgaacgacaagaaaaccaaggaagtggacgggcgggagagcgtgagcatgctgcccggcgtgacggtgggcgtgatgatcgcggtcatcgcgttcgtgctgagcttcgacgcgttgaggctcgtgttcgtgtccagcggcatcaacccgctcctgtcatggggaggccccctgtgcgtggacggcacgatcctcctgtgcacgtgggcgacatggggattccgcaaaggccacatccgcggacgctggtacccgtgggccggactcgtgctgttcagcctgttcagcgtgacgggcaacgcgttgcacgcatggctcaacgccggcggcatgctccccacgtggggtgcgcccgcaatcatgagcatcccgcccatcgccctgctctactcgacgcatctgatcgtgatcatcgccggcgaccgccaggacaaactcgccaggatcaccggcaaggccgccggccccgatgacgggcacgccggacccgccgcagccacgccggaaacggccggcacggaaccggtccggacggaaaacccgcgggccatccccacgccgacggccggaccggagccgggcaaagccacggaacccgcgcccgccgacccgctggaccgctacctgttcgacccgccggcccaagcggaaaccgacgcgaatcggggaaagaaggaggatccggaggacatcccgttcgaccaggacctctcatggccctccgtgacgtccacgaccacgacgtccgcaaggcccacggagtccacaatccacatggtccgcatggaccaggcccatgcggaccaggaccttgcggaccaggaccgcatgggccggaaacccgagatggatcccaagggccagccgggcccggaggcagggggtcatgcgggccacgccgaacctgagcccgcggaatcccacgaaggggccatgtccggcccggaccgttcctccgacacgggatcggcccacgatgccggcccaaaagccggtgagccggcgcgcaaggcgacggccggcttcgaccccgacgaatggctcgcatgggccgacaagctgaaagccaacggcgagacggtcacctcgacccgggccgtggccgacggtctcgccccatccaccaccacggccaaacgacgcctgcacacgctgcgccgcgagcatcccggaaggttctgaccatgagggaaagcgatgaaccgttgacggacacattggtccgctgcctcgccgaccccacggacctgaaagccctcgaacggctcgagaacgacggggaccaagccggggccaggctcatgcgcgcccgcctcgccgaccaggccgcactccggctcgacgccgcgctggaggacaaccgggcgcgcgtgcgccggcagctgggccgcgactgggcatgggccacggacgaggtcatgagcgacctgacgatacgcaccatccgccgactcgactactggcaccgcaccaacacggaccgggccgagggaggggcgacgagcctggccgcgttcgtcaaccagctcaccggcaccgtggtcggcgaatggttcaaaacccaacggcccaaacaccgcacgggcatgacccagaccccggaacggcgcgcgggaaggctgaaaccacccacggacccggacgaccggacggcgtgggaacggtggcgccggcacgagcagaccctcgccgactccgacgtgatctgcgacgcatccgacatcttcgagggacgcgacggcgacggcgagagccccggatcgcccgccgcgggcgaccgggaaagctaccggcaatgggacggcgacacggcggacgccccattgccggtcagcgccggatacaagacggacatggaggccctcgccctcgcggtccaggccgaatggggactcgccgcatggaaacggatcctgacccgatgcatgacctcgaaccgcgcccgtcccctgctcagggagatccgccactggcttgaagcccaccacaacgggaccaccccgagactggaccgctacccctacctcagggcatgcgccggcacaggcgcccgtaatcggccgaaaaccggcgatggacgagtgaaagaacaaacgaaaggacaacgggaagccggacgacgaggcccgcgaaccatagaggaacgaaaggaacgaccatgaccacgatgatgacggccccggcaggggccgaacccgacgccgtcaccctgcagatccccgcgatccccatgacatgggaacaggcgtcgatcatgctcgacgcgacgttcgacgcatggaggatgctctccggcgagatcgacgccgcccgcggcgacgactggcaatggatccaggagatcctcgccctgcccgcgcacacccggtacatcaaggccgcgggcgacgaggccatggtgtgctccgccgcgatgcgcgagacatggcccggcagatggcatgatctgctgcgcgcacgcgtgcaggacgtcatcgacgcgctcgtctcccacgaacgggaggtccgcgccatggaccccggcatgttcgcgcgcatgccctcgcccgccctgtgcgacagggtgcggaaacgccacgacccgacccggacgacattgagcatgacggtgtaagagctcgcccgatgaggcgacaggaaaggaacggaagacgatgcggatcatcatcgacggacacggcaggatcgaccggcaggccatggccgtggaacgcctcaagaccatcgacatgacgccggccgggggcggggacgcccaggactgggtaggcgcatggctcgacgggttcgaccaggcattggacctgtgccgcgccctcgaaaccgccctcgacgccgacacggggaaggagctgtccggcgatgcgcgatgacggacacgaggacaggaacgaggaagccatgggccgcgccgccgcatcggcgggagccaggtacggaagcctggaacccaccagcaaggcgttcgacaggctcatgcaggaacacaagaaggaacgcgaaacggaaggagcgagaccatgagctggcaatgcacgtcatgggcgctcagggaggcgcccgcacccacggccacggccagactcgtgctcatcgccctggccgaccgctgccagcccgacggacgcagcgcatggcccaccgtggacaccctgatgctcgaggcgcacacgagcgaatcaagcgtcaaacgtgccctgaaggcgctcgaggagacgggatgcatccgccggggcaaccagaagctcgcccaatgggacgagcacggcaactacgtgcccgacccgtaccggtccgtcgtctgggaatgctgcatgaacgtgaccctcgagcacgtgtccgagaaacccggacgacaggccagggcggaacgcgccgaacggctcgaaagcgtcgacgcgacggacggggcaaaaggcgccggttttaggggtgtcaaaatgacacccctggaaaacggcggaaacaagccaaaacacagaggtgtcaaaatgacacccctggacgatgacggccaggccaggggtgtcactggtgacacctccagaggtgtcaccagtgacacccctattgtaagaacaaatacttctaaacaaatatcccctttgcctcctacggaggcatctccccggaccggggagagccgcgacgggaaaaaccaaaccgcccacatcatcgaagccgcatccgcgccggacgaggcgaaccgccctatgggtgagcccgacgacgaacgctggcaagacgccggccccgaaccggaagagcgggtccccgccgggatacgcgccagatggatcctcgaccggctcgaaaaccgccgagccgccatgggcctgaccccgaaaccggcaggccggcgggacaccgacgccgtcactcggctcgtcgaacggctcgacgccgccggcgaacccgacacgagcgggctcatggaacgggtcctcgaccacgcgctcgacaacgggttccaggccaaacgcgtcgacacgggacgccgcttcgcccgcctgttcgacgaactgcgcgacgacctgacctgcgaccagcgaaccctcgaacgccgacgcagggagcatgccgacgccagccaacccaccggaagcgacacaggggagagccggccggcggaaccggaatcctacgagacccgggcgcgccgcatgctcgccgaccgcatcggcgccgacatcgacgcgtccaccgccatccgcgccctcgccgacaggctgcgcctcgaccccgacccggacccaggccaagccgcacgctacgccgagctcgcgctccgcgccggccgcaaaacccgggccgaacaagcccgccgggagagcgaacgatcgagggaactccacgactaccgcgcctcgcacggcggcagctgcttcgccggcaactggcaactggagcaggcagaatgacgggctcaaccaagacacccgaacacgcggactcgtgcccaatccatgagtccatgcatggccgctcgccaggggaaggacgagaaatgaattatcaggaagacaagaacgccgaagcgccaggcatggggcctgatggaatggcatcagtccatgacgtcggcgcgtacgcccctcaaacggctggtcgtggcgatccaattcccgtcaccgtcgcgggtctcccacttgacggcgaagtattcctcaccggatactccaggagaggaagcgacggaagggcattgtcccgccctgacggacatcccgccaggtttggctgtatttcgtcaagtcggtgtttcgtgtttagtcatgtatttttttcgggtttagccgacagggtgtgggagagtagcacgccgccgcaccacacgtacaggaagccccttggagcacacgccccaaggggctttcgcatacccgaaacactcacgacccaaacccacacacccccacaaaaacacccggggcttctcgcactcatgagacccacgtccgggaccattcccggccggccccgccgtcggggccgaagagagacggcgcggcgcgttcccatttccgcaggaaatccggaaaacagcacgtccgtgaccgtggaatcccgacgcccgggcctcctccccccggtctgctgtgcggacggctccccccccctgaggggagccagaaactggcttggttatggggtcgctctacactggcttctgctatgcattacttcacccctaaacgttgcgctacgtcgaataaaatcatgtatcacgataaggcgcaggttcagcgtgccgctgatcaaagcctaatcgagcgcggagttgagctatgggtgtaccgttgcgaattttgcggatgctggcatctcacgcatcgcgatccgcaatccagttaccggcatgtaccgctgaaccagcaactcaagccacacagtcgtaaaaagggctacaagccacgtagacgttagcgtcagaagctccacaggcctcgccaacgccgtgtctgagacaggttacggtccaaacacgtcaggtcgtaggctgctaagcgttcagggcgctcggacacacttcgtccaacacttacatcaccttggtgttttcaaggttgcggataacccaatcgttgaagcgaattaccggcttgcgcaacataagtcccaacagcaatgaggggacaaggaacagtgccagtttgcccatggaaacccagtattccatgccgaatgagcctgccatggccgaatgcatcgcatccaccgcataggggaacagtagccatttagaaacgacctggaagaacgtcggcagtgtttcaatggggaatgtgccgccggaaccggctacctgcataaccagcagtactacggcaatggctttgccgatatcaccgaacgacagggtcagcgtatacacaatattcgagaacaccagtgcagacaaccacccgaccatcaagaactgaatcggatgctcacactgcacgccgagatagaacatatcgcccaggcacaccagcgtaccttgcagcaaagcaaggaaaccgaaaatcatgtatcggccgaaatattcgtggtgcaagcgtaaaccgaactgccgcgcattgccgggagcctcggcacgcggcttcttcagcacatccaacgcggcggccggtccggcaatccgcccggcaatcatggcctcgcgaagacccacttccgaaccgagcggcagatcattgcccaaccctaagatacgagccttctcatggtcggaaatcgatactttcaacatggcgaccagaatgatcgcaccgacccaaatagacaaaatcgtgtagaacggagccatcgcggaaccatagttggcaacgggatagagcgcgatgcggtcgaccgctacgggtgccgccagcatggaagcaatggcatcgggcttcgcagaggaaatcacagacaggtcgatggtgccgccattggtgatagaggcgagttgggaagacaagttgtcgagtttcttcgccgaacgggtcaaagcgctagctgcgtcagttaaggccgactggatgtccgtcaggctgtctgaaacgccgccagaaagacctgacacgctgcttacggtcgatgcaagcccgtcgattacggaacttgcctgcgtggtcacttcgtccatggacgaggtcagattgttcagttgcggtttcagcgtgctcttgtacgtgtctgaagcctgagtaatcgattgtttggcggcagcgatttgtgatttcagatctcgacgcgctgtatcggcatcggcagtaccgtttgctatgtgcgtggccgcatcgcccaacgcggtggcggcttgctgcatgctctgctgcgcctttgtggcttggtctgcagccgcgttcagttgagcggcaacggtatctccgcccacgggcagtgaagccgcttgtttggcgagatctcgtaaagcggcggcatactttccaaagctgtcggcctgagcctccactttggattgcatatcggttagtttgtttgatatctgtgaggattgtgagcccacatcggcaaaagcggcatcgatttgcttggcaatggtgtcgtaggatgaaccggcctgctgcaatgccgtaccgacgccatcggtggctccggacaatgccttgtcgaggctggagacgccgttgcgggtctgtttcaacgcctttttggttgtggccgcagctgagcctgttgaccccagcagcttatcggtggaatcaatgatgctgttggcggccccgagcagattggcataggaatccatctgcgacgcagtgccggtcaaacgagacgacatggtggcaatatgactggtggcgttgttgacgtactgctccatttgcgggctttgcgcgtaatcggccacgttggaaaccaaatccagcgccacgctcgccaaggtcttcacgaatgtctggtcgatggtcgtggccacggtggtagcaccctggtcggtgatatgcggagcgatcggattgattttctcattgagatagtattcgagcttggcgtgcttgatcttcggtgaaaacagcgtcatcatatcggagctgaagctctttggaataatcagcgcggcatagtattcgcctgagttcacgccatcgatggccttagcacgatccacaaactgccagtcaaggtcatgattggccctgagcgtattggtcacggtttcgccgacgttgatggtgatcggcatcagatcggacttatagcccttatccacgttcgccacagcgaccttcaaggccttggtgttgccgtacgggtcccagctggcggcgatgttgtaccaggcgtacagtgccggcacaatcgccaatcccatagccacgattacggcgatcacattgcgggtggcttggcgcacgtcacgtacgaatattttccagataagcttcatcgtgcgcctccctgcccaggctgcccggactgaccggactgtgcggtgtgcgcagtcggctcggtggcctgatcactgaacggtgtgagtcgttcagtggtttcgccgatattcggattgctgtccatcgccgcttcgtgacgtccgtggccgtggaaacgccgccacacatatccgttgagcatcacattgcggaactcgtcggcactcatggcgctgacgccaagctgcatggcgtaggcttcgcgtgcgtattcaaccacaatgagataggcgtcgataagaataatcgacagaatccaagaggtcagcatggcgattttctcttgggtgacgaacagcagcaccaggaatacgaacgggagtacggtcagcaatgccagaccggcaacgatcatctttggataccgtgcgaagaaccggtgcgcgcgatgggcgatgatatcgcgcagttccttgctgtcggacaccgtgcggaatacggagttcaagctcacctgttcgttcaccatgctgttgtgctcggtgatcatcaggtcggtatctcccaaacgacggtcgaacagcgcgttcaggttcatcgcataccggcgtatgacaagtcccacgaagagtgccgccggcagataccagaacaggtgcagcatgtcgagccagtaatggttcgcgtacaggccggcaatcgggccgcgcatcgcgttgatgccgtaggtaaagggcagccacgggtgcagttcgcggaagaagttcggcatcatttcaatcggatacaggccggaggcgccgggtatctgcacaatgaccagaattacggcgatggctttgccgatatggcggaacgccacggccagtgcgtaaataatgttgatgtatacgaacgaacagaagatcccggccaagatgaacagcagcggatgctcgcattggatgccaagcaccagatcgccgatggtggcgatgacggcttgcaggaatccgatggtgaccagcagcagccagcggccaagatatgcttgcgtagcggtgatacggcgaatgccctcgcggtcgacctcaagcttgtagatggcgattagcacgaaaccgcctacccacagtgccagattcgtgtagaacggggtgactgcggacccgtaattgtcggtggcatacacgactttcgtggtcagggtgacgggattgcccatgaagtcgccgaatcccttgtcatccagatgcagcgtatcccggattatctggtaagcggcggaactatcgagcgtggcgatatcggtgcgtacggtggcgacatcgctggccacctggcgcagcgaatcctgcgtgctgctgatggtggtttttgtttggttcagggtatcgacaagctggtcgaacagcccgtcggcctgatccaaggtgccggacaacgaagtcaacgtgccatccagcgtgccgttcagggcggcgaaactgttcaatgatgaggtgagcgacggcatcacggtgccggtcagcgagccgcgcgcggtattcagcgccgcgatgccgccggtggtggtgttggtcatggctccggaaaggttcgtggtggcgtctttgccggagttgatgaactgtgtggtgtcggtatggaaggtgttgagctgtgtctgctgtttgctgatcaatgagtcgagcgcatcgatttgtttccagatgttctggccgaccgggtcggtggtgtctttgccgatgccggctttggtcagcgcgtctttcagatcgctgattgacgtttgggtggcgttcagtggggccgaaagtgtgttggtgatggtgtcgacggagttctgcgcgctgttgaaggaaccggtgatgctgccggcggcgttgttgacgtggacggccagtccggagagttgtgctgaactgctgtcgagcgcgccgaccagtgtggtggagaaggcttgtgacccggcctgtgtttccgccaacagtatgccggactggcgggaggcattctgcgcggccgcgacggtctgcttgagtgaggcggtggtctgtttggcgtcggcgagaatcgtgtctgattgggccagcgtgtcctgtaagtcggtgagtgaatcctgaacggtgttcagcgtggacatcaccgtattgagatcatcgatcgtatcgtgctggactttgccggtgacttggtcgagatcgtctcccgcttcggaaacggccgaggcaacggtggcggctaccgtggtgacgaaggcggagttgatctgctcatcgatggtggtggcgccggtgtcggtgattttcggcgcgatcgcgttcttcttctcgttgacgtaatacttgattttcggctgtttggaggttccggtcaccgattcgaccaagctggcgctgaaatccttgggcagcacgatggctgcatagtatccgccggtctccacgccgtggacggcctgttcctcattgtctacgaagcgccagccgagttcgtcgttctgcttgagtttcttgacgacctgccggcccgcatcgagatggccgaccagatcgttggtggtgccttggtcttcattggctacggccacttgcagattgccggtggctgaatagggatcccagttggcgagaatgttgaaccatgcgtacagcgagggcagcattgctacgccgagcgtcaccacaacggcaacgggattgcgtaagatacgtctgcaatcgcgtagaaagacttgccaaactgtccgcatccagtccctcttttccggttcgtagtcattgcggccacatgcagtctattcccaccactggtgcgaatactgctggtttggcgggttttcttgcaaaactggccgttggttgtccgcataatgggactgatatgtgaacgtttgttgatggtgcggcaccggcgggatggttgtgcaattttgccggtatccggtgatgaaatgttgaggtgttggaactgagtcgtcgcagtgctgagaccgagacgactcagtgacgagcctatccgaggctatctcgttggttctggtctcactgatccagacggaagccctgagcggcggccttgtcgagcagtgtctgatggctgacatcctgccgactgatcgtggcgacctgatcgctgaaagcgtccaccggacggtcggcttggcgcagatcgtagtaccggtgaacttcctcgtcgaaggcgggcagctggtcgagtacgccatcggcgtcagccgggtaggtgttctcgaagaactgcatcgtgcgcggcatgcgcggcttgacggtcgggttctgatcgggcttgccgatggccagacccagcaccggatacgtgtattccggcagattcagcacgtcgataaggccggggatgttgttgagcagagagccgagaatcacgcagcccagtcccagcgaataggcggcggtctccatggcgtgcagggccagcactgcgtcgttctgagcttgggtgaagcgatagctgtacttgagatggaattcgtcggaagcgggatcgatacccttgcgttcggcgatgcgtgcgttgcggtgctcgtcgatgacgaacacgtacagcaacggcgcggtggcgatatacggctgatggccgaattcggcgagcttggctttggtggccgggtcggtgatacggatggcggaccagtcgttaaggaactggctggacgcggcatgttgggcgacggtttcgagcgtggcgcgggtatcgtcgtcgatggcctcgtccttgaacttacggatggagcggcggcccagaagagcctcgattgttgcgttggtaaccatggctttattgtcgcacggcagacgccggacgtcacggtggattacctcacagtgaaatgccgatattgtgtggcggaactgtgctggactgatggttcctgtcgattgactgatggttccttgacgaaattccagcgatgagtcatcagtcagccaacagaaaccatcatccaaccgggggattagcggctgggcttgcgatggcggtggtcgacgaacgccttggagccccgatccgacagctgcgaaaccactgcgccgagtgcggccgaaacggcggcgaatgccagactcattgccagactttgcggcgcgtctgccgccagtcccttgcgcagattgcgtttgcttgtgcccttgtcccatatcatctggaatgctttgccggcaaccaagcctgccagcgctgggactgccgacttgatgagcttgtcgcccagagaatcagggtcgttgagccggtcctcgcgcagcctgttgaccttctcgtcgatgcggtgcaggctgtcgaccgcgcggtcggcgctggaggggaagtcggtgttcgtttcgtcgctcatgactctcagtctaatagcatctcaatcatctcagcgcaaaagatgggcgttaatggtggagtcatgaacgagcgcagactagagtggaggcatgagcgaacagaacgtgaacggcaccgttgccgtcgagaactctcgtggcggcaacggatttttggtgttgctgcgccacggccagaccgtgtggagcgaatccgggcagcataccgggcgcacggacatcccgttgaccgcggtcggcgagcagcaggcagcggatgccggaaggcgcctgcgcgaggccttccccgaaggattcagccagagctgtgtgttttccagtccgctgaagcgggcgtgccaaaccgctgaactggccggttttgcggaccacggtgtgttggacggcatcgctgaatgggattacggccgagccgaggggcgtacgcgccagcaggtgagtgaggccagcggttttgaatgggatgtgtggcgtgacgggccgcgctcgctgacgcccacgctggagggcgactgggtcgagaccttaccttcgggcgagcaggtgccggtccatgccgggcctggcgagacgctggaagaagcagcggtacgcgccaagagcgccatcgacgagattacgccgctgctgaaagacggccataatgtgctgttggtggctcatgcgcacatcctgcgcatcctcacctcgcaatggctgggcgtggacccgcatttcgcacggttgctgcgtttggatacggcgcactactcggtgctcagcgtctataagggagataacgtcatcgaacggtggaacgcctagccccggttgcgctgcgattgcgctggcctgcccgctactgcgggcgggcctttattgtttgtggcgggaattgcggtatgtcgataaatgatttgcaaacgatagcgtcggcgtgttgttttttttgatgggtataagtggcaatcgattgccatgaaagatatgttagcgctctcatgattgcgaacgcttgcattgcgataatgaggcaaaaatgactgaattaatgggatatttgttgacaatggcctgaaaatgatgatttatgacgcgctgatattgctatcgtttgcaaaaagaagcaaaccgttgcacaatagtgcatgtcgatagtcgtaaaggtgcgtgctagcgtacctgtcctgaccggggacggccgggtcgacgatgaaagagaaaggttcgatgatgaatcgtacagtcaagtcagcagtcgcgatggcggccatcgctgcaatgtccctcggaacccttgccgcttgtggaagctccacttccggcgacgactccaagggcaaggtctactacctgaatttcaagccggaagcggctgatcagtggaccgctctggccaaggaatacaccaaggaaaagggcgttgaggtcaaggtgcagaccgcggcctccggtacctacgagcagaccctgaagtccgaaatcgccaaaaccgaagccccgaccttgttccaggtcaacggcccggtcggctaccagaactggaagaagtacaccgccgatatgtccaatacggatgtgtacaaggagctcgccaaccaggacgtggccctgaaagacggcgacaaggtggtcggtgtgccgtacgtgatggaaacctacggcctgatctacaacaaggacatccttaacaaatacttcgcgctggatggtgccaaagccacgtccatggacgaaatcgacaacttcgacaccctgaaggccgtggccgacgacatgcaggcccgcaaggacgagctcggcatcaagggcgcgttcacctccgccggcttcgactccagctccgactggcgcttcaagacccacctggccaatctgccgctttactacgagttcaaggatgacaacgtcaccgagcagccggccaagatcaagggcacctacctgccgaactacaagaagatcttcgacctgtacatcaccgactccaccaccgaccccacccagctgagcgccaagaccggagatgatgcgaactccgagttcgcgctcggcgaggccgccttctaccagaacggtacctgggcctggaccgacctgcagaaggccggcatgaaggccgaatccgtgggcatgatgccaatctacaccggtgtcaagggtgaagagaagcagggcttggccactggttccgagaactactggtgcatcaacgacaaggcctccgacgccgacaagaaggccaccgaggacttcctgtcttgggtgatcacctccgacaccggcaagaaggccatctctcaggacatgggcttcaccaccccgttcaagaccttcgatgatgtcaagtttgacaacccgctgactgaagccgctgttgaggatcagaagtccggcaagacccaggtttcttggaacttcaccatgatgccgtccgaagagtggaagaacaaggtcggccaggcactgctcgagtacgcgcagggcaccggcaagtgggatgccgtcaagaccgccttcgtggacggttgggcttccgaatacgaggcttcgcactgagtctcatagagtcccatagccgataagcaacaatccgcggcgcccctgccatttccttctccgggggcgccgctttgtattgctgagtctcgcacaaaatcgtccgccgcagaaaagtgtgaggcacgcacccgctcaatcgcacgctgtggggccatgaatcggcgatttttcgccattctccacaatgtgcgattgagcgttattgtgcggttgcctcacactttttctatggtgggctttgttgtgtgagcctacttaacgcgggaggtggaggagcggaccttcagctgggccgggaacacgatgtagggttgctcaatcggcttttcgtcaatgagatcgagcgtcatgcgggctgccacgcgggccatttccaccggatcctggcggatggtggtcaggccgatatcgccggtgtagaaactatcgtcgtagccgatcaacgagacgtcgccgggcacggagaatccattgcgctccagctggaacataagcggcaaagcaatgccatcctcttggcatgcgatggcggtgggcatctcgtcttggcttatgagttggttgaccacgtcgctgatttcataacgtccatcgtcatcgaccttgcagacgataacctgcggctcgatgccttccctgcggcagcaggcggtgaatgagtcgaatcggctttgcacggagaagctcagcgacacctcgcgattggtgctgatgtaggtgatgcggcgatgtccgagattgataagatggcgggcggccagcgtggagccctgcacatcgtcgatattgacggcggcggtaaagccgcgggcttcgggttcgactgaattgatgccgacgatcggcacgccgaccgaagccagttgcgcgatttcgttgttgtcgatatcgaaagacgccacaatcacggcatcggcgttacggcgtaccggcaacatctcgaagaattccttgcgctcctcgatgctggaaatctggaataccgaaatatcgtagccctgcgtgtgcagcacctcgttgagcccctcgatgaccgaggcggtgaaccacaggcggatatggccgctcatcagtactgcgatgcgcagggagcggccggatttcagggccgcagccgagcgggagagtgagaaattgagtttgtcggcgatggcgagcacgcgctcgcgggtcttggccgacaccagatccggcctggtgaaggaacgtgagacggtggagatggagacgccggcctcgcgggcgacatcctgaatgctcgtagccattgcagcccccttgcgttgaatggaaaatcgcaatacacatgcacaactgactccagtgtacatgctgattgattgatctgcggcgatgacaacgattgtattacaaacgtttgcaaagtgtctatgttggcgttagattggctttatatagccattatcttaggtgaaagaagattgctggagccggagtgtgctcgaacttgaaacgcctaaaatgacaacgtttgacatataatgattcgacgtttactatgaacataggcttgaacgagaacaggccgtgcatgcggttctcgatcggcaagctcgcattgagttgaactccgcagccggcgcacgatgcagtgtcacaacgcagcggactcaaggaggaggaaaagtcatgatcagcatggctggcaaggcgatacgcagatggtgggcgctgttcgcgctccccacattcgccgcattcatcatcgggttcctggtgcccttcatcatgggcgtctacttaagcttctgcgaattcaccaccgttaccgacggtgaatgggtggggcttaagaactatggcaaagcgttgaaagacaaggaattcctgcacgcgctcggcttctccaccgcgttcaccatcgtgaccaccatcgtgatcaacgtgatcgccttcgccatcgcctacatgctgaccaaggcgatcaagggctccacgctgttccgctcggtattcttcatgccgaaccttatcggcggcatcatcctgggctacatctggctgctgctcctgaacggcgtactagcccactggggccgcgccctgacctataaggcgtcctacgggttctggggcttggtcatcctggtgtgctggcagcagatcggctacatgatgatcatctacatcgccggcctgcaagccctgcccaccgatgtgctggaggccgcggccgtggacggcgccaacggacggcagaccatgttccgcatcatcatcccgctgatgatgccgtccatcaccgtgtgctccttcctgaccgtgaccaacggtttcaagctctacgatcagaacctcgcattgaccaacggtgcgccgagcaacatgtctgaaggtctggcgctgaacatcacccgcaccttctacggccgtatgggctgggaaggcgtcggccaggcgaaggccgtgctgttcttcatcctggtcgcggtcatcgccctgattcagaacaagctcaccacgagcaaggaggtggcagcctgatgaacgagaacaagcctgtgaagcatggcgcattatggaccgtgctgtttgccgttgtctccctgttctggattttcccgatcgtcctggtgctgatcaactccttcaagcagaaggcgtacatctccaagaacgcgttctccctgcctgccggcaaggcgttcgtgggacttgagaactatgtgcgcggcatcgagaccacgcagttcttcgcctccttcggctggacgttgcttatcaccgtcggctcggtggcgctgattctggtgtgcacctcgatgtgcgcatggtggatcgtgcgcgtgaacaactgggccgcgaagctgctctacaccctgttcctgttcaatatgatcgtgccgttccagatggtgatgttcaccctctccaagatcgccgacatgctgaagctcaataccccgtggggcctgtgcatcgtgtacctcggtttcggtgccggtctggccgtgttcatcttcactggcgtgatcaagggcatcccgcaggagcttgaggagtccgccatgatcgacggcgcgtcagtgccgcgcatcttcttccagatcgtggtgccgattatgaagccgtcgatcgtctcggtggccatcctcgaagccatgtggatctggaacgactacctgctgccgtacctgacgctcgacctcggcaagtacaagaccgtctcggtcgccgtgcaatacctcaagggcggctacggttccgtggatatgggcgccatgatggcctgcctggtgctggccatcatccccatcatcgtcttctacttggtatgccagaagtatatagtctctggtgtcatggcgggcgcggtcaagggttgagcccgacaatttggctcccctccctgaggggagccaaaagctgtacaaggagtagttgatgaactggctggcaccggactcgaaattcatgcgcgcgtggagcaatcttgttgacggcgtatggatcaacattctgatgctggtcacttcgattccgatcatcaccatcggtgcggccctgactgccggccatgatgcttgccgccgctccatcgagggcgagggcaaaggcgtaacctccaactacttcaagtcattcaaaaccaacttcatcaaagccacactgctgtggctgccgttcttggtggcgctgattgcactggtctggtcatggatcgtcctgcagatcacgccgctgctcatcatcaaattcgcgctgaccatcctctggcttatcggtttcgaatgggtgttcgcgcttcaggcacgcttcgagaacaccgtggccggcaccttgaagaacgccttcatcttcggcatctcccacatcgcgatgaccgtggccctggtcatcgtggatgccgtgttcgtggcactgctggcggccagctggttccacatgcccggtggactgttcctgctggtgatccttggttacggcaccatgctgatgctccatatccccgtcgccgagcgtgtcttcaagccatatctcattgactaggcgggttctcacgaatatgcggcgatcttcgaggtctgagcgctctctgtccacgcaagcgcggtaaagataacaaattaataacagtttggggcggctggcggagcggggtgccgattgaggggtattagtgattggcttggaagggggcttttggcatacggggagtgttcgggctgggcggttgccccccgtaagtgcttatatacataaggaatctggcacactgagtctcagtgccgtaatggtatcatcgcaaataatgtttgcgttcacgtagaggcgaacgagacactcgacaagtgggtcgaggcaaaggacaaggagagatgcggtgaagcattggaagaagatggcagcatcgttgattgcaatatcaacgatggtggcagtagttccgacgacgtatgccatggaatcggaagattcccaaccacagacaaccgataccgcgacagtgcagactactaaggctgctgaaccgacgctgctcgccagctgggacttcacgggcaaaaacggcaccacgaacagcgcgattgccgattcgaccggcaagtacaacctgacgctgaaggacggcgccaagatcgaacagtacggtgaccgcagcaacaacgaggcgctctcactgcgcggcgatggccagtacgcccagatcgatgaccagctgttcaaggatgcgggcgactccttcactctggagttcgcgtccaagactcgtcacgacgacagcggcaagttcttctcgttcatcgtcggcaaggacggctcgaacgacgccaacaccaccgatcaggccaacgccaacaagtacctgatgttctacaacagcaagaccgccatcaagggcgttatctccaacaacaactggggtaacgaacagggatccaaggtcaccgtttccggcaacgacaacagctgggccgattacaagattgtcgtggacggcaccaaccttgccgtgttccgcaacaatgccctgatcattttcaaggccaacaccggcatcaagatgagcgatctcggcgcgaccaccgcctacatcggcaagtcgttctactccgtcgatgagtactggaatggtgcaatggatgacatcaaggtctacaggggcgctgacctgaccatgccgaccgccgttgcgatttccggcaccggtgtggtgaacaacaagctcaccctgattgagaaggactccaccaagctcaccgccaccgtcactccggacgacgccgtgagcaagaacgtcacctggtcctcctccgatgagtccgtggccaaggtcgccgcagacggtactgtaaccggcgtcaaggctggtactgccaccatcaccgccaccactgagctgggtggtgtgaaggccgaactgcccgtcaccgttgagccgatgaacgcccagaacgccgccgcagccgacctcgatgccgcgattgctgcgctgaaagttccggcggccgagaatctgccgctagtcgccaagggcaccaagaacggctcggcgattacgtggaagtcctcggacgagaagctcattacgtccactaacgagaagtacgaaaacaagaccactggtgccgatgacccgtatcgtggtgctggcatcatcaatcgtccggcctacggcgacggtgattccaagccggttacgctgaccgccaccgcttcctacaacggcggtgagaaggtcaccaagaccatcgaggtcactgtcaaggagaagacccgcatcgcgcctgacaccggctatgcggccgtcacttttgagagcgacagcaacggtggagaaaaggcctgggtggcttccactgagaagaacgatttcttcacgtttaagactcgcaacaatggccaggcggtacttaccaatgatgcagacacgggtggcttgcgtgacatgttcgtgctgcgttcccacgaaggcgacaagtactacctgattgccactgatctcaaggtctcgtcaatgggctggagccagaaccaggttaacggttctcggaaagttgaggtctacgagtccaccgatatgatgaactggacccgtaccaacggcgacggcaacggcggcatcaccatcaacacgccgaacgccggtatgacctgggcgccggaagcttactgggatgatgacctgaacgcttacgtggtgttcttctcttcccgcatgttcactgatgacacccgtaccactccggtcaagaacgacaaaaccggcaatagctcctatgctcaggtgcgttacgccatcacccgcgacttcgtgaacttcaccgagccgcagatgtggcaggacaccggctactcgcgcattgattccaccgtgcgtaagatcggtggctactactaccgattcaccaagaatgagcagggcggtgccgctggcgattacatcaccactggtaagagcatcttccttgagcgttccaaggtgctgactgcaccgaccaccgaggcatctccgggtcaggacccgaacaccggttggcagctgctcgagcaggcgttgctgccgttcgaaggaccagagaccatcaagctcaacaaggatgacgaactcaacacgaaggacgacgacggctacattctgctgtccgacaacttcgcctaccgtgcatttatgaccacgggtgccgagctttccaagaccacgtgggacaacccgatgaccaagcgttacccggacttcaacaacgaaaagaagccggtcaaagccgagccgggcgctcagggctacatcactcagggtgctaacggcggtctgccggacaaggtgcgtcacggtgcgttcgtgaacgtgcctgagtctgtgctcaaggtgacgaagtcctggaccgctgccaacccgacgcacatcgaggctgttgactccaccaccaaggccgagtacaacgccggcacccgcgagctcaccgccacggtgaccgccgccgataagggcacgctcgccggttcggtgaagttctctgctggcgactggtccaagaccgtgaagctcgacgccgaaggcaaggccactgtgaccctcccggccagcgtctctggcactgttgcggttgcttacgacggctacaccgatggtttggtcaatccatccgatactacggttgacggcattgaacagggcaaggtcgatttggttgagctcaacaagcagatcgccgctgccgaagcgctcaaggaatccgattacacggctgattcctgggctgcgctcgccaaggcactgcaggccgccaaggctgcgctcgcttcctccgaccaggctgtggttgacaaggccgccgctgatctgagcgccgccatcgcagcattgcagaaggcggaaacgcccaccaagccggataccggcgatggtggcaacaagggcgataacgcaggcgacaagaccgatgacaccaagtctgacggcaagttgccggccaccggtgccgccgtatatggcgtgagcggtgccatggtgctgctcgccgctgccggcattgcgttgtccatctggcgcaagcgccgcgcataactgagtagctgctcactgcaacgcacagaaaatcgcacagtatatatgtgattttctgtgcgttttaatgtataacagcacatgcgtcattttttattgtattggtgtggtcatgctaaatgtatgtgctgtagagcctgtgtaccgtaccagtgaacgctaacactaaacttataagtgcttgcatttgggcgtgctatagcgcatcggtgttgtccccggaaaacggcgttgttcgtaggggcggattggtgggcaagtgcagtcaaatgtaatgcgaatcggcaaacgaggaagtgctgattcgtacaaggagacgcaaaagtggccgataaaggagcggccaagcgccatagcgataacaatttgataacaatctagcaaggatgcgaggaaggaaactcggtgaggagagttactcgattggcggcctgcttggctgcggtatcaacgctgagcgtgggactggttacgccggtcaccgcgttggctgacgatacgacacctcaggtgcagcaatccgttcagacgagcgatgctcaggctgctgcggctgtagacccgcttgccggcttcgatttcaatagcgacccggacgatggtgcattcgccagtgctcagggtaacgctaaggccaccgtgcaaggcacggtggatctcgtcaacggaaaagatgacgacaacggcaaggccgcccagctcggcagcggtttctggctgaacgtgaccaagtccgatggcagtgcactgctcaacggtcttgatgatgtgacgatcagctacgacagcaaggcggctgcgaccggtggccagtggactgtgtttgccgcgccgaccgccggtgcggtgaacggcagcgcccccacctacgtcggtgtgctcgaccgcaccgacaagacccgcgtggaacgctatctcaacggccgcgcatccgacatcgccaccatcgacaagaacaccggtacgaaggatgcttggaagcatgtcgatctcgtcatctccggcaagaccgcgaagctctatgtcgataagaagttcgtggcgagcaacgtgaacggcgaggatcttaagagtattcttggcggctcaggtggtgtgctgcaaatcggcaaaggcaactggggcaacggtgaatacttcaccggtttgctcgacaatctcacgatttatggctccgcgctttccgcagccgatctcggcatcgcatcgcctactgcaatcgagatttccggttccaatgtgaaggacggcaagctgagtctcaaggaaggcaactccgcatccctgtccgcaaccgtcacccctgaaggtgccgatcccacagtgacgtgggaatccaacaatcctgctgtggctactgtggatgccaacggcaaggtcaccggcgtgaaggccggcaccgccaccattacagcggcttccgaagctgacgccgccaagaccgccgagctcaaggtcaccgtcaccgaggtcaaggccgatgacgcctacggctacgtgatggtccacttcatcgaaaacaacaagggctacgccgagaagatctacctcgacatctcacgcggtgatgacgccacccagtgggacacgctcaacggcggcgagccgattctggtgagcaacgaatccaccaccggcgtgcgcgatccgttcatcgcctacaaccccgagtcgaagacctactacgtgctggccaccgatttgcgtgtgttcggcgcggacaacgccgagtgggccgcatggaccactgattacagcaccaagctgcatgtgtggtcgtccaaggatctcattcacttcagcgacatgaacgagcttgagaccgccaccgcagacacgtacaccgccaatccgaccaagagccagacgctcaccgattccgtgaccggcaagaccgtatccggcatcggcatggcgtgggctcccgaggctacgtgggtgccggacttctacgatctcaacgacgacggtgaactcaacggttccgacaagggcaatcctgagaaccagcagggcggtgcatttgtgctgtactggtctgtacaggccaagtatgatggcggcgaccgtgccgaagcctgcaagcatgtgttgtgggcggccaccaaggacttcaccaacgagacttacatgtttggcggcgtcttcgtgcctaacagcaagtacaaccgtggcaacaccatcgacaccacgatgctgcagaacggttcccgcacataccgcaccaccggttccggcgtgatcttcatggaatacaccgatcgtgccgattggtggcgtgccaacgaccagggccagtacgcgaccgacccggccaagggctgggtgttgcgccagaccaacatcggacacacgctcggcagcgcgcaggaaggtgccaacggtttcaaggtcaacggcgaaaacaagtggtacatgttcgtcgacaactatggatctgtcgcctccggtgcccgctacggctacaacctactcgaagccgacaacctcgattccgagaatccgtggagcgtcctgaaggccgacgattacttcctcaccgccaacaccaagcacggtggcgtggtctcgctcaccaaggcccagtacgacgcgatccgcgcggctgacgccaaggcttccgacaacgccgacctgaaggccgaggatgtgacggtggataagggtgctgccgatacggacatcactgccaagctgccgaagacgcagcaggtcactcttgccaacggttacggcactgccaagcgcgacgtgacgtgggacgtttccaacgtcgacacctccaagcccggcgaatacaccgtcaccggcacggtcgacaccatcggtgccaacgagaaccattggaagtggacgaacgccgccggcgagtcgaagaccgacgaggacgacctcatcaacaccggtgcgaacgcgaacaacaactggaagcagaccggtggctttgtggacaacgaaaccgccaacaagaaccgcacgctatacagctccaccgccatcaccgtgaccgccaaggtgaccgtgaccggcgaaaccgagccgaccgacccggatctgctcgccgacttcaccttcgagaacgccggcgagaccttcgacggcggcaatgcgacgggcaccacgcagggcaccgccacgctcgccgacggcaaggacggcaaggccgcgaagctcagcaagaacttctggctcaacgtcaccgccaagaacggcgacgctctgctcaagggcaagaacgacgtgaccatcagctacgacgtcaagcccgatgcctccggcaacactggctggaccttcttcgccgcctccaacgccaccaagcaggagtacggcaaggaacactacgtcggcgtgctcgacaagaccaccggtattaccgtcgaacgctacaacaacaacgacggcaagcgcgattcctccggcaacgtctcatacaccaagacgaacgccgactggaagcacgtcgatatcgtgatttccggcgcaaccgccaagctgtacatcgactccaagctggtagccgtgaacaacaacggccagaagctcgccgacatcctcggtgctgatggcggcgtgctgcagatcggcaaggccaactggagcaacggcgagtacttctccggtctgctcgacaacttcaagatctggggcaaggccctgagcgacgacgagcttggcgtggaaagcgcgaagaccgactacgccgccgcgctcgccatcccggcgcaaatcaccggcgacctgccgagcactgtgctgggcaagacggttacttggtccgcgaccggcgacggtgcgaagctcgtagccgcagacggcaaggtcacgcagccgaagtccggcgagaaggccgtgaaggtcaagctcaccgccaccatcgacggcgtggataaggccatcaccgccgaatccgaaatcctcaacaacggcggcgaaatcgcttcctacgtcaaggatgtcgatcgctccgaccagaacggtgccaagtacgacccgctcgcctacaacgacgatcgtcgcgccgactcgctgtacgtggccgccaaggccgccgatggcagcaaatgggagaccctgaaccgttcgcagtcgattctgtcggtcaagtgggacggctcgcagtctgccaagccgaatgcgcagatgggctcacccgctttcttccgtgcggaggacggtacccttggtgtggtttcctcgcagaacaacgccaccggtgcgatttacgtgtgggatggcaagggcgacggtgccacgttcaccaacgagcgcgccatcaccgtgaccgacaactccatcgtcaccaacccgcgcatcgtctatgatgccgcctccaagggctacaaagtcttctggaccgatggcctgagcggcgaaggccgtatggccacgctctccgacctgactgccaaagcaacggtcggcgagacgctcaaggccgacgcggttgcgatgggtgtgggcgacgtgaccgaaggtctgcccgcatgggccggcgaaggccagacccgcgcattcgctgtgagctcctctgaattcgatgcgttctacaagaactatgtcgatctgcaaaacaccggcgtcaaggctctgggcggcgcaaccgtggagaacggcgcttccgccgaggacgtcaccgcagcggtttccggaacgcaggccacaatgacctacaacgacggctccacgaagaccttcaacgtcgactggaacgccgatgatctggccgccgtggacacctcaaaggccggcacgtatgaggtcaagggcactgttcagcagaccaccgaggccatgtacaacgacgctcgcgccgatccggacatcttctacaacgaagacgatggctactactacctcaccggttccacctatgaggtgaagtccactgattcgaccaacaaccagaaggacggctaccgttccatcggtctcaagcgcgccaagaccatcaacggtctgaaggatgctgaggaacacatcatcatcaagccggagaacggcactccgggccacgaagaccagtaccccgactcgttctacggttggagcgcgttcatttgggcccaggagttccacaagatcaacggcaagtggtggattgtggccggcttccacaagggtgcctcgtccacgaacggtggctggtgcaacaacaccatcctcatcccgtacaccggcgacgagcagtccatcaaggatggcggattcctcgaggccgaaaactggggcgagccgaccgtgctggaaggcgccgcattcgacgtgacgtacttcgagcgcgaggagaacggcaaggcccaaggctactggctcttcccgaagagtgcaggcctgtaccttgccaaggcaaagatgggcgatggcgtcactccgctggtggatggcagccttgagcacatctatcaggccagccagcagttcgagtacggcaagtatgcgcctacccccggagacaactctgaaggttctgatcaggcaatcgtagaggcaccgttcatgttcgagcatggcgactacgtctacattgcctatgcgggtgccacggtggataagtattacaacaccaacgtgatgcgtgccgccaagaatgccgacctgcaggatctgtcgagctggaccacggccgacttcccgtcgttcgacaccaacgacacctacaccggtacctacggtgcggatgaggcctcgtacgagcgcaagcaggccggccccggccacatctcgcttgcacatgatgaggccggcaacatcgtcatggcctaccacgcacgcccctacccggaaattcactccggttccgcggcgggtggcctgttcgatcaggaccgcaatacgtggggcaaggccgtgaacgtgcgcgccaacggcatgctcgacatgtcgctgaccaaggatcaggaggtcgctccggccaaccgcacggtgaccattacggtgaccgtaggcgagcccgatacgccggttgagccgtccatcaccggcatccgcgtcaagagcgagccgacaaagaccaagtacacggtgggcgagcagttctccgccgatggtcttgtgatcgaggcgacgatgtccgacggcacggtgaagacgctcgatgctgccgactacacggtcggcgacgtggacatgtccgctgtgggcaccaagaccgtcaccgtcgcgctcaaggccaacgatcagctcaccacgtcgttcgtggtgaccgtgagtgccaagaccgagcccggtaagcccggttcgggcgacggttccggcgatggtgcaggcggcgataacggtaacgctggtacgggggcggactccggtctgccgtcctctggtgccgccgtgctagccctcggcgcagccatggtcgctctcaccgcagctggtgccggtctgggagtctggcgcaggcgcaaggactgagcaggcctagtctgcacaactcccctcagtccgcctcagatggactgaggggagcccaacaaacgtggtttcccaataaacacacttcacaactcaacaaccaactcagccacccccaccattcaatgaggagaaatatatgggcaagtggaagaaaacggtagcggcgatagcggcgctaccggtcatgattgcgggactggcctcaggtccagtcaccgcgatggcggcagacaacgacggaggtctgacggacgctaatctcgtcgcatcctacgattttgaggatgccaacgataaagggaaggacatctccggcaacaataacgacctgaccgtcaagggcgagaatgtcgaatacggcgtacccggagaccatcagtcaggcggcaacgccatccagttgcgaggcaacgatggtcaatacctcgaactgccgaacggtctgctcaatggcaccgactccttcaccgtgcagttcgactcgaagtcccgcatggctgcgaacgacaacttcttctcgttcaccataggctccgacaaccagaagtacttcttctcccgtctgcgcccaaccagcgtgtacactgccatcaccaaggactccaacggtaacgagcagggcgtgaccgctacgcagtccgcgaacgtgtggcacacgtaccgcatttccgtgagcccgaccttcatcgccacgttcatcgacggcaaccttgccgccatcaacaagaacgtgaccacgaagctctccgagctcggcaccgacctgccgatgaacttcggcaagtccacatgggccggcgacaagtactacaacggcggtcttgataacatcaagatttggaaggctgcctacgtttccgacggcatggtgtgggatggcgtgaccctgcccggctccaccgaaggcagcgtgactctgcctgccaaggatgcgctcggcaacacgatcacatggtcttcgtccaacaccgcagtgctcggcaacgacggcacactcgtcaaagccccggcccaagacaccgatgtgacgttcaccgccaagtccacggtcaacggcatcgaatacacgaagacattcacggtgaacgtggctgcggccatcaccgccgccgacgcagccgccgaacgactgctggtcgactaccagctcactgccggcgcaacgctgccgactgcaattgctgcggcccctgatgcgaaggtgacgtggaagtcctccgacacgagcctcgtcaaagacgatggcacagtcgttggcgcagacggcgacgctgagaagaccgtcgaccttactgcgacggttacgctcggcaccaccagcaccacaaagaagttcaccggcgtgcgcgttatgccgaagagcgcccagaagctctcctcctacactcgcgacaggtccatcaacggtggctcccgcgtgggcaatgccttgcatctggcgctgaacaacggcactacgaccactgcgctcaacaccaactacggtgtggcttttgccgaggcgaagatcaacgcaaccgcaaacactgaatccactgaagttcgtggtctcgtagacccgtacttgttccagttgaaggatggcaagtacgcctatgtggcagtgttcactgatgtgaacggcaatcgcgtagatggcggccaggttgctttctctacctccagcaatctgacggactggtccggcaagccgaatgaggacgagcgtggcgacatggttacggtcacctctgacgctactctgtttgatgccggttccatcgcagctggatacgacgcttccgcaggcgaataccgtatctcgtggaaggtgaacggcgttgccaagtacgtgacgaccaaggactttaagaccttctctgaagtcaagaacggcgtaggcttcgagcgcgcgcaagctgacttgaccggtatcgataatgcggttgctggtagcggcaacgccatcgcgcttaccaaggatgttgctgacagcctgaccgagaggcttggccgcgtgcacaacactggtgtggaagtcccgacagacatcaccgtgcaggccaacaagaccaccaaggatgacctgctcgcgcagatcaacggcggcgcagagctcgacaacggcaacctctccaagggtgccacggcaaccgccacttactccgatggctccaccttcgacttccgcgtcaactggaatcaggacgatctgaacaagatcgacctgaccgaggccggtacttacgaaatcagcggcaccatcaaccagcagaactactccgagcagttcccgatgatgagcaaccgcgccgatccgaacatcgtgtactacaacggtaagtactacgccatgggcacctccgacaccggcggtatgaagacactgttcatccgatcctccgatacgctcgccgggctgaaggatcagaaggccggcaccgcaactgaaggcggctacaaggtcgaaggtcaggatgtgtacctgtttggcgagaacgatggtttggggcacaagggttaccactgggcacctgagctgcacgttatcaacggcaagctatactgcttctacgctaccttcccggccggtaaggctggtgatgaaaacatcactaattctcccaactgggccggtccatctgcttacgtgatggagctcaaggatggcggcgatcccaccaagaccgccgactggcttgagcatcgcgtgcaggccaaggatggcggcgtgctgtccccgcacggtctgtccatcgacatgacctacttcgaggctggcggcaagtcgtacattgcttggagccaaggcgatcaggagcgtaagggtgccaaggccaacgtgtccattgccgaggtcaactcggacaagccgtggcaggccatcaccgagccgcagcgtctcatgcgccccgaatggggttgggagctggacggcgtgaatgagggcccgaacgtcctcgtctccggcggcaaggtgtacatggtgttctccgcgcagctggtcactccgcagtatgccaccggtatgctcatcgcaaatgtcggtgacgacttgaccgatccggccagctggacgaagtccaactacccgtggttgcacaacggtactttcgccggtcagtttggcttgggccacaactcctacttcactgacccgtacggtgatacgtacaacgtgtatcacgcgatgaccagtggcaccaacaacacggctcgccatgccggtgttgttccggtgcacttccgtgccgatggcacgccgattatcgacatgaccactagcgaggagctcgaccagtcgaagaaaaacgtgacgctgaaggtcgtggtgaccgaggaccaggtgtcttctgatgccacgctgaagtcgctgaacgttgtcggttccgatatcgacctcgacacggctgcctctactgagggtgccgcgcttgaagtcgacgatccgagcaaggtgaccgatgccgatgtgcaggctgtggcaaacgatgccaacgccaaggccactgtggccgtggcaaacaacgtggtgacggtgaccgtgaccacgcaggatggcacgaccgtcaaggtctacagggtcgtgctcaccaagaaggccgtcgctcctgaccctgaagacccgaccgatcctgattccggcaaggataacggtgacaagaacaccggcaaggatcctgacaagggcgacaacaagggcgacaagcccggcgctgacctgtccgagactggtgcagccgtgctcagccttggtggtgccgtggtggcgctcgccgtcgccggcatctccctcactatctggcgcaagcgccgcgcttgagcggattcaaatgcttcctctcagtcggcttctgacggacggagaggaagcacctagtatcaccataacttgaacaatttcaaaactgtgcctcataactggaggcgcaaccacaatcaaccctatcaatgaggagaaacatgagaaagctgatacgaaaggcaaccggacttacggtcggcgtggcaacactgctcgctggtctggtgctgccgatgacggccagtgccgagagcgcatcgccaatcgacgccagtccgatcatccactattcattcgataacgcactgacgtccaagaccatcgccaacgagggcagcgcggccaacagcgatgccaccctatccggcgacgccacggtggccaatggccagatcaacctgaccggctcgcaaaccattagcgtgccgaccacggccatcgccggtaagaaggacgttaccgtctccatctggctcaagaacaattacggcaacggcaataccgccgccgcgtacatcggcgcggccaagaccggcaattatccggccaacggctactggctgctcaacccggccaacccgagtggctacgcgaaatccgtaatgaccaatgccactgcggccgacccgaataacagcccgtggggcaccgaagtcggccctggatcgacgaacgccgccaccatcggcaccaaggccaccagcgatttggctctgtacaccaccgtcatcagcggcaccaacagcaccatgagcttctacctcaacggcaagcaggttggagacgccacctacaccattccggccggtggcctgaccaattacggcgacctcgtcgcctacattggcaagtcctcctacgctgacccgaactccaagctcgacgtggacgattacgccgtatacgacactgccatcagcgccgcagacgtgaccaagctgtatgacgctcaggtgctcgacaaggccgaggccgctgtcaaggccgctgtgcccgcatccgctaccgaggacttcgcgctgccgaccagcgccgctggcgtgagcattgcgtggaagtcgggcaacgcagccatcgccgttgacaacgctaccggcaaggccacagtcactcgtccggccgcaaccgcagctgatgccgaggtaaccctcaccgccacgttcggcaacaacgccaaaaccgccgcctacacggtcctcgtgccgaagcagttctccgatgccgagcaagccaaggccgaccttgacgccgtcaccatcgaggactccgacgacatccgtagcaacttctccgtgcccaccaagggcaacaatggttcgaccatctcgtgggaagtgaccggtgacaaggatatcgccacactaggcgaaggcgtgaacgacaaatctcgaacggtcactgttaagcgccctgccgccggaagcgatgccgccactgtgacgctcaaagccactgccaagtacggtaccgccaccgaaacgaagaccttcaccgtcaccattcagccgatgcctgccgccgaagagaaggacgaggcctacgtgtgggcgttcttcaccggcgagggcgtgggcggcgagaaaatcagcctcgcggcttccaagggcaacgatgcgctcgactggaacacgctgaacaatggcactccgctgttcacttccgagtttggcgagaagggtttgcgcgatccgttcatcatgaagtccaaggatggtgacaagttctacatgcttgctaccgatctgaagattgacggtcgtgcccccctcaacgggctgaatggctttgctggtgcacaggctaacggttccaagtacattgagatttggaagtccgacgatctggtcaactggtccaggcaaagccacgtcaaggtgagctctgattacgcaggcaacacttgggcgcctgaggcctactacgacgaggaaatcggcaagtacgtggtctattgggcctcgaacctgtacgacaacaccgacgagaacagccgcaagcagctgacctacaaccgcatggtgtacgtcaccaccgatgacttcgtcaacttctccgacccggtagtgtggattgacgttgatcgccgaggcggtgcaggcagtggatccatcgatgtgaccgtgcaaaaggtaggggatacctactaccgcatctacaaagatgaaaacacgatgtctttgcgtcaggagaagtccacagatttgactgccgcaattggtggcgccggcgtgaagaactacgccgatgcgcttaaggatagtgcatggagcgaagttgccacgaacatcggtaaaggccaggctaacggttacggtaaaaccttcacttccggcgaaggtccatcgctattcaaggccaacgatggcgatgtgaacggctaccagtactacctgttcgccgaccagccgagctatcatcaaggtccaaaccactatgtgccgatggcgactgaggatatcgccagcggtcagtggaccgttatcggcaataagatgcctgaggcgaacttcccgaccaactccgatggcggcaagccgcgccacggaaccgtgctgcccgtgacccgcgcccagtaccagaaggtgctggaggcatacgctccggctgtggctgtgaagtccgttgacgcgctgtctgccgagacgacggttggtgtggctccgacgctgccggagaccgcgcatctgactcatgcggacggttccgtttctgacgttgcagttgagtgggatgccattgacgcatcttcctacgccaagaccggcaccttcaccgtcaagggcatcgcccaagacgattcccgtatgccggtcgaggctaccgtcattgtgaacggcatcgacctctccaaggcgaccgtcaccgtcgaacccaacgagttcaccgcagacggcgctgccaaggagccggccgtgaccgttgtactcgatggcgcgacgctcaaggaaggcgccgactacacggtggcctatacgaacaacgtcgaacccggcaccgccacggtgaccgtgaccggcgttggcaagtactccggtactgtctcggcaacgttcaccatcaaggccgccgagcccggctccacgctggacaagtccaagttgcaggcgcttgtcgataaggtgaagggctataacaaggctgattacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtccaagttgcaggcgcttgtcgataaggtgaagggctataacaaggctgattaccagtctggttgggatgccttcgccgccgcgctcgccaatgcgcagcaggtgttgcagaactccaccgaccagcaggaagtggacaaggcgctgtcgcagctccagtccgccgccgacaagctggtcaagaagtccggcgactccggcaagaccgacggcaaggacgacggtgcccaaaagcccgccaccaagccggacagcgctctgtccaacaccggcgcctcggtgttcggtgcgggtatcaccgcggtcacactgctcgccgccgccggcgccgcctacatcctccgcaagcgccaggcctgagctgcttgcagcgtagaccaagccccctctgacgggccgagccgtacagcaagcagcctactggattgttcgcttcatggcgcggtcccatcagagggggcgtattgcacgttcgtccgacgacgctgtcggacgcataggctctatggccccatagctccaatagccattaccgaacttcaccactcaatatctagatctgttgcgcggcaagcagtatcaccgcgcgcaagaaggagaagcaatgacaaccaaaccatcgataggcaagcgcctgctcggtgtgatgctggcagtgccgatggcgcttgccggcatgggaatcggtgcgaccacggcggtcgcggccgataccgttccgaccgataatctcatcgccgcctacgacttcaccacgaagccaagtgacggcaagaccgtggccaacagtgcgccgaacgctacgcttggcgcggccgaagtacagaactccgccgactcgctttgggccgatgatgccctcaccctttccggcggtgccaagaccggcaccggcgactgggtcaagttgccctcgaatctgctgtccggcaaggacgccgccacggtgcagttggaggtcaaagcggattccagcatgctcaatgctttccatttcctgtggaacatcggtaacgacagctccgatacggagtatttcttcgccacgctcaactgcggcagttcgcgtaacccgctcgtcggcctgaaatcgggcggtacggagacgctcgtgcagtccagctcctgcgtggccaaggccgaccaatggttgtcggtgaccgccaccattgatggcaccgccgcgaaactgtacatcgacggcacgcaggtggcatccggcaccgtgccggccaaactgtccagcgtcaaggaccagtcgctcaacaccatcggccgttcgccgtggcccgacaacctgttcaagggcgcggtctcgaacttccgcgtatacgatgccgcgctcaccgccgatcaggtcgccgcgatcagcactgccgatgcctcaattcatgccagtgaactcaccggttccgtgctgaacggcatcatcatccccacgacggtcgacgatccgttcatttcgctgcccactgcgaacggcgtgacgtgggcgtcctccgatagcagcgtcatcgcgactgacggcacagtcaaccagcccgccaagggcgaggcagccaagactgtcacgctgaccgccgccgtcacagtccgtggccagaccgctacgaaggaattcacggtcacggtcaacccgaccacgaaaactgccgctgaacagctcaaggaagccgcggccggctacgtgatcccgtccgtcgtgcgttccggagacgccctcccggcggctgtgaatggcactaccgccacggttacgtccactaaggacgtagccgtcgaggatggcaagatcaccatcgatggcgacgaggccacgaccggtaccatcaccgtcgagttctccaagaacggtctcgccggcatcgagcccattaccaaggccttcaccgtaaaggtgctgcccgccgcgaagtccgcgaccatcgccgcctacgatcgcaacgccaccggcgagaatgaggccaacaacggcgacgtcgcctacagcatgcacctcgcgttgcagaacgctgacggttcgtacaccccgtacaacgagaactatggtatcttcttcgcacgttcgccgaaggcgcagaagctcaacgagaaccttgacggcaatgactatcgcagtctcaaggatccgagcctgttccgcatggccgacggcacctatggtgtgatttccgtgcgcactaaccgtggcaccgccaccggtgattccaccgcgaagtccagcgtgctcatcgccacttccgaagacctgctcacctatagcgaacaggagaactccggttccatcatcgatcttggcgagaccaacggcgtcaacgctccgtacgccgtgtacgacaccgccgccaagcagtatgtcgtcggctgggccgatgacaacggcgtggccaagtacaccacgttcgattcgctcaagggctccacatccaagcacggtagcgtactgtacggttccgtcgccaagtccggcgtactcgccgccgacggtgtgcagggcatcgcgaacttccgctccggtgccaccatcgcggtggacgaggccacggtgaaggcgctcaacacccgttacggccgctctgagaacaccggcacgagcaatctcactgacatcaccgtcaagaagggcacctcaatcgatgaggtgaccgcgcaactgccgaagaacgtggacctcacttactccgacggttctaccggctccctgccgatttcctcatggaacactgagggcatagatctgacgaaggtgggtgattacactgtcaccggcaccgtcaagcagaccgaataccagattccgttcgccgaggaccgcgccgatccatcggtgtataagtggcagtggacgcatgaggtcgacggtaaggaagccaccgaaaccaagttcctgatgatcgcttccaacgacatccaaggtgacgtcacttggcagcatggttcgccccacatgccgttccgcatggccgacacgatttccggtctcgccgacgagccgggcaacccgaatgccctgattcagtcgaacggctacaacaacaaggaggtgtcgctgctcaaggctggcgacaaggactccgagggtaatgccatcatgcacagcttctgggctccagaaattcatgagatcgatggtaggctcacgattctgttcatggccggatacggcaacacatggtccaacggcaagtcggtgtacatgcagctcaagcaggatgtcgacggtcacgacctcgatccgaccgaccccgataactggactgtgccgacaccgatctaccgcaatgacgcctcgctgctcaacggtaacaagcagctcgcggccaccgcgtccggcggagtgggcatgtcgctcgacatgacctatttccaggatgccgacggcaggtcctactacgcctggcagcagctcggcgccacctacattgccaagatggacccgaaggacccggcccatgtgaccagctccccggtgcgcatcgtcaccccggagtacgcgtggaacgccgccatagccgaaggtccgaacgtgaccctgcgcgacggcaagctgtacctcatgttctccggttccggcgtaggcaagacctacaccaccggtttggccgtggctgatgccgccggctccgacctgaccgacccggccagctggacggcgctcaactacccgattcagaagtccggtccgttcaacggcgagatgcagcttggcaccggtcacggcatgtggagcgaggacgaggacggcaaccaggtctacgtgttccacgcctatgctacgaagaatctcggatccgtgaatgctaccggccgcgacatgttcgtgcgccgtgtgcactgggccgccgacggtatgccggtgtttgacatgagctcttccgaggagctggcctccaagaccgtttccgtgacagtgaaggtggctgacgacacggttacggtcgacaagaccgacctgtccaaggcgctcgcgtccgccaagcagctgcgcgagtccgactacaccgccgcctcgtggaaggcgttcgccgcagcgttggcctccgccgagaaggtttatgccgacgagaacgcttcgcagaaggacgtcgacgacgcaaccgccgcgttgaacaaggcgcaggccgcgttggtgaaggtcgacggttccgattcgggcgatggctcgagcgattcgactaagccgggcgacggctcgagcgttgacactggtgctgtggacgataagacgggtaacaaggtcggtctatccaagaccggtgcggccgtgctcggtctgagtggtgtggccgtggcgctcgctgccgccggcatcgccctgaccctccagcgcaagcgccagaggcgtttgtaggtgaacgaaggccgacagtcccacgggcggaaagtcggcctcagtccgtccgcaattgcggacggactgtcctcgtagcggactgagaggaaccctcctgcctgccaactaggggcacccatcctcaatatgggtggagacaccgcatctcatgaattcaacggtgtgacgttcgcgggagaggctttctctaactcctttccatatacgctggggaacggagataccgtaacctacacggactacggatatcgccacgcttccgataatcaaattggggcgtggaatggttatgcctcttgcggtactggggcttgcgcttcgctgaccaaggaatacggggacttgctgggaagcgcatggttcaacgaatcgaatggtgatgcttcgtgaaccattccgaactctgccggggagcgtgccggcattgtgctgacgcttaataatctgactccgggtgagcgttatgagattcagctctggaccaatgattgccgcatcgcgacgagtggcaagaactacaatcccggcaaaaccacgaatatcgccgatcttggtggcatggtgaagcttgaacagaacagtcaaaaagccgctggcggaaccggacaatacgtcactggcatgttcatcgcgtcgggaaccagcaagaccctcacgcttgcgggaagcaaccccgatgattcagccgatagccgggaagccatcttgcccgcgtaccagttgcggaagatcggcgctgacaagacggcgctaagcgatttggttgccaaggcagagggatcgaaggcatctgactatgaggcgacttcttgggagtcgttggaagcggcccttggtgcggtccgtacggttctgaacgatgacgcagctctgcagaaggatgtcgatgccgcagcccaacagttggagtcggccatgagtgccctgaagcctgctgagccagacgttcccactgagggttcccttgacgagtccaagttgcaggcgcttgtcgataaggtgaagggctataacaaggctgattaccagtctggttgggatgccttcgccgccgcgctcgccaatgcgcagcaggtgttgcagagctccgccgaccagcaggaagtggacggggagctgtccgcgcagcggactgaggggagctccctcgtcttgcacaaaaagtgaacgttaacactaaaattgtaagtacttacaactaaaaaaagcggccttgcatcgccccagtccctcaaaacggtgtcgttcgaggggcaaggcgtcgcatggccgtatgagaacacagttcgcgctgacaaacaaagcagctccattagtgcgaaaaaggtgcgaaacccgaccgataaaggagtggtcgattatcgcacgataacaatttgataacaaaatcgatgtttgtttcctgttcaggaagctgaacaccgttggtcaataacttcgatccataactcaacacaaaaccaaaacccacaatcagaggagacacatgggtaggtggaagaaagcggtggcagctcttgcagctgtcccgatgctgatggcgttggcgccagcagcgaatgcggttgaatcggataccaccgattcatcggccgcgcagcgggcgctggcagcagccctgaaatcaaatgccaaggcagcggcagacagtgatctgctcgccagtcttgatttcgataacgtcgctgcaggcgctactggcactattgtcgatgacaccaccggcaccaaggcgaccatcaacggtgctgccgcagtgactgccagcaaggacggcactgctgcagttcagctcggttctggattctggctgaatgtgactaagtcggacgattctgccgtgctcaagggccaggatgcggtcacgatttcgtacgattccaagtccgccagcactaatcagggctggtcggtattcgctgcgccgaatgcgaatgcgcaaacctaccagcaggagcattacctcggcgtgatggatcgcaccacctcggtgaacgtagagcgttacaacaacgccggcaagcgcgacaccactggcaatgtgggcaaggatggcctcgccagccagtggcgtcacgtcgatttggtcatcgacaaggccgcttccacgctgtacattgatggtgagcaggccgcaaccgtagccccagctgatggcgtgagcttcgctcaactcaccgatattctcggcgcagacggcggcgtgctgcagattggcaaggccaattgggtgaacggcgaatactataccggtgcactcgacaacctcaagatttacggctctgcgcacactgctgaccaaatcaaggaggtctacgattccacgaagtccgatgccgccaaggccgacgctaatgcgctgaccctcaacaacggcgctgaggacgtgtattccagcatcacacttccggccaagggctcggttaacggttccgcgattacgtggaaatccagcaacgcaaaggtcattaccgatacagcagatggtgacatcgcagccggtgttgtcacccgccagaaaaccgacaccaaggtgacgctcactgccaccattaccgatgctgacggcaacacggaaaccaaggaattcgagctgaccgtcaaggccgccgtcgaacagccgaagaccacggactatctgttcgcgcacttcaccggcaccgaaggcagcactaccgacgagcagatgtacttcgccaccagcaaggatggcctgagctggcatgacacccgcgagtccggcgatccagtactcagctggaacaacagccagaccggcaactctcgtggtaaggacaacggtgtgcgcgacccgtatctggtccgctctccggaaggcgacaccgtctacctcatcgccaccgaactgagcatccacaaccgtggcggttggggcgcggccaccgctaccaccaatggcagcaccaacctaatcgtgtgggagtcgcatgacttcgtcaactggagcgaaccgcgcgccgttgacgttgcctctcagattccgggagccggcatggcttgggctccggaagcctactgggatgatgtgaacaagcagtacatggtgtactgggccactgcttccgacgcggacaacaagtccggcgatcgcaccaatatgtactactccaccacgcgtgatttcgtgaacttcacgacgcctgtcaagtggatcgaccgagtcaagtccgttatcgataccacgatgattaaggccgatgacggctattactatcgtgtgtccggtgacacgtacctcggtgttgagcgtagcaaggatccgtatgccacaacgctcaccactggtgacacaattgcgaatggttactacaacactgacagtgatccgaaccagtggacgcttgtcggtacattcggtgacctgactggtaccggtctgaccggtgcgcagctggaaggcccggagctgttcttctacaatgaagatgacgtgcagaccagtgatgcgggcaagaagatgctctacggtctgatgtgggaccagtactcagccggtaagggttacaccccataccgttctgccgatttaggcagcactgataaggctgattggggctttgcctctgatgtgaacttcggttcgctcaagaagcgtcacggcaccatcctgcctgtcactgaaaccgagtacaacgcaatcctgaaggcattcgataagaacaaggacaccgagccagtcacacccgatgaagacggctccggtccgattgccgagtatgacttcgaagacagcaagggtaccgacaccactgagaacagcaacgacttgaccttcaacggcaacgccaaggtctccgaggatgccgaaaagggcaaggtgcttaagctcgacggctctgacggcacctacgccgagttcccgaagggcctgttcgatggccgtaacaagctgactgtgcagatggatgtcaagtcggagatcaataaaaaccagttcacgttcgctttcggccagaactccaccaagtactacttcctgaagtacaacaactccggcgagctcgccagccgcatcaccaccaactcgtatggtgcggaggacgcggctaacgctacgttgtctggcaacggcgcatggcatcgtgtcacggtcacgttggacgacaacgtgatgaccgtgtactctgacggtgcgcaggtggctcagaacaaggcgaccaagaacaaggtcaccgatttgggtaacgatctgctggcctacttgggcaagtccttctacaacgacccatacttcaagggttcgttcgacaatgtgaacgtgtggaaccgcgcgctcactgctcaggaggtcgagaagaccagcccgattgctctgcagggtatttctgtgggcactgtgccgtctgacccgaactcgctgcgtggcactgacgaccactctcaggtgcgttccaccctcgactggtccgcgaagaccgtcaccaccgtgctcaaccgccgtggcgacgcggccaaggtgcccgtcaaggtgaccgtcaaccgtggcgacgactccatcaagctcacccttgatggtcaggcgttcaccaatggtggtacggccgacctgactaaggaccgtactttggttgtcgatttgggtgacggtaatacggaaacctggacgctgaagaaggtcaccgtgggcaacaacccggtgctgcccggccagtacgccgacccggacatcgactacttcgacggcaagttctggatttacccgaccaccgacggcttctccggctggagcggcaattacttccatgcgttcagctccaccgacttggtgaactggaccgacgagggcgtgatcctcgatgtcaacaaggaccaccagccgaccaccgatggcgatgagaacaccgccatctccccgtggtccgtgggctccgcgtgggcaccgaccatcgagaagaagaacggcaagtactacttctactactgcgcgaagttgccgaacggtcagtccgccatcggcgtggccgtggccgacaatccggccggtccgttcaaggccgccgatcagccgctggtcactcgcacgatggaaggcgtcaccgttggacaggccatcgacccgtccatcttcaccgacccgaacaccggcaagtcgtacatcctgtacggcaacggttcgcccgccatcgccgaactcaacgacgacatggtgagcatcaaggccggtacggtgaagaagctcaacggtctgaacgacttccgcgagtccgtggtcgtcgcctaccgcgacggcaagtaccactggacctggtcatgcgacgatgccaactccccgaactaccatgtgaggtacggcgtctccgattccatcgacggcaccatcacctacaagggtgtgctgctgcagaaggattcctccaagaacctgcaaggtgccgcgcaccagtccgacgtgcatgtgaccgacgcggacggcaacgaccgttggctcatggcctaccatcgccactacacgccgctcggcgtgttcacctccggccttggttaccaccgtgagaccgccatcgacgagatcaccttcgacgcggacggcctgatgcagaccattcacccgaccgacgaaggcgtgtccattgagatggccgatacgacggcgcttgatggcgcgattggagcggccgacaagctcggcaccgatggctctgcttacaccgaggccagctggaaggcattcgaggatgcgctcgccgcagccaagacggccaagcagaccttccttgactccggcctgtctcaggctgatgtcgatgccgccgccaaggccctgaccgacgcgcagaatgcgttggaggagagccagcccgagccagagcacccggccgcaggcacgatcctctccatcgccgtgaccgcgcagcccgccaaggccgagtacaaggtcggtgaagcgctcgacactgccggtctggtcgtcaccgcgaccgtggccgatggcaacggcggctccgccacccgcgagctcgccgccgatgagtacgagctgctcggcttcgactcctcgaaggcctccgacaagatgaccgtgaccgtgcagtctgtggccgattcgaccaagaccgccacgttcaccgtgaaggtcgttgccgacgagacgccgactccggatcccgatctggccactgaggaagagctcaagcagctcgaagatgccattgccaaggccgaagccgagaatctgaaccaggacgattacaccgccgattcgtggaaggcttacgccgatgcgctggcccaagcgaagaaggtgctcgccaaggagaacgccacctccaccgaggtccaggatgcgattcgtcacctgaccgaggcccgcaaggccctcgtgaaggtctccgctgatggcaagaagccgggtgccgtcatctccgacactggtgccgccgtcttcggcgtggctggtaccgtggtggtcctcgccgccgccggtatcgccctgaccatctggcgcaagcgccgtatctgacccctcatttgcaaaaaactctcactgacgttgagtcagtgagagttttttgcaatagggggggggcttatctcttcgcctgagtgatctggtaggcggcgaagaggatggcgagccaaatcacgccggcgatgacggcgacgcggtagctggcggagaagcacatcagcaccacgaccagtgccaggaacgccaataccacccacggggttactttggcgaacggcagcttgaagtgaatcgcgtcgagcgcttccttgccggacttgccggccagttcggaatcctcgggagcgccgcccgcggcgaccaccttacggaacttcatttcggtgaacatgatcatcgtccagttgatgatgccggcgatggtggcaatcgacatcagatagttgaacgcgaactcaggccacacgaacaccacgaccacggcgatggcggtgatcacgacggacgtcagcacgccggccaccggcacgcccttagcgttgagcttgcccagatacgcgggtgcattgccttgtttggccagcgaatacagcatgcgggagttggcgtacaggccggagttgtagacgctcatcacagcggtcaggcacacgaagttgaggatgccggcggccgcgtggatgcccacggaatcgaagatttgcacgaacgggctgggaacatcgtctccgccgatggtgttccacggtattacggccatgattacgccgagcgcgccaatgtagaacacgagaattcgccagataatgtcattggtggcgcggggaatcgtacgacgagggtcctcggtttcgccggcggtgatgccgatgagctcggtgccgccgaagctgaacatcaccacgacaagcgccatcaacaggccggtccaggtgccgtccttagtctgctccatgagaccgttcgggaagaagcccccttccaaggtgaaccagttggcaaagctcgctttgatgccggatgcggtgggcagagcgaagatgatgacggccaggccgccgacgatcatggcgatcacggccacaatcttgataatggcgaaccagaactcgaactcaccgaacttggagacgcccagcaggttggcggcgcagataatcaccaagaacacggccgccgacacccatgtcggaatcgccgggaaccagtagtttacgaatttgcccaccacggacagctcaaccatcgagacgaggatgtaattgaaccagtagttccaaccggagatgaagccggcgcgcttggaccagtagcgagtggcgtagtagctgaacgcgcccgccttcggatcctcaacggacatttcgctcagcgcgcgcacgatcatgaagattgcgaagccgccaaccaagtaggcgagcagaatcgaggggccggccagcgcgatggattcgctggaaccatagaacaggccggttccgatggcgccgcccagcgcaatcagctggatgtggcggtttttcaatgacttgcgcagcgtggccggcaccggcacgtcgtcggtttcgcgcggcttcttaggcgcatcagtggtactcattgtgctcttctctcacatttcttgggtttggcgcacgcggggcttgccgtgatgcgcaacgttcgttattctatgccgccgtatcgtctcagaaatggtcaatcgtctatttgtgcgctattgcaagcgcgggcgtgggcgcggccggtgagcaggcgaagctatagcgagcgatgcttatgaaaccgcacgcttcactgagttcactgaattcactgtgctcactgcgtggcaggcgtacacatggtgaagatggtgtgggacaccgattcgggagaggccgcgagatcggtggcgagccagtattgcaaaagcccaatgctgccggacacggcgaatcgcatacgcatctgcgcctcggctgggtaacccgccgaagattgcaactgttcgcctacaccgcgctggctgtaaatcaatcccagcagctgctgctggaaaccgatatccgctttcgggctcatcagcacttggagatgattgcgattgtcggcaatgtactggcagatgcgctcaataacatgctcgatgccggcaggatctggctgggcgagtagctgttcgagtgcggtggtgacccaggccatggtttcgtcttcaatgtcgtgcagcagttcctcgatgctcgcataatgcgcgtaaaacgtggaacgattcacatcggcccgctcgcacaacgctttaacggtgatggagccgagcggctgatcgcgcagcaactcgataagcgcgtcctgcatggcacgtctcgtgtaacgggtgcggcggctttccgtcaattctttggacatggccttctccccaagttccgacaacccacaatccaactgttggttgcagaaccgacacagtgttgttttacttgagtatagcaggaagttctggcggggcctatggggctaggtggctgccacgagcgcgttggaggtgtgcgatggcgtatatcgaattcgaccatgtggtcaaggaatatccttctggcagcagtgtgattcgcgcgctcgacgaggccagcttcaccgccgaacaaggcgaattaagcgtgattctggggcagtccggtgccggcaaaaccacggcattgaacattctgggcggcatggataccgccacaaccggccgcgtagtggtcggcggacgcgatattacgggtctgcggaaaaaggaactggtgacctaccggcgcaacgatatcggcttcgtcttccagttctacaatctggtgcctaaccttaccgcgctcgaaaacgtggagctcgcctcgcaaatctgccctgaccatttcgatccaggggaaacgctgcgcaaagtcggactgggggagaggatggacaacttccccgcgcaactgtccggcggcgaacaacagcgtgtatccatcgcccgcgcgattgccaaaaagccgaagctgttgttgtgcgatgagccgaccggtgcgctcgattacgagaccggcaaggaagtgctgcagttgctgcaggatatttgccaaacacaaggcatgaccgtaatgatcatcacgcataattccgcgcttgcaccgatggctcacaaagtgattcgcttccgctccggcaaggtgaccagcgaggaggtcaacgcaacgccgcggcccatcgccgatatcgaatggtaggtgattggcgatgctcactgcaagacactctgtgaaacgccccgtgaaacaagcgaggcgattcgtgaaacaacctgtgaaacattctgtgaaacggcggaacctcgacgatagcggcggtcgaggagcgggcgtttctgcggtatttgccaaagatacgttgcgttgctggctgcgcagctggaagaggttcgtctcgatcgccgtcatcacgctgcttggcgtggccgtgctgaccggcatctacgccggatgccgcgatgcttttctggcggccggtcgtttttacgatcagcagggactgcatgacctgcaggtgctatccacatacggcctgaccgatgatgatgcaacggcactgcgccgaatcgacggtgtgcaaaccgtgcagcccgaacgttctcagacggtgaccacgttggtggacggcaccaagaaaaccgtgaccatgcaggaaatcggtaccgaagggcttgatcagccgtacatacggcagggcaaactgccgaacaaggccggcgaagtggcggttacgcagcaattcctgaacgatagcggactcaagattggcggcaccattactgtgacgccacaagacacttcttcatccgtcatatcggtagcggccacggagactgacgattccaataatgccgatacggtaggtgtcgccgccaatgcctcggcatccgatgcgaagtccgccgccaatacggacgccgacgccgagcaatccccgcagttccccacgaaactcaccatcaccggcgtcgtacttgacccgcgcgacctcaacaatccagacggctattcgggcatgacctccttccggtccacctcatccgaggactatacgttctttgcacccagcgacggcgtgaccggcaatatatacactgcgatatcggttgccgtcactggtgcgtccgattttgacacgttttccgatgcctacgatgaagccgtcaaaaccgtggccgaccgtatcgaacatcagatacagaccacacgccagaaagcccgtcgtcaacagatcgtctccagcgcgcagcgcaaactggatgatgccaaagacgaggccaacgagcagctggacgaagcccagaagcagatcgacgacaactgggccgagctggaagccaacaaaacgacattgcaagatagccgtaccgaattggagaacaacaggacaaccattaccgatggcgaacggcagctcgccgatggacgtgcgcagattgcatcggcccgtcaacagatcgcgcaaggtcgccagcagatagccgaagcgcgcacccagctcgaatcgggcaaagcgcagctcacctcggctcgcaaacagctcgatgcggcgcaaacggaactgactgccaatcgcacgaaaatcgaacagggcattacccaaatcgaccaaggcgtggcacaaattgatcagatgctgtccatgattcaacaggccgacaatctactggcgcaacttgacccgaatatcgacttcaactcacccacatggcaggccatcaagcaactgctcgcgcgccttggcattaccctgcctgaagtgccgtcaatcagtgagctgcggcaacagctggccgccaagcaaacggaactgcaaacgcagcgagacagtctgacccagcagaaagccgatttgcagcgcacattaaacgaaaccattgcccccgcacaatccaccttggaccagcagaacgcgcaactgaccgccaaggaacaggaagcggctgcaggagaggcacagctcaataccaaatccgcggaactcgaagcgaatgccgcaaccctcgaaacccagtcggcgcaacttgaagcgcaggccgcccaactggccagcggcaagcagcagctcgaagaaggcgagcggcagctggaagaaggcgaacaacagctcgcggacggcaaggcgaaactggatgatgcgcagtctgcactcgatgcgaagcgaagcgaagcggaaagcgaattcgccaagcagcaacggcgcatcgacgatgtggccaacgcacgttggtatgtgcagacacgcgcttcgatcgacggattcagctcgctcaaatcagacgtcagttccatcgaatccatcggccgcgcattcccgattgtgttcctgctggtcgccgtgctcatgagcctgaccaccatgacccgcatggtcgaggaagaccgcggacttatcggcacctaccttggactcggctatggcggactcgccgtgtccagccggtatctgctgttcgcgttgctcgcctgcttggtcggcggcggcatcggtctgctggtcggattcctcggcatcccggcattcctgatggtggtgattgagggactgtatatattgcccggtgtgcgacttgaatacgactggctgtacggctcggccggcatcgtgctgttcgtggtcggtgtgggcgtggtcaccgcgctcgcctgccgcgaggagatacggcacacgcccgccgcgctgatgcgcccgaaggcgccgaaggcgggcgctcgcatattgttggagcggattcgcccggtatggagccggctgaacttcctcggcaaagtcactgcgcgcaatatcttccgattcaagtcgcgtttgattatgaccgtgggcggcgtggctggttgcacagcgctgattatctgcggatttgcgattaacgacaccgtcgacacgactggcgtcaagcaatatgagcagatctaccagtatgacttgatggtggtggccaatgacgatgacgccgccgcgatgcgcaagcaggtggcacaagatggccgggccaccgaaacgctgaatctgcgcgtggatagcggcgagatgagcaatgcggcgcaggaaagcgaaaccgtgcagctgatgacggtgcccaacaattcgttgaacaaactgaacgacatggtcacgctggaagaggccggtgacgatgggtggttcgagctgcccaatatcttcggcaaagcgggtggcggcactgtagcgctggacgatagtggtgtgattgtggcgaagtccgcagccaattcgttggatattcatgcgggcgacaccgtcacgttgagcaatggcggcagcgggcgggccaaggtgaaggttgcggcggtgacgcgcaacctcatcggctctgatgtgtacatcagtgagcgactgtacgaccagaagtttgcggccgacggtgtgacgtcttcggcttcgggagatggcactgcctcgaccttgacgtggaacgcgatgctcgccaagctgaaaggttccgagaccgaacaggccgaatatgcggatcggttgggcgaggaatcgtcggtgctcaaggccgtgagctgtgcgcatctggccgccacgtttaagttcgatttgatgggtgccgtggtggcgctgattgtggggctcgccggcggcctggcgctggtggtgctgtttacgttggccaatacgaacgtgtccgaacgcatccgcgagatggccacactgaaggtgctgggcttctatgaccgcgaggtgcacaactacgtgaaccgcgagatgatgatattgaccggtatgggtgtggtggttggtctgccgcttggcaggtggataggcggattactgactgctgcgttgaatatgccgtcgctgtatttcgaagtggaagtgcactggtacagctatgcgattgccgtggtggcgacgctggcgttcgcgctgctggtgcagctgttcaccaacccagtgctcgatcgcgtagacccggtcagctcgctcaagtccgtggaatagaggtagaagttcaatttggtgttgatgaattgaactttttggcggaatatttacagtatcatcgcatgtattcttgagctgagcggttttcgtgacatatttcggtgatacagtttgaacttgttttgaacgagtatcgcgtctggtgcgtaacaatcgggcggcagagaagagaaatgaaatcagtatggccgatacgaatgtgaatggtggtacacagcaggctacgggcaaactcaagtctgtcgaaagcctggaccagaccaacgagatggagcgtggcctgagcaatcgccacgtacagttcatcgccattggcggcaccatcggcaccggcctgttcctgggctcgggcaagtcaatctcgctaaccggcccctcgatcatcttcgtgtacattctggtcggtgtcatcatgttcttcctgatgcgcgccatcggcgaaatgatgtaccgtgaccccagccagcacaccttcatcaatttcatcacccgttaccttggcaacgggtgggggcatttcgccggctggacgtattgggccgcgctcgtgctgctgggcatgaccgagatcacggccgtctccacgtacttcatcaccttcttcgacacgttcggcatcgacctgacccattggaaatggctgatcgagctgtgtttcctggtgtcgctggtctccatcaacctgattgccgtcaaggtgttcggcgaggtggaattctggttctcgatgatcaagatcacgctgatttgcgcgatgatcgccaccgccgtggtcatgatcgtgatcggctaccattacccagccgtgcagattcacggcgtggaccacgtgagcccggccggccacgccggattcgacaacctgttcgccaacttctcgttcgcgccgaacggttggatggccttcctcatgagcttccagatggtgttcttcgcctacgagatgattgaattcgtgggcgtcaccgtctccgagaccaagaatccgcgcaaggtgctgcccaaggccatcaacgagattatcgtgcgcgtgctcatcttctatgtgggcgcactggtggccatcatgtgcatcgtgccgtggacctcgttcaagccgaacgaggacggctcctttgcctccccgttcattatggtgttccagtacgccgggctgaattgggcgtccgcgctggtgttcttcgtggtgatcaccgccgcatcttccgcgctgaactcgctgctgtactcggctggccgccacctgtaccagctgtccgaggtgtcgccgaacccgatgctgaacaagctcggcaaggtgtccgatcgcaaggtgccggcccgcgccatcctggtgtccgcggcgctgatactgctgtcgccgatcgtcaacgccatccccggtgtgtccggagcgttcgtgctgttctcgtccgccagctccgcggtgttcctgttcatctacatcctgacgctgctggcgcatcgcaggtaccgccgttccgctgatttcattccggacgggttcgtcatgcccgcgtggaaggtgctcaatacggtggcaatcgtgttcttcgtgttcatctacctgacgttgttccttgcggacgatacgcgcaattccgcgattgccggcctggtgtggcttgtgggcttcggtggattctctatgctgcgcgaacgctaccgtagccgcgatttgaaggccgcactggaacacaaggagtgattggacgggctgattggctggcggctattggttgggtggctgttggctgttggcggctgactggctagcggccgatagccaatgactgggctgatcgtcagccaatcggctgcctataggtctcattgatacattcggtcatccgattagtgcatttgtgcggacaattagtgcattcgatcatcggattagtacatcagtgtgcaattattagtacaattagccgcctaattagtacattaggacataaaacaatgtcctaatgtactaattagatgctaaaatacgataagtgccatgtcctaatgtatgaattatcgctatgaagggcggaatgcgatgacgcaggatgaacttatgcaagtgctgcaggccggtgaatcatctatggtcgagttcaagcgctgcagcgaattgcctcatacggatacttttgagactgtatgctcattcgccaatcgttctggtggcagcatttatcttggcgttgacgatgacggtcaagtgctcggcgtcgattctaagcgcgttagtgagatagagcgcaacgttgtcaacgtagtgtctaatcgtaagatgttcgaaccggctccaatggtggaaacggaacatatcgagtacgacgaacggattattgttcgtatttgggtagctccgagttcttcggttgtgcggttcaagggcgcagtgtttgatcgcattgctgatgtggatacacacatcgaaagcgatatccagattagtcaaatgtatattcgcaagcagaactactattccgaacggcgaattttccgttacgtgactccgtttgatttgcgtcctgagctgattgcgcgaatgcggcagctggcggtcgctcagcgagctgggcacccttggggaactatgtctgacgaagaactgttccgcagcgccaagctatacgatcgtgattacacgaccggcgaagagggctttaatcttgctgcagtgctgctcttgggcaaggatgaagtcatttcctcggtttgcccagcgtatattactgatgccgtggttcggcgagacaatattgaccgatacgatgaccgacttatggtgcggaccaacttgttcgattcgtacgagcaactccgtgaatttactgagcggaatctgcctgaccgctttgtgttaaagggcgataagcgagtgagcccgcgtacgatgatcgcccgtgaattggtggcaaacagcctcatgcatcgggagtattccagtccggtggtggcgcgtgtcaccattgataatgaatccatccggacggttaatgcttcgcgctcattctttgaaggtcgaatgaagctgggcgagttcacgccaatgccaaagaatccgattatcgctaatgtgtttgtgcagaccggcatagccgagcagctgggtagcggactgcggaatctgataagagcgtcccggcaatatactgagcgagagcctgagttccgcgatggtgacatattcgaggcgacgattcctattgttcctgcgctgaagaccgtggatggttctggttttgctagcgtgagatctgtagttgagaaagatgccgaagagggtgcgaggctcattggcggggaacgtgtggatggtaagaaagcagatgcaaccgcatcgggtgaaattgattcgcgggcagcgatgctgtcggcgatgaatcgacgcttgacagaggttgactatgtgactgtacctgaactcgccaagataacagagctcgataacagaacagtccgcaaattcctaaacggtttagttgcgcaaggaaagctgattgctgaaggcaacacgcgtggtcggcgttatcggaagggatagcgggcgcgatatctcgatgcagtgggattcacttaagggctacggcaaatatgattcgtagcgattgggccagcgcaattcgaatggctcatgactttgtgcgtcgtttgtggtctctgaagttgtttgctgggtgacggttttgtgataaaatcgctcatatcaaaatgtttgcgtaaacattttggctgcgccgaaagaaggagtcgacgtaggtcatgtatcaggcaaagaggccggcgcagtgaagcaaaggccgatttttccggtataaggcggatagcaggaacactaaggagaccaatgaaggtactgagcaaatcgcttgctgcaatggttgcggcggcaacactagtgggaggaggggcgtttgcggttgccggcactgcgtatgcggctgataacgatgccattaccgtgaccccgaacccgtggtatgccaacagtttcgatggctggggcacctcgctggcttggttcgccaacgccaccggcagcctcggcgaggaatcggccatcaccaccaatctcggcgatgacgcttccaaggctaaggctgtggaatacggcaagcagctgcgcgaacagttctaccagtccatcttcggtgatgaaggactggacctgaacatggcccgctacaacgtgggcggcggcaatgcctccgatgttgcctacggctacccattcatgcgccaaggcgctgccgtgcctggcacgtggaaagatgacgccaccggctccggcacgtatggcaatggcgtaaccaccaagcaggccgacaaagacaagctggctgcggcattcgacccgactgacgacaaccagtatgacttctccaagtccgccgcccaagactggtggattgagcgcggtgccaccggcgataaccctgacatcaccgacgtagaggccttcgccaactccgctccgtggttcctgaccaacagcggttacgccactggtggacgcaactccggtagcaataatcttgcaaaccctgagaaattcgctcagtacatggccaagaacgtcgagcacctcgaaagccttggcgcaaacgttgacacggtcgagccgttcaacgagtccgagaccagttactggggcactccgggcgacatggcttcgaagtacaccgatgagagcgatgacaacaccaagctcattaacaactactgggataagtactactccgacaaagataagtccgtcaccccatactccaacgcgttgaagaagccgcaggagggtatgcatgtcaataacgcccagcagcagcagacgattaccgcactcgctgaggcgctcaaggacaatgatgacaccatcatcgcagccaccgatgccacgaactccgccgacttcgtcaagtcgtacaaccagtacccgcaggcgatcaaggaccttatcggccagtacaacgttcacgcctactccgacagcaaccagatgcagtcgcgcgatatcgctcaggcagacggcaagaagctgtcgatgagcgaggtggacggctcctggcagtctggctcctacaacccgtacggtttcgacaacgcgctgggcatgatgagcaagatcagctccaacgtcacccgcctgcagtccaaggacttcaccttctggcaggtggtcgaggacctctacaacatgcagatggggtcgaatgtgaatccggccggtgagaacaccaactggggcaccgtgctcatcgacttcgactgcaccgtggctggcatggacggcaagctctactccgagcgccgcgtgaacaacaacggcggtaccaccgatggacttgaaccgtgcacggttattgcaaacgccaagtacaacggcgtcaaggccatcacccacttcatccacgcgggcgacaaggtcatcgccaacaacgatgaagacaacaacatgactgccacctccgacgatggcaagacgcagaccgtcatccaccgcaactccggcacctctgaccagaccttcgtcatcgacctgtcgaagtacggcgagattgccgacaacgcttacggtgagctctacctgaccaccgaaacctctgccgaagacaagaacgcgggtgtcgattccgccactccggaagtcttcgccaagaccagcaacgtcaagcaagctgaaggctctgtgatgattgacaaggctgccaagaccgctacggtcactgtgcccgcccgttctatcgcctccatccagctcactggcgtgaccggctacgctaaggatgctgccgtcgagaccggcgacacttaccagctcgttggtaagcagtccggcaaggccgtggctgataccacttctggtgattccgcgctgtccctggccaacgtcgcttccgatgccgagaacgccaagaagcagacttggacctttacccagatcgagcagcccgccgactccgagcgccctgatctcaaggcttatgtgattactaacgccgaaggcaaggtgctggtgtccaaggatggcacgaacgcgctttccaacgaaacggttgaggccgctaagtccgacccggctgccaagtggattctcaacacttccgatggttcgacctaccagctgctcaatgccgcgactaagacgaacctcgatgtggataactctggtaccacagtcggcacgaaggttggcttgtggcagtcaccgagcggcacttcgccgtccgccaaccagacatggactctacgcaatgtaacgccgaccagccagaagaccgtgaacgtgcagaccgccgttaacgagaaggccgcgctgccgaccgaagtcacgctctactacacctggggcgaaggcaaggccacggttgccaactgggatacttccaaggtcgatgtggccaaggaaggcacctacgaagccaccgctaccgccaccgatgtgtacggcaacgagttcaacgtcaccgctacggtctacgttggcgcgctcaccgtttccgatccggtatcggctacagtgctggccggcaccagtgcgagcgaggcgaaggccgcgcttgaggctgcgccggtgtacctacacgtcaaggcatcgcctgcattcgagggcgatgcggctaaggttacgtggaacttcgatgggcttgataccaagctcgccgatgccaaggctggcgacaacattgccgtgaccggtacttaccagctggacgacgcgaccacgattgcactgaagggcgcgatctatgtcaccgccgccacgcctgagaatgtggccgacactgcttccaacctgaccgtgaccaaccagcagacggaatacagcaagggcgatcagtggaagaagctcaccgatggtgacacgtcagctgaagcctgggtgacgtggaactctgctggtgactattccgccagcccgaccgccacgattgacttcggctctgagtgtgagcttagcagcgtgaccattacgtatggtgacaaggctccggcttccgccaaggccgagtacaccactgatggcgagacgtggatgcaattcggtagcgatgttaagcctgccgcaggccagacggtgacgttcaaggccgataagggcacagtgaatgccacgaagatgcgcattgtgaacaccgtgaacaacgactacatgaacgccaccgaaattcaggcattcgtgacgccggttcagggtgctgcgaagaacatcgccgcggcctctggcacgaacttctcggtgaacttccaggagggtgcctccgcttccaaggccatcgatggtgacactacgtcaaagggttggtccacttgggcttccaccgcctcgacggtggacccggtcgccacgttcaccttcgacgaagctcagaccatcaccgaagtgaagaccttcttctactacgatggtcgtgcgtcttggccgaagagccagacgctggaataccaggatgaggctggcgaatggcatggagtcggtaccaaggatggctggaagatacaggccggcgatgccggctctggctccgacggcatcaccgccgccgacaccccgaccgttgacttcgtgctcggcaccccggtaaaggccaaggccatccgcctgactaacacattgcaggacaccaaggtgtacatcaacgtggctgagatccaggtgttcgcacaagacagcacggtactcaccccgcagccagcatccgatgccacgctgggcgacctgcgtcttgacggcgaaaccgttgaaggcttcgacccgtccaagaccgactacacggttgatctgccggtcgacgccgaggcaaacccggtgctgcaggccttcgccaccgacaatgccgccgccgtcaaggtgactggcgacgcggttgagaacggcaagcttggcggcaaggccgccattacggtgacctcagccgacgagtctgagacgaagacctacacggtgaccttcaacgccttcactttggcttcgctcaaggtgatcggacccacgaagaccgagtacgccatcggcgacaagctcgataccgccggtctgaaggtgactgccgtctaccagagtgtcgacaagaccaaggaagtgccggtcgctcttgacgacccgcagcttgcgattggctcgttcgactccaccaccgcaggcaagaaggcgattaccgtctcctaccgtggtgtgaccgcgaccttcaacgtcacggtcaaggccaacgcagtcgcccctggccctgaagaacagaagcccggcaacaccaacaagcccggtgccaccggcaacggcaacaagaacacggtggccaacaccggttccagtgttgccgccatcgctggcgctgtcgctctgctggccgctgccgcgggtgcactgttcatgctgcgcaagcgtgcatagcaccctcgcgcagtaatgggtgaaggaacaagccggcaatattgactattgccggccggttcctccgctctttgaccataattggtccgacaagttgaatactgaattttcagtatcggtatattgatttgtcgaaccttttctggcttcgcggatagcgacataactgtttgttcaaaaaaccgttatcatcaatcaaggaaccaaatcaatgaagataaacgataagggcaagggcgctcttatcgcggcaattaccgccgcggcaacgctattgtcatgcgggctggccgctgcaagtgccagtgcggcaggtgtggattacctgcctaccatcggccaagtgccgacatacaccaagttccagcccacagccgatccgggcaagaacgctagcgattacttccagccatattggtatgccaagaacgccaatgataatggcggcacacacatccaagcgcacggtggccaagtggtcaaggtcggcgacgcctactactggtatggcgaagaccgttctaacggttacgacaacagccccggtgtccatgcttatatgtcgacagatctatacaactggaccgatcttggtgtggcgctgcgtgcggtgaccagcaaatctcagttgacggataagagcaatgccgattacgcctacttcgacaaggcctacaacctgaccaagtccgacggcagtgtggacgctgccaaggccgacgcaatcttcccgtacctcaacaccaaccccgatcaggatggtgatggcgcggttgattccgtacagggcattttcgagcgtccgaagatcatctacaacaagaagaacaagcaatacgtgctgtggtggcattccgatggaagcaccacgccgggcggttccaactatgcacgtgcacttgcgggcgtggctgtttccgacaatccggcgggcccgttcactatggtgggtgcctatcgtttgcctaaccagaacaattggaaagaagccgcaggtaaccccagctggggtgagaacggtgacagccgcgatatgactgtgttcgtggatccgaaggacgacagtgcctatgtactgtattcttccgaagccaatgccacgctgtatatcgccaagcttaacgatgattacaccaatgtagtcaagaccacgaatgtggaccagtccgagggacaaaagcagtactctgctgacgggcagtacccatacattcttgcagacggtactacggatgccccggtgcgtggcgaagatttccaaatcgtcaaacaaaatggttcgctggaagctcctgccgtattccaatatgacgggcgttacaacatcatcgcatctggtgcaaccggctgggacccgaacaagcagacctactacaccgccgactccatgctgggaagctggacccgtggcgtggaaaaggacgatgccaacgagaacacgtggtacaacaacatgccggaaggcgcggatggtctgttgtctgtgggcgatacccgcggcaccacattcggttcgcagtcggctagtgtgctcgcagtagaccaggagaaaggtcacttcatctaccttggtgaccgttgggattccggtaaagccgattccacctatgtttggctgccgctgaccatcggtgagaacggcaccatcgaaatgcataatcctgctcaagaaggcgagcccgacggctgggatctgaactattgggacaaccatggtagcgccaagggcaagctggtcaactggactgtggaaaccggcgatgatctcccgaagaccgtgaacacgggcggaaccgttactctgccggacaccgtcaacgtcaaggaaggcgacgataccattgctaccaaggtgacatggaatgtggaaggcggtacggcagtcagcaagtcgaccaaggctgccggcagcacctacgcattcaatgtgccgggaacctacaccattacaggcactcttgccgagagcagcaacttcaacccgggccgcacattccgcagaaccatcgacgtttcctgctccaacccgatttccggaagttggaaggaagcccattggaagggcggcagcgcgtgccaggtttctgcgtccggcggtgcttatgacttcacgattacggacaacgccaatcgtggcgtctggacggatcgcaacgagggcagtgcggtgtaccagcctgatgctctggacgtgaacgaaacgctggaaaccacggtcaagccgctcgacttgggcggtaatggcgatccgcgcgccggtctggtggtccgtaacggtcttgctgacgctaacggcggcaagggatatgccacgttacttgccagcccaagcggcatttacatgcagtacgattccaatgccgatggctacatcgataaggaaacatcgcatgttggtgccggcttcggcgaccaagtgcaactcaagctggagcgcgccgcaaccgataccctgaaaggctactggcgtgcttccgcgaacgatgaatggcaggatgtcgctacggtaacgctgaccggtgcggacgcaaccgggctcgatgccggtgtcttcgccacgtcgaacagcaatgccggcgcattcaccgtggccttcaacggcactgcgttcggttcgcagactgctgctgtggagtccatcgcggctaaggaccctgaagccactatcgccaaggggcagatgctcgcgcttcgggacgtgacggttaccgccacgctcaccaatggcaaaacgcgtgtgctggagccaagcgaatacacgctggaaggcttcgacaccaccaaattgggcgagcaaaccgtgacggtgcgtcttgtcgctgattcttcagtaaccgccacgttcaccgtgactgtggaaagcaaccttgcccggttgttctgctcgtccgctgcggcctcgaagtatgagccggccagtagctgggcctccgcttctacggccgacctgacttgcgacaacaacctgagcaccaactggtcgaactggggcaccggcgacacctcgccgtggctcagctacaccttcgataaggcatatcagctgggcaagctcagcgttgcggtggataaggccaagggcgaggccgctccgaagagcttcactgtatcgtacctagctgaagacagcgccacgtggactgatgccacgctgccggcagtcactgtgaatggtgctgctggagccgtgacggaagccgatgtgagcgctctgcccgccaccaagggcattcgcctcaacttcacctacgccgatggcaatgactatgccaagatcgctgaagtacgcatcgccgaaggtgaagcgacaccagagccgcagccgtctagtaacgccaatcttgctgatctgactgtggatggcaagacggttgacggattctccgcggataccactaaatatgccggtgcgctggctggagatgctgcttcctacccgacggtggaggcgactgctgctgacgcaaaggctacggtgcaagtggagcaggcttcggccgagaacaacggcgtggccacggtgactgtaactgctgaggatggcacggcgaaaacctacgcagtgacattcggcgaactgcctcagttggctgagcttgctgtggaagtgaccaaggattcctatcaggtaggcgataagttcaacgctgccgatgtgaaggtatccgccatttacaaagtcggcgatactgaaacgctgcgcaagctgattgatccaactgatggtgatctgaagttcactggctttgattctgccaccgcaggcacgaggaccatcaccgtctcttatcgtggcgtgaacgcgacgttcgaagtcacggtcacggccacggaggtcactcccggccctggagagcagaagcccggcgataccaacaatcctggcaacactgctaagcccggtagcactgccacgaataagccggctgctaatggcgctgcgcccctttcgaatacgggtgctgccgtggctgccattgcggtcgtggttgtggtgctggcagctgcggctggtgccttgctcgtcatccgcaaacgccgcgcataaccatggcaactgctgagtagcgtggattgcgttgctattgagcaatctgcgattcacgccactcagcgagtgcacccgagtgcgcccgagcttgcgcaatgcaggcgcaatacagtgcaaacagtacaaagcaacaataatggccggtctgagccagctgctccatgcgagggcagttggctcagaccggccattgtgtctgcaagtacatgcaattagagcatgaacatgtggaagccgttgagcgttactggttgttttgctttgttgttgcgctcagcagtgcgacggacgtccgcccgcagtgtagtgcagcgctccgtgaaccagcgccgatgtgaaatgcatgttgcacatgcccgcttcttctgcttcgtgcgtgcagccggcgatgctgcataggttcataccccgaatcatggtcataccccctctttgggatggcatccgtgccgccatctgccttcagagcatagcggacaattgttgcattgcctaggcggtacaacgctttctgtggcctgtatcacatccttgccggcgttctgcggcgtggttgggcgtgtacatgtgcacttgtgcggttttgttgtgtgtgatttgggtatacggatagagtttcttctctgcagtggcaagggcctctcgaccggcgagccggctgatttctcccatgcgttgctcaatgatttccgttttgcgagtctgaacggcaaaatagctctggagaagtgccacttcttctttcttcggatcaccgttttgagcaatgagatagcaggcgtatcgggagtgctgagttcgctggttttgcgtgtgatttcgtcgcggttcatgggtgtgtccttatgtttttcatgaccattttcgtgactccacgaaaatggtcaaagcgaataattgcaatggttttgaggtatgggcgcgctccgcccaactggtctgtcttcgtccgccttttcgaccagatacctcatggagcacaatgccaacgtcgctaccgttggcccagcaaatattcttagacgacgccccgaagtgaatatctatgcggctttcagaatatcaaagagcgtggagtgtgtgcattatgcgttccaaaaatagtttctagtagcgaattgtttacggtgtgagatattcttggggtgtttgcggcgctctgccgtgtggcgaatgggaatggatggtgctcttatgggatttgagcaggaagcagttagtgaactgtatgccagcgtgtggggcaatcgttcgacaatgcagagggaattcactcgtggagcccatggtgagcagttcgtgctccgggagctgtccatgaaggggacgcaaacgccatcgcaattggcatcggcgctgcaggccagttccggccgcatctccactgtgctgtcgtctctggagaaaaaaggctgggtcacgcgtgacattgattccaaggatcggcgcattattcgcgtgaatctcactgattccgggcgcgagcagtctcatcggatgatagaggaaatgcgttccgcgatttgctggattttctcgcaaatgggggagcggcgcacgcgcgaattcgttgacctggtgtctgagttcaccatatatatgtcgatttgccatccggggcggcctcggccgacggctgaacaagtgcgtgaggcattcgtggagcgggacaagcgcgtggctgaacacatggcagctaagcgcgcggagaactaatcggcaaggctaattgaggacgctcacagcgaacatacagaagtgcgtataatatctcacagtgtaagtaatcaaacaatggaaactattaagacatcgtgaaccgataatcaccgataacccagccaacttaagaaccaatcgtcaataaccaataaccaacccaaccaacacaaggggaaaccaatgcttcgcatcatgaaatacctctccaaagcggagatcggtcagatgctcatcgccctggtgaccatcgtcgggcaggtctacttcgacctgaaactgcccgactatatgtcagacatcaccacgctggtcgagacgccgggcagcgacatgaaggacatctggatcgcgggcggcaagatgctgctcatctcgctcggatccgtggcgtgtgccatcatcaccggctacatcgctgcgcgcgtggccgcctcgttcacccagcgtctgcgctcgctcgaattccgcaaggtcgagtccttcggcccggccgagatgagcaagttctccaccgccagcctcatcacccgttccaccaacgacgtcacgcaggtgcagatgttcatcaccatgggcctgcagctcatcgtcaagtcgccgatcatggccgtatgggccgtgtgcaagatcgccggcgaaggcttcgaatggacgctcgccaccggcatcgccgtggcggtcctgctggtgtccatcaccgtcatgatggccatggtcatgccgaagttcaaggtcatgcagaccctgaccgacaacatcaacctcgtggcccgcgagaacctcaccggcctgcgcgtggtgcgcgcctacaatgccgaggactaccaggaagccaaattcaccaaggccaacaaggacctcaccgagacccagctgttcaccaaccgcgtcatggcgttcatgatgccgttgatgaacaccgtcctgaacggcctgatgctcgccgtctactggatcggcgcttacctcatcgacgccgccgggctcaaggacaagctcaccgtgttctccaacatggtcgtgttctccaactactccgtgcaggtcatcatgagcttcctgctcatgagcatggtgttcgtgctctggccgcgcgccgacgtgtccgcgcagcgcatcatggaggtgctcgacactgagccaatcgtcgagaacggcaccaaaaccgccgccgacgtggccaaaaccggccagaggggcaccgtggaattccgcaacgtcagcttcacctacccggattcgcgcgaggcgatgctggaaggcatcaacttcaccgccgagcagggccagacggtggcgttcatcggctccaccggctccggcaagtcgtctcttatcaatctcgtgccgcgcttctatgacaccagccaaggccaggtgttggtcgacggcgtggacgtgcgcgactacgacctgaaggccctgcgcgacaagatcggctacgtgccgcagcagtccgtgctgttcaggggcaccgtggcctccaacgtgagctacggcgatcagccgggcgacccggcggaggtcgagatggccgatacctccaccccggccgggcgcaagcgcgaggccgcgttgatcgccgctggcgaggccgcggaaggtgccgatataccggccgagcagctgaatcgcgtcagggccgccgccgacgtggcgcaggccagcgagttcgtggcgcgcatggacggcgggtattccgccgcgatcgcccaaggcggatcgaacgtgtccggcggccagaagcagcgcctgtcgattgcgcgcgcggtgtaccgtcacccggaaatcctgattttcgacgactcgttctccgcgctcgacttcaagaccgaccgcgaagtgcgcgacgcgctcgcccgcgaggccaaggattccaccaagctcatcgtggcccagcgcatcggcaccatcatgaacgccgaccgcatcgtcgtgctcgacgacggcaaggttgtgggtcagggcacgcacaaggaactgctcgacaactgcgacgtataccgccagatcgccgaatcccagctcagccagtcggagcttacggcgtaggggggggcggcagcggtagctccccatgtcaggggctgagccgtaaagggaacagcccagtgggctgttcccaggcgaagacgagctgataagcgagcgaataaaacagcacagctgactgaggggtagtcgcgtacggcttctctccctccggcgcttcgcgccacctccttcatcagagggaggtcaatacggacttttaaggagtaaaacaaatgccaagaggaccaatgggcggcaggcgtgccgtcgaagagccccatgatttcggcaaagtcatgggcaaactcgtgaactactgccgcaactatcttcccgtcatcatcatcgcgctcatcctgggcgcggccggcaccgtctgccagatcgtcggcccggacaagctcaaggacatgaccaacgagatcgtcaaaggtctgcccgccatcgttaacggcagaccggtgatgaactcggtagatttcggcacggtgggccacatcgcctggactttggtggccctgtacgtgggctacgccgtgctcggctacgtgcaaagctggatgatggccaacgtcacccagcgcaccgcccagcgactgcgcgaatcgatctcggtcaaaatcaacaaactgccgctcaaatacttcgacaaggtcagctacggcgacgtgctgtcccgcatcaccaacgatgtggacgccatcggccagacgctggggcagtcgctcggctcgctgattacctcggtgacgctgttcgtgggcgcgctggtgatgatgttctacaacaacgtgatcatgaccctgtgcgccatcggtgccagcctcatcggcctgatcatcatgatggccatcatgaagtcctcccagaagtacttcgcccggcagcagatggcgctaggtgacgtcaacggccacgtggaggagatgtacgccggccacctcatcgtcaaggcatacaacggcgaggccgattcgatccgccgcttcgagaagtacaactcggacctctacgagtccggctggaagtcgcagttcctctccggcctgatgatgccgctcatgaatttcgtgggcaacttcggctacgtggtggtgtgcgtggtgggcgcggcgctcgcgctcgacgggcagatcgagttcggcgtgattgtggcgttcatgatgtacatccgcctgttcactcagccgctttcgcagtttgcgcaggccttccagaacctgcagcgctgcgcggccgccgccgagcgcgtgttcggcttccttgaagagccggagatggaagacgaatccggcaagcaggccctactcggcaagaactacatgggcggccacgaagtgaagggcgacgtggaattcagccacgtgcagttcggctacgagccgggcaagccgatcatccacgacttctccgcctccgtcaaggccgggcagaaggtcgccatcgtcggcccgaccggtgccggcaagaccaccatggtcaacctgctcatgcgcttctatgagatttccggcggctcgatcgcgattgacggcgtggacaccaagtccgtgccgcgctggaacgtgcacgaccagttctccatggtgctgcaggatacgtgggtgttccgcggcactgtgcgcgagaacatcgcctactccaagcccggcgtgaccgacaagcagatcgaggatgcgtgcaaggccgtgggcctcgaccacttcatccgctcgctgccggacggctatgacaccgtgctcgacgacaagtcgtcgctctcccagggccagaagcagctgctcaccatcgcccgtgcgatggtgcaggacgcgccgattctgattctcgacgaggccacctcatcggtcgatacccgcaccgaagagctgatccagaaggccatggacgcgctgaccgtggggcgtacgagctttgtgatcgcgcaccgcctctccacgattcgcgacgccgacatgattctcgtcatgaaccacggcgacgtgatcgagcgcggcacgcacgacgagctgctggcggcgggcggcttctacgccgacctgtacaacagccagttcgcactcgctgactgacggattgtttcctgcgttagcggattagcggattagctatactcggctcccctctccgaggggagccgtcagcgtagctgactgaggggagcaacccatcggtccacccgagggatgtgatactgatgatttcgtacattagtgtgtgaaaaagccgccgggaaaattgggggattgggcggcggtgcggttggcgttgagaatggcgcattcgaaggggaagtgagcgcgcagctgggtggccggggtggtgaacagggcggtggcgaggccgtcggccagtgtgacagggacgtgtgccgcaacggtgttcgacgaatcgtcggtatcgcggtttgccgttgtcgaggcattgctgccatgcgtcgatgtcttcgtggttatggcgctcgatggcggcgtgacggccacccatgtggcggctacatcgtcaaccggtagtccgtcgatggcgttgagcagatggtgaagttggtgacctgcggcgtcagaccagtggcggcggctgggggagctcgcgcagaatgcgccgtggctgatttcgaccgtacctacggcgttggccggatcggcaggatcttcaagggcgatggtgattggttcgtccgtgtgcactagcaaatcacccccggcgtcgatgacgtattgaatgggttgagggtgacccgcgccatcacccaacatccccgcaagcaaatccaccaaataccccttaccgcacgcgccgaaatcgagcgcgaccggtccgcgcgtcaccagtgttgtgccatgccgctcaacgtcggctgaccaaatggctcgtccgtggatcgcgcctgcatgttcagcggcatctggcgcaggcgtaaacgaatacgactcgtcatagccaagccgaatcaaatcctcgcccacgcacgggtcggtcgccccatcggttgccgcaaacaggcggtcgtacaggccaaacagacccgatgcccagtcgggaaaatcgaacgtgccgccatgtgcggccgtgcgcatccggccgacgatggaatcatcgcggaatcgagataatacaacctcatattcatggatgaacgagccaatacgatcgcgtatctcatcgtccaatacgctctcggtgtgcaccagtaatccggtccccaacgcatcaggaaaagcgtatacgtatggcagttgctcggtcagacttgtcatgcccactatcgtagagcgcatggtgtgccggtgtatactggattttgacactgtgtcaatgttgattcggaggttgtgagaatgggcaatgcgactacagcaagtgtaacgggtgtgcaagttgcaccggcgaagtcagccatcagagatctccccatcgccaaagtgtgggcgtttgcggtcggccagttcgggtgggcgctgctttccggcatcatctccaactggctcgtgtatttctaccaacctgaccaggagaccatctcccaaggtcagaccgtattcgtgccgcagggcctggtcgttctcggcatcgtgaccgtggtgggcggcatcaccgccttcgcccgattcttcgacgcgttcgtggacccggccgtggcgtctctctccgaccgttgcgacgccaaatccggccgccgtatgccgttcctgaaattcgccgccctgccgctcgcggtggtcaccgtactcgtgttctggagtccgatcaacggcaccggctgggtgaacgcggcgttcctgttcgtcaccgtgatcggctactacatcgccctcacgttctactgcacgccgtacaacgcgctcatcgccgaactcggccacgactccaagcagcaactcaccatctccaccgccatctccttcacttgggtggccggcacggccatcgcgtacgtggcgccggtgatttggggcgcgttcgtgccgatgatgggccgtatcaccgccatccgcgtgaccttcaccatcatggccgccgtggcgttcgtgtgcatgctggtgcctccgctggccatccgcgagaaggactacgtcaactcccagcccacctccgaatcggccatcgaatccctgaagcagacgttcggcgacggcgaattccgcaagttcgtatgctccgacgtggtctactgggtggccatcaccaccttccagaccggtctgccgttcttcgtgaccagcctgctcaagctgccggaaaccaccacgaccatctacttcgtgctcatgaccggcgtctctgtgctgttctatctgccggtcaatattctggccaataaggtcggcaagaagaggctgctgctggttgccttcgtgatcttcacctgtgcgttcgcatttgccggcgcccttggttcggccgtgctcggcttcattccggcgatggcccagggtttggtgctctcggtggtcggcgcgattccgatggccgcgttcggcatcctgccgcaggccatcgtggcgaatatcgccgacgccagttccaagaccaccggccaggaccgtcagggcatgttctacgcggcccgcacctttgcgatgaagatgggccagtccgtggccatgctgctgttcaccggcgtctccaccatcggcatggcgtccggcgcgggctaccgcatcgccgccgtgtgcgcggccgtgctgtgcggtctgggcggcatcgtgttcgcgttctacaacgaaaagaaggtgctgggcgtgctggagacgtgatgacgttgccgggtgccgccgcggtatccatgcggagcggtgtgggtgacttgccccgtctgcgacaccgaaacgttaccgtgtcgacacgcgtgcgacacttcggcgtcaaattgcgtttgaccgtactccgtactatattgttgcgagttgctttgcggagcaaagtaacatccaaggggctgtagctcagttggtagagcgcttcgttcgcatcgaagaggtcgcggtttcgactaccgtcagctccacgagaccctctgcattcattccaccgcagagggtcttttcatttgttttcgttgaaattctgccatctcgcgtttcaaggggctgatttggggtttgccggaggtctacttgcgtttcgaggggctgatggtcaagtagatacgccgccaaaatggcggaatagcgttgcgtcaaagccgtttgtatcggtgcttcaccggatgaggagccccttgaaacggaagtagacctccggaacatgtgaaatcagcccctgcaaagggagaatgcctcgatttcgccatggattgtcgtggattgctctgtggcatgggcaatactgggagtatgacaagcgcagatgagttgaatgagcagtatgacgctgacggtagcgtgacgcaagtgcctgaacgcaatgatgaagttcatgccggcgaatccgccgtcgcccaatcccgcgaatcggccgtgaccatccccgccggcaccgtggtgctcgccgccaccccgatcggcaatgtcggcgacgcttcagcccgtctggtggccctcttggaacgggccgatatcgtggccgccgaagacacgcgccgcctctacgatctcgcccgtcgcctcggcgtctatgtgaacggtcgcgtcatcgcctatcacgaccacaacgagcgcgacaaggccgacggcctgctcgaccaggtcgaaaccggcgccaccgtgctcgtcgtatccgacgccggcatgcccaccatcaacgaccccggcttggccatcgtgcgccgtgccattgaacgcggtctgcccgtcacctgcgcgcccggcccctccgctgtgctcgacgcgctcgccctctccggcctgcccaccgaccgcttctgctacgaaggcttcctaccgcgaaagcattccgagcgcgtgcagtatctgcgcacgctgttgcccgaacgccgcaccatcgtgttctacgagacgcctcatcgcattgccgattcgatggacgatctgctggacgcgttcggcccgaatcgcccgatggccctgtgccgcgaactcaccaaggattatgagcagattcgtcgcggcccgattgacgagattcgccaaagtgtgattgatgatccgccccgtggcgagatggtgctggtcatcggcggcgcgtccaacgaggaggccgaagcggccgcgcccagcacgttgagcgtggatgacatggccgtgctctccatcgaccgtgctttggaggacggcctgcgtatcaaggacgccatcgcgcaagtggtgcaggagcatccactggctgacggatcgttggccaatcgcaagcaggtgtatgcggctgtgctgaaaatcaagggatagcgcagcagccggcgattatctccccgttacgtttccatcgactcgaacaatatttccaacgcctgccggaccccgggcccaccacgctgcgagaccaattccagcaaaggtgcgtcggctttgggattggcaaccagccatttacgcagttcgggcacgtgatatgcgatgtgccagagcacggcaacatccgtatcgggcgaacatgccaccgcgggcgtaagtctgatgggcggttcaggcggcgcggtcatatccgagattgcgcgcgatgcggattcggatgagtgtgccgccgcctcgtggcgaggcaaccgttgcgcctgccgcaaatgccgtaaacggtgagcggcatggcggcctctgcgatggcctctgacaatgaaccccctcgtcatgcgcattgctccaaagccggttcgtccatctcctgctgtaccgattcaaaaaacatgcgtgcgcgtccggcgtacttgtgatgccgatgctccttgacgatttgcagacagtcgtttggccgaaactggtacgcggacatcagctggcacaccagtgcgttgacggtggaaggatcggggatgtcttcaggactcatcaccaggtcgcaagccgtacgggctggcgtggtgacaggcagcccgccgagcttgatgatttgctccggcaacgtcaatcttttgaatacgcggatacggcggctgacggatgccgagcggaagtgcgatgtggaaatcacgtctatggtactcggaaagtcggggcctcccagccatacccaagcggcggtcatcgaacacaccacagtgccaaacggggcgacctccgcgacgattttcgcgcgaccatacagtgtgcccgaatgctcgatccagtagccggcggaatcgtcgagcttatgtaacgtgccgaaggcggccagacggttaaggctgagcggtcccggcagatccttggtaaacagtatcggcggcaccgcaggctgcgcggttgccggcgaggcgactgttgtgatgtccgtcatcggacctgctgtgatatccatgaccgaacaatatgcagaaatgcggcttgcgcgccaccggataggcgaaaacggtggataagtgcataactttactaggtgtgcaaatgatgtggataactcggtggatattggcaggcggaagtgtgtgcggatgtgcgtgggcgtgcgtacggatgggtgcgcggatacgtgtgcgaatgcgtatgtggataagcgcgcaagaggtgtacagataagtatgtggggaagttgcgggtggataggtgagtgggatgaggatggcggcgcggcggctatccgggcgtgtccccgccgcgccggataatcaagccttatgagtcatgttttggtgaatgttgcttggccgtatgcaaacggcccccgtcatatcggccacgtcgcgggatttggtgtgccctccgacgtctacgcgcgctacgagcgcatgaagggcaatgatgtgctcatggtgtccggcaccgacgagcacggcaccccgattctcgtcgaggcggagaaggaaggtctcactgcccaggaactggccaaccgttacaaccgcgtgatcgccaaggatctgtgcgacctcggcctgagctacgacctgttcacccgcaccaccaccggtaaccacgagcacgtggtgcaggagatgttcaagcagtgcttggagaacggctacatctacaagggcacccagcaggtggcgattagcccgtccaccggccgcactctgcccgaccgctacatcgagggcgagtgcccgatttgccacgccgaaggtgcgcgtggcgaccagtgcgacgcctgcggcaacgagctcgacccggacgagctcatcaaccccgtctccaagattaacggcgaaaccccgcgcttcgagcagaccgagcactacttcctcgacctgccggcgctcgccgaagccaacaaggcatggctggagacccgcaagggctggcgtaccaacgtcatcaacttctcgctcggcctgttcaaggaagtcaagccgcgcgccatcacccgtgacatcgactggggtatcccggtgccggtgaagggctggattgacaacccgaacaagaagctgtacgtgtggttcgacgccgtgatcggctacctgtcggcctccatcgaatgggcccgccgccagggcgacccggagaagtggcgcgaatggtggaacgacccgagctgcccggcctactacttcatgggaaaggacaacatcaccttccactcccagatctggccgtccgaaatgctggcgtacaacggcaagggctccaagggcggcgaaaccggcccgatgggtccgctcaacctgcctgagcaggtggtggccagcgagttcatgaccatggaaggcaagaagttcagctcctcccgcggcatcgtgatctacgtcaaggacatcctcgcccgctaccccgtggacgccgtgcgctactacatttccgtggccggccccgaatcctcggattccgacttcacgtgggccgagttcgtgcgccacaacaacgaggagctcgcctcctcgtggggcaacctggtgaaccgcgtggccaacctcatcaacaagaacttcggcgagattccgccgctggacgaggattcgatgaccaacgaagaccgtggccttctggaagagagttccgccgcgttcgacgtggtcggctcctccatcgaaacccaccaccagaagcacgccctgtccgaggcgatgcgtgtggtcggcgacatcaacaagtacatttccgccaccgaaccgtggaagattaaggacgaccaggctcgtctcggcaccgtgctgcacgtggccgctcaggccgtgtctgacgcgaaccacctgctcgcgccgttcctgccgcactccgcacagagggtgtgggaggcgctcggcggcaccggcaccttctcgccgctgcctgagctcaaggaagtcgaggatctcgacaagcccggcttcacgtatccgatcatcaccggcgattacgagctcggtgtgaacgtgcacccgtggaagagcgaggcaatcgaggtcggcgccgtggtgcctaagcccgcgccgatcttcgccaagattccgaccgaggccgtggaagaggagctggctcgcttcgatgaagcgttggctgctcgccgtgccgccgaagccgagcgtctggccgccgagaaggccaagctcgccgccgaatgattcggcattgctagctcgtagctgacgggccacctcgcacatgaagtgctgcggggtggcctgttgccgtatgtgcggccaagccccgacagagcgaggccggttgtcggcgggcgtcacaaattcgtcacactccgccaagacttttcccagacaagcacatcaattcgccaagcatggagcggttatatagaagatgtcaacggaatgaagttcataccggtggcgaggttcttcgaaccccataactgaacccttcttctctcttctctctcacccggcggccccctccgccgggtttcttttttttaatgctgggaatgccatgggccgcatattgaaaaaaggattatggcagagtgctgtctgtttacaataaggcattgctgttctagaaaataacaaagaaggggggactgatgatgtataccgtcacattttcgggcaacctgactcaagcggaatcggccttggtcaagcgaggcgccatacagatcgccgcgttgctggccgcaaaaatcactggccgcgggctcatcatcaacgacggtgacaccgaatactcatgggatttcatcctggtcgatgccagcagcgatgagcggcacacctttgacgagaggctattgcggatgctgtccgactacatccacgccggtttccccgatgccgtgatccgccacatccagcacgaggcaccaaagctcagtaaataatattggtcgcgtggtgagtcccatacttccgtcggaatatcgctatcgcggtatggtcgcatgcctgttgagcattgaagcgttcgatctatgcgcagttgatgttccggtgatgacggcaaccgattgacgcgattaccgggacagatttcgctgtcccggttcgtgatttcggcttctttttgggaaccgggacagcccccccccttgtaaacgcccattatccgtaatcccaaaaccccggaattccgccgatgtacgatggcgaatattgcacggtggggtgataggtgaatgaaattttgtcttggttgctcaaaaaggggcgaaatggagaaccgggacagcgaaatctggcccggtccacacataaatcgattgacatcgctaccgggacatcggacacggacaccgagtcgcgcagcgtcggcgcaacatggatactgtacgactttcgcgataaacgttatattcttcgtcgcctcctccgggcgatctcatcgagtggcgttgccgtcaaagtgaaatcgaatacggcacctcgcaatgccaactgccgcccgacccggtaggcgagttcggcttgggatggctcatcggccatgttcgtggcagtggcgatgatgacgatccaatgatgatgtcgcagcagttcgcgcttgtcgttgtcccgccgccactggtttttgtcggtgcgatgatgatcgccgtcatattcgatggcgacgcgaaaatcgggccaagcgagatcgagcgttatcggcgcaccgttgctgaatgtcgcgccgggcaccgtgtaatttgtcacggctggcggaagcccgtatttcgtcgtcgcgatgcgggtctttgattccatcggagagtccacgcggggcgtaatgaatgcaagagcgatcatgcacttggattttgcgttgaatttcgggagtccagtgacttgccgcacgaagtcctgataaatgccgtcagcagtgcggccgttcgccagacccggcttgcgggcgattgccgtaaggattgcgtcgccaagtatgaccagcgattcgagcgatatatgagcggcgagttgtgcccaagtgtgtatcagatccagtgcgtacacatgtttgttgatacgcacattgtgcgcatcgctcagcggcttccagatgtgtggtgtcgttggcggcacgatggcacgtattcgtgtgcggtgtgagtcggagacggtatggagctcggcggggtcgatatcgcaatccttgggaagcggcacggattgcagtatcagcgatgtggtcatgccgaagagcaccggttgcccgagctgttgcgcggcgtccgtgcatcgtttaagcatttcccgcttacgttgggtgagggtttcgctcatagcgggcgcagtgggggttgccatacgcggtggtgagtatggctcgggcttgacggcgtgcgtggacgcagcactcggtgccgcggcattgttggtccagccgggtggttcatcgtcgaatacgccgggtggcggggtgggaaatccgctgttcataacgccaccgtagcgtagcggtcgcgtgttcgccatgaaaaacggggtatgtggttctagcttgctgaggatgtggataactctgtggataactaaagtgctcctatgttttgctcactctgtgaggagtcggcaaaacataggagcacttcagccgcggccaatagacggaatatatcagcggcagcgacgggtgaggggctgccagggatcgagctcgactggttcggcggcgagcagggcgcgggtggcgtcatcgaggtattccttgcggatgatgagctcggtaacgtagcggtcgaaccaggcgtcggacatgacgtagtagccgtccttgccggcgtccttgccccagctgttctccaccttccagcggttcggcttgccgtcctcgccgaggttcacgccggtgaaggtcatggcgtggttgctcgggctgtcgccgtattcgaggccgtgggccttgtcgccagtgaattcagtgccgaacagctggtcgacgcgcaccacggactggtcgaagaaaccgtccttgcgcagggcgaactgcgtgcagtcgcaggcgaaccagatcgggtggccggcggtgagctggtcaagcgcggccttcttgaacacgtccagcggcacgttgacgaactccatatcgccagcctcgaccacgttcgcgctgaagcggatgcggtagcgccggttgaacgggcggttcttgagtggggcgttggccagcgtcgcgaaatcgttgacgtccaccggcacgtacttcttgtagaactcaagcggggtgatgccgatctcgcgaatctgcgggcgctcgtccttgccggtcttgtccttgttcttatcgcacttgcacgccttggcgtcggacttgtcctcgcacttgcaggattcggccttgccgtctgcgtcggcctcggcgtcatccttggtgcgcgcgaagaagtcgaacttctccggcggctcgccaagcgacacggcgcagatgcggtacacggtgcccatgtactcgtccttcagcgtgcgcagctcgtcctcgccagcgcccgcagccgaacggcggcgcagctcggccgcgaactcgcgcagcttggagttgaggtactgcttgaaatcatcggaattacgggagttctcggactccgggtaggcgctcttgggcaccagaccgtacttgttcaccagcgcggcgaacatctgccaccagccgccgtcgtcggacgggccccagttgatggcttcgaacagacgcgaatcggtcgcctcgtcgagcgtgcgcagcacgttctccagataagtgttcgacttctccatcgcgtcccagaagaacaggtaggtctcggagaactcgaagtcctcaagattccagcgatgcataagctcgtagcgcagcgtgttcagggaggcgaacatccagcagcggccggaacgctcctgattggtgatcgaaccttgcttaagttcgatggagaagtcgcgcggcagcgcacgtacgccgcgatagtcggtggccgccttgagcacgccggccgaaaccgccgcgtccgccgcgatcaggttggcgcggtctttgttgaagtcttcggtgtacgtacgcagaagttcgggtttgatggcccgtgcgctggcgtttgctgtcatgatgattgatcttccattcatgtaggcgacgtttgtggtccgtcggtagtataagtcgccgtgtattcgtcgggcgattcaccgggcgaaatcgtacgggcggatatgcgccggcgattccaccccgccaacgatttgtccaccttgctgctcgcgcgggcgcacgtatcatatgtaccgatacatattgttgacgaatgtcgcatagtccaaaggagtacgtcatgacttcgctgcatagcaagccgctggccctgaaaaacgtcaccgtcaccgattcgttctggcgcaccgagcaggaactcgtgcgcacggctgtgattccctatcagtggaacgccctgaacgataacgtccccggcgcggcccccagctactgcatgcacaacttcaaggccgctgccgcgcaaaacaagcgtaaggatacccagggcaaggcgttcgtgccgccgaagtacacgttccgcggatttgaggcgctccccgaagacccggccaatcccgacccagacaagttctacggcttcgtgttccaagacaccgacttctccaagtgggtggaggcagtcggctattccctcgcccattacccggaccccgcactggaacagaccgccgaccaagccatcgacgtcgtgtgtgccgcccaactcgacaacggctatctggacacctgctacattctgaacgacatggatcgcgcgttcaccaatttgcgtgatcatcacgaactgtactgcctcggtcacctcgttgagggtgcggtggcctactaccagggcaccggcaaagacaagttgctcaaggccgcctgccgtttcgccgattacgtagacgagcgcttcggtcgcaagccgggccagctgcgtggttaccccggtcatgagattgccgagatggctttggtgaggctgtacgaggtcaccggtgagcaacagtaccttgatctggccgaatatttcgtgaccgagcgcggccggcagccgtacatcttcgatattcaggcagacgagaacgcaaagcgcgacgccgacgccaactacaaacccaacacggaccccaaccggtacgcctatcaccaggcgaacaagccggtcaccgaacaaggcgaagccgtaggccatgccgtgcgcgccggctacttctactccggtctggcggacgtggcccgactgaccgacgaccaggacctcgccgatgcggccgagcggctctggcgcaatatcgtcgataagaaactgtacgttaccggcggcatcggcggcacggtggacggcgaggcattctcctacaactacgacctgcccaacgactccgcctactccgagacctgcgccgcgatttcgctggcgttcttcgcccgtcgcatgctcgagctcgcgccaaaggccgaatacgcggacgttatggaatccgcgctgtacaacaccacgctggccggcatggcgctggacggcaagagcttcttctacgtgaacccgctggaagtcaatccgtatgcctgccataaagacagccgcctgcgccacgtcaagccggtgcgtcagaagtggttcggctgcgcatgctgcccgccgaacatcgcccgcatcgttgagtcggtgcaggaatatgcctacacggttgccgaggatggcggtacgctgttcacgcacttgtatatgggcggcgtggccaaagctgagctgaatggtacggctgtggagctggatgttacggcgaacctgccgtggcagggcgatggcaaggctgtcgtgcgcttgggcggtgacgctgctggcacctcggctcaggctcctgctcgctttacgctggccttccgtctgcccggttgggtgggcgatgagtccgctgctgccgccgcgattacggccacgggcgagtctgagtctggggccgatggttcccgcgtgacccgcgaaatccgcgacggctacctgtatctgaccggcgaatggcgcgacggcgacaccgtgacgttcgacttcccgatgccggtacgtatgctggccgccaacccgctggtgcgcgaggacgccggcaaggtggcgttcgtgcgcggcccgatcaccttctgcgccgaggaaaaagacaacggcgccaacctgcacctgctgcacgcggatacggaggcactattggccgacccgagcgcggccaaggtcgaggagttcgacttccacgccggcgccaagggcatcgacgacaagggccagggcgaggtggaagatgtgacccgccgcatggtgaagcttgaggtgccggcttggcgcgagccgttgccggctgctgtggccgccgcgggtgagggcgcggccgacgtttcggcgttcgcgccgctctacgccgtgtacgcgccggtcaagcgcgagcccgccaccgccacgctcatcccgtacttcgcctgggccaaccgcggcgaaaacgaaatgaccgtctggctgcgcggctgatatttgctctcggctactctggtagccatgggcatcacgacatgtcggctcgaagggccggtggacttttactcggtcgggcagtttgtgtccggaccgggctggcgccatctgcggcgcatcatcgacaccttcgagctgatgttcgtgcgtcggggcgtcctgccgatgcgggtgggggagcggaccctgcatatcgaggccggccaaatcgcactcttgccgccgaatgtggagcatgcgggcgccgacatcatcacgtctgacgtggacttctactggatgcatttcaaattgccggatgcgcgcatgctccccgatgacgcgggtctgccgcaggacgaccattgcctgttgctgcccgatgaacgcaccctgcccgaccccgaccggctggcggtgatgtgtgggcagctcatcgacatctatgcgcgattcggcccgtattccaacgcttactgcgattacttcgccaccggcctgctgctggaagtcagcgcgcaggagcggctgaaggcggacttcgccacccatcgtacgctcgccggctaccggggcgacggcaagcccatcaccagtgccgaccgcgtccggcagcaacaggaatgggccatgcatgtcgattcggccggtgccgctggcgatccgtccggcctggcgccgatgctggccatccgctcgtggattatggccaatgccttcgacgacatcaccgtggccaaagtggccgcgcgcttccactattcacccagctatctgaccgcgatgtaccggcgcgtgttcggcgtgggtgtggccgagcagatcatcgaatatcgcatcgaccgcgcgcgcgaactgctcagctccggcacttccagcgtggcggatattgcgcgagaagtgggctacgccgactcgaagtacttcatgcgcgttttcaagcgccgcactggcctgacccctggccaataccgcgacgccttccccgctcgcctctacaacaccgtgtgattagggaaggtcatggtcctaaccctaggaaaagtgcgcatgggcgccaccgccacatgggagcgctgggaacggtttgatgcatgccgaaacctcgcacgtcacgccgcacggcacttgggcagtgggcgcggcagtcgggaatcgccgccctatttcagcgtttcagcgttacctgtttgctgaaccgacggtggactcgcgcggaaccagtgcgtatccaatggtggcgcgcgtggccggcatgccagcgtattcgtcggacctgccgtcgccctggtcgcgctgctccacgcggcgggtgatcatatcgagcgcgaattgggcgagctgatcgagatccacttggacggtgctcagcgtcggtgtggtgtacgagccggccgtggcgccgtcgaagccgatgactctcacatcgtcgggcacgcggatgccgtagtcggcaaggcctcggattactccgaatgcggcatagtcgttaatgcagaagatgccatcgatggccggggtgcctcccgttgcccgcgtggtgcccggggaacgggactcagcagtgtcatcagccgattgcgcacgagcctcgagcatcgcctcggcgatggcatgaccggcttcgatgccgctgtcgctaccgtaaccaatgaagttcgtcgattcgtcatacggcagcccggcgtcaagcagtgcgccgctggccccgcgtagacgcaaaccgctggaactttccacgtgcgccagttcggttcgtggcgaatacccgtcgccgacaatggcgatgcggtggcatccgcattcgatgagatgctgcactgccgcccgcgcgccgtcttcgttcgggaaattcactgtatcgaacgtgggcgtttcctcgcaggcgtcaatcagaaccagcggtcggccgtggttgatcgcggaaagcggcacaccggcattcaggcccgaagcgtggataatctcgccgtcgaacaactgcccggagaacgggttgttggccagcgcgtgtttggcggcatccggagagtaccgggtttgctccacgaacggcgtcagcccgcgcgcggtggtttcggtgacgagcgattcgacgagtttggagtagaacggcgaatcgaattcgttgacgatgatgtggatgatgttgctgcggccggacttcagcatgctggccgtcagattgatgcggtaatcgagcttttcggccactgccagcactttggcgcgagtggaatccttaacacccggcttgccgtgcagcgcattcgaggcggtcatgggggagaacccggcggccttcgctacgtcgcgcaatgttggtttgccgctcggcataacgtcacctcatgtttcgcctgtgatgggcattggacaatgcccgtaatgcttccaatggttgtaacggtattcacaacatcgtgttttggcaaatggtggctgtgcgccggaatcgctgaaaatgctgcgcttaggcgatgacgcgccgagcgtaacatgcgcttgcttgatatcgttccggtggaagaatatgtaacggtacatacgtcggtgtgccaagaggccatgaagttcgtcgtacgttgggatgggactctccgggggagtggcgtcactcttcacctatccgtacgtgcgcgatgccgattggtttgcggctggcgtaccgccgtatggcaacttatgcgaatatcaacgaaagcaggatacgatgacggatcttccgcagagccttcctcaggcatggcgtccgccgatgggctggaacagctgggattcgtacggcacgactctcaccgaagacgagctgctggccaacgcgcggttcatggctgaacacctgaaaaacgccggctgggatacgttggtcatcgacatcgactggtacgacccgaccgcccgcgcacatggttacaacgacaacgcgccgctgattctcgacgaatacggccgtcagctgcctgacccggtgcgtttcccgagtgctgccggcggcaagggattcggcccgctcgccgccgccgtccacgaactgggcttgaagcttggcatgcacatgatgcgcggcatcccgcgtattgccgtggacaagaacctgcccgtatacggcaccaactacaccgccaaggacgtggccgacctcgaccacgtgtgcaagtggaatccggacaactacggcctgaaccaatcccacccgggcgcgcaggcctggtatgacgcgcagctcgacctgttcgcctcctggggcctcggcttcctcaaggtcgacgacatgcagaccccgttccactccgacgaaatcgccgcctatcatcgcgccatcgccaaagccgaagccaaatacggccgttcgattgacctgtctctctcgcccggcggctgggtggcgacgagctacgtcgacttcctgcgcgagaacgcccaaatgtggcgtatttccgacgatctgtgggaccgttgggaagacatctaccagcagttcgcccgcctggcccgctgggcgccgttccagaccaccggccactgggccgacgccgacatggtgccgttcgggcacataggcctgcgcgccgaacgcggcgacgaccgccaatcccgccttacgctggacgagcagaagacactgctggccctatggtgcatggggcgtagcccgcttatggtcggcggcgatctgcccaccagcaacagcgacgccatcgcgctgctgcagaatcccgcgttgcgtgaggtgcttgccggctccaccaataaccgcgagaccgtgcgcgaacggatttttggcaaatggtgggatgagagcacctaccgtggcgagttcatcgtctggtccgccgacgcagccgattgggctgatggcacacgttccgcgcatcacggcggccattacgccgcgctgttctggaccggcagcgacacatacgagatcggccgcaacatccagctccaatccattgtggggcttgacgcccgtaatgacgattggacgctatccgatctgtatgccgacgcgccgggcgagcccgccgacgtgcgtcttgaaggcgtgggtgccgaccgcgtcatcaccggcacgattccgccgcacggcgtgctctgggtggccctggaccgacgctgaaaccgaacctgcctccgccaaccaacctcctgaaccgaccgcccgaatcgtatggagaaacctgccatgaatgcgaacatcgcaaacgaacaatccccggtagctgttccgcccgcaagttggttcctacgtgcgttcgctggcgttctgacctgtagtctgtctgtctctgtctgttcgttgcttcgccttgcttgcgttttgtacgttttatctgtttcgtgagtttcgtgcgttctgcggatttcacgcgtttcgcgcagtgccgcacgctgatcaccattcagcgtgcggcacttttgcatatctcacgtgttgcgggagatgccgattccgtcgcacaatacgtaaaacgtgaatgaaccactcactatgctgggttgtttgagcgtgatatgacatgcgccactttcccgggaatgcgttgcgaattggacctgttcggaggtgtgcagcgacgcattccggggaatgttgcgcttagagagccgcgtatcgttgctaatgcggggaacacgcagagttgcgggccgttgcgattagacgcaggtcgcctagactagtacgcgtttgcgaaagtcgaacgtgcttcgaccgatgaaggagagcttcggtcatgcggccaatgacaggcgcagtgcgaagcacggctgatcgtgaatcgcggcggcagcgattgccgcgtgcggcgcaggagcatgccgcaccataccacaagcaaacaatccccaagaaacggtgatctcctcacatgtacgtcgatccgggaatcaataccagcgcaagcaatctcaaatgggtgctgccatactgcaaaccagacctgccccgcgtggtaggcgcgcttctactgttcatcgcaaataacacgatggccctgaccattccgattctgtccggtatcatcgtggaccgcgtcatcgtcggcggacatgccgacgaactgccacgtctgtgtggactgatgatcctcatgaccatcatccgcgtgggcgcgcgatacggctaccagatgtggatggagcgtttcggccagaactcggtctaccgcctcgtctccgacgaatacgagaagctgcacgagctcgacttcacgtatttcaaccacacacgcaccggcgacatcatgagccgcctgacctccgacaccgacgcgatccgccactgcctgagttgggtgagctatcagattgccgactgcgtggtcatgttcgtgggcgccctgtgcgtgatgttcgccatcgattggcgactcgcgctcgtcctggcctgcgtcacgccgttcatttttgtgctcacgcgcggcctgtccacgcacgcccacccgctgttcttcgccatccgcaactcgctggcctccctcaactccatggtcgaagagaacatcgagggcaaccgtgtggtcaaggcattcgtgcgcgaaccgtacgagaccgaaaagttcgacgagcacaacgacgattacatgcagtgcaacatggccttggcctacaactcgcgcaagtacatgccgtggctggacggcctcggcttctcgctgcagctcataaccctcggcctcggcggctttctggtcatcaagggctacatgaccctcggcaatctggtgagtttcaactccttcctgtggatgatcgacggcccggtgcgccagtccggctggctgatcaacgactggcagcgattcaacgccagctgcatcaaaatccgcaagctgctcaccgaacagccgcgcatcgtggagaagcccgacgcggtcgaagccgtcaagcaggcggtcacgatcgtcgagcaagtcaagcacgatgatgaggctaccggggctaccggagcgcccgtggcttccggaacatccggtgcccagcagtccaccgaacgcaagtcctgcccgctgcacatcaagggcgacatccgcttcgaccacgtcagcttcgccttcccggacgacccggagaccccgatcctcaaggacctcgacttcaccgtgcccgccggctccaagctcggcatcctcggcgaaaccggcgcgggcaagtccacgctcgtcagcctcatctcccgcttctacgacccgaccgttggccatgtgctcatcgacggcatcgacgcacgcgactggccgctggccaccttgcgctcgcaggtgtgcatcgtggcgcaggataccttcctgttctccgacaccatcggcggcaacatcggttttggtgccagcggtgatagcgacgaccgatatatccagaaaatggcccagatcgccggcgcggacaatttcatcaggtcgatgccacagggttatgacaccgtcgtgggcgaacgcggcgtgggcctgtccggcgggcagaagcagcgcctgtcgctggcccgcgcgctcgcggacaatccgtcgatcctgattatggacgatacgacctcggccgtcgatatggagaccgaggcggagatccagaagcacctcaaggagatggacggcggcaagaccatcgtcgccatcgcccaccgcatctcgtcggtcaaggattccgacctgattctggtgctcgagcacggacgtatcgtcgaacgcggcacccacgccgaactcgtggccgcacacggccgctactgggacatctaccacaagcagctcggactccagtccggcgtcgcacaaggtttttagaagaggacttatggcacaacgcaatacataccgcgaggatgaggaactcgaggagcagatcaacttccgggacatcctgcgcgtcggcaaatatctcaaaccgtatatggcacaggtggcgcgcattctcgtcgtcgtcatctcgatgagctgcatcgtcgtcgccgtgccgtacctgaccaagatcatgatcgacgaggcgatcccgaacaaggacctcggcaagctcggcatcctcgccgtgatcctcgccgcgctgatcgtgctgtacgagttcgggctgcgctaccgcacggtggcgatcacgcgcgtcggccagctcatgctcaaggacatgcgccgcgatatcttcacgcatatccagacgctgcccttcagctacttcgattcgcgcccgcacggcaagatcctgatccgcgtggtcaactatgtgaacacgctttcggacacgctgagctccggtctgatcaacgtgatctccgacgtgttcaccttcgtgatcacgctgatcgtgatgttcgtgatcgactggcagctggccctgtggagcctgatcctgttcccggtgctcatcatctgggtgcgcgtgctgcagatcttccagcggcgcgccttccagaagctctccaacaagcagagcaacctgaacgcctacatccacgagtcgatcgccggcgtgaagaccacgcagaccttcgcacaggagcaggcccagttcaggaccttccaggaacagcagggcgaggtgcgttccgcgtggatgcacgccgtgcacatccagttcctcatgtggccgggcgtgcagaccatctccgtgatgaccatctcgttcatctacttcgtcggcgtgatgggcttcgggggcgtgaacgtgaccaccggcgtgctcatcgcgttcgtcggctacgcgaacaacttctggaatccggtgatcaacatcggcaacttctacaaccagctcatcacctgctcggcgtacctcgagcgcatcttcgagacgctcgacgtcacgccggagatccgcaacaagcccgacgcggcggacctgccgcagatccgcgggcgcgtcgacttcaacgacgtggtgttccgctacgagaaggacggccgcaacatcctcaacctcgtggacttccacgtcgaaccggggcgcacaatcgcgctggtcggcccgacgggcgccggcaagacgacgatcatcaacctgctgtcgcgcttctacgacgtgtccgagggctcggtgacgatcgacggctacgacgtgcgcgacgtgacgctcgcatcgctgcgccggcagatgggcgtgatgctgcaggacaccttcatcttctccggcaacgtgcgcgagaacatccgctacggcaagctcgacgccaccgacgaggaaatcgaggcggcggcgaaggccgtgcacgcgcacgagttcatcatggaactgcccgacgggtacgacacggtggtggaggagcgcggatcgaccctgtcggccggccagcgccagctcatcgccttcgcgcgcgtgctgctcgccgacccgcgtatcctgatcctggacgaggcgacgagcaacatcgacacgcgcaccgaggaggcgctgcaggccggcctgcagcatctgctcaaggggcgcacgagcttcatcatcgcgcaccgcctgtcgacgatcgagaacgcggacgagatcttctacatcgatcacggccagatcgtcgagcacggctcgcacgcgcagctgctcgccgccaagggcgcgtactaccgcctctacgaatcccagtacgcgatgattcgcgtggccagtggagcgccggaagagtgacgagatgttgcgcacaaggatgcgtttagcggcgtttcacatagcgggtgctgcgaccggcaccgattttgatgatcgtaccggagtccaacagtgatttcagcgtgcgctcaatggtggtggtgctggtatcgggcatgcgagcgagaatatcggccttggagagtggaactagggattgatcaagcagtgcttcaatccgcgttcccttggtggctactcgcggtgctccctgcgctctgccgcctgccgtgagattgatgcgttcgtcgaattccttgcacgcggacagtatgatgccaagcaggtagttcgtgaatggcgcataatcattggcgttgtcgtcccagccttgagtgcttgcgtccagcgcctcataataagtgcttttactttgctcgataaggtgttcgatactgatgtatttgccgaccatatagccattgcggtacagcatcaggagcgtgagtagccgactcatgcggccgttgccgtcattgaacggatgtatgcagatgaaatcgagaatgaacatggcgatggcaagcaatggatcggtatgtccatctcggattgcttgcgtgtaggcggaacacgcgcgttcgatcagttccggtgtgacaagtgcggacggcggggcgaatcgcacggtgctggtcccgtgtgcatctcgttcgatgatgacgttgtcactgtccttgaaatgccccgcaaaggtcagtggtgtgtgtcggaagaggtcgcggtgcagttgaagaatgacgttcggggtaatcggaatatagtcgtggctttcgtgaataaccgatagcgcgtcacggtaaccggcaatttcttcttcattgcgattgcgcggtgtgactttctccgagacgagatcgttgagcctgctatcgctggtagaaataccttcgatgcggtttgaggcatctgtgctttggatgcgcgcgacggcaaccagcgtccccaatatatccggtctgatcgttgtctgtatgctttgacgcccttttgcctcgtgaatagcggcaagcaaactcgtggtgtgcggggtgagcaacgtcttacctgattctatgtagtcgaatgatctcatactgcctcattttctgcatcatacgaacttttctgcatcatattttatcaaaatgaggcagaaaatgggctgatgagacagaaaaggcggcaggatggcggccgtctcgcttgccggttgcgttactttcccgggaatgttgcgctcgtggcaagaaacggcaagttcaggcggacgcgaccgacgatacccgtcgtgtagtcgaacgtcttaccggactgccttacgagcgttgctggcggtagcctacactgagaaaccatgagcaagcatcaccatcgcgaccgtagctgggccccggcacctgaagcattgccggacgacgcccagaccattgacaaccacactcacgtggcctccgtaatccctttcgcgcgcgctatgagccatgaggcgcaggagaagggacagcccgaagtcccggtgtacgacgtcgaccaattgctggcgcaggcgcaatctgtcggcattgggggtattatcgactgcggttgcgagctgccgcacctgatgaccgccctccagatggccctcgatcatccgggtaatgtgcacgcggcgctcgcaatacaccccaatgagtccgtgctccacgggcatcgtggtgtgccggggccggatggtctgcccctcaaatacaagccttaccatgacacgtctttcgaggacgcgctcgccgaagtacatcgcctcgccaccacataccccgagcaagtggtggctatcggcgagaccggcatggacctcttccgcaccggcgaaggtgccaaggaactgcagcgcgaggctttccgcgcgcatattgccttggccaaggaactgggcctgcccatgcagattcacgaccgcgactcccatcgcgaggtcatcgaaaccctgctggccgacggcgcgcccgaacgcaccgtattccactcgtattccggcgaccgtgagatggccgagatcgcgcgcgaacatggctggtatctgagcttctccggcaccgtgagctacaaaggcaatgacggtatccgcgaatcgctacggattgtggggctggaccatgcgatggtcgaaaccgacgcgccgtatctgacgcccatgccgtatcgtggccgcaccaacgcgccgtacatgattccctacaccttgcgggccatggccgatacgctcgacttgcccatcgcggatgtggcgcgcggcacccgcgataccgcccgcgccgtatacggactgtgagggccgggtgtgcggccgtcgcggcgatgtgttgacttgtaaaatttgtcagaattgtgaacgaggtctaccatgatgtacctgacataagcgagggggatgatctccacctcaatggaggactgaacgtatggctgagtcgaaccaaaggaccgcacgcgcccaaaaagcctcaaaggcccagacagctcaggctggcgccgccaaagccaaggcccgacaggaagaagaagcactgctgagggccgacacctttaccaacgctcccaaggtgtcccgccgcactctcaccaaggaggagcgcgaggcactcgccaagcagagagaagctgaaaccaaagaagccgagaaaatcgccagcgcatggtcgaaaggcggcctcggtcgatggtgggcccgcctgcaatccagcccagacaaggtcacctggggcatggcgatcgtggcgctcggcgtggtgtacggcgacatcggcacctcgcccttgtacaccgcgcagaccttccttgccggtcagggagggcttggcagcgtagaccgagaggccgtgctcggcatgctgtcgctggtcttctggtcgattacgctgatcactaccgtcaaatatgtgctcatcgccatgcgcatcgacaacaatggcgaaggcggcatcttcgcactgtactcgttgattcgcaagtacggcgcatggctcgcgattcccgccatgctcggcggcgcggcattcctcgcggattcggtacttaccccggcggtttccatcagttccgcagtcgaaggcttgcagaccctgccgccattggaagggttgttcgacgaaaacccaagcctgaccctgatgatcaccgtcgtgatcatcgtgattctcttctccgtgcagtcgcgcggcaccgaaagcatcggcaaagtattcggctcgatggtgctggtctggttcggcttcctcgccatcgtgggcgtcacgaatctctctaacgactggtctgtgttcgaggccctgaacccggtgtacggcatcaaattcctgttcagcccgaacaatgctgccggcatcgcccttatgggcaccgtgttcctctcgaccaccggtgccgaggcgctgtactccgacatgggccacgtggggcgcggcaacatctacttcacttggccattcatcaaggttgcgctggtgctcaactacttcggccaaggtgcgtggatgctggccaatagcgataacccgcaatacactgcgatggagtcactcaacccgttcttccagatgatgtctccgaacgtacgttatctggccgtgattctgtctgtttcggccggcgtgatcgcttcccaggccctgattaccggcgcgttcaccatggtctccgaagccacccgcctcaattggatgcctcatctgcaggtgcggtacccggcccgcacgcgtggccagctgtacattccggtggtcaacggcgtgctgtgcgtctccacactggccgtactcgccatcttcaaggattcggaacacatctctgccgcatatggactggcgttgaccattacgatgatcaccaccaccgtgttgctcggcgtccacctatggcattccggcaagcgggtcggtgccatcgtgttcaccgtgctgttcttggcgattcaggctatgttcttcatcgcgtctatggccaaattcctgcatggtggttggttcaccatgttgctgaccgccgcgattctgttcgtcatgtacacgtggaatgagggcaccaagctcgaacgtgcgcaacgccgtcacatgcggcccaacgacttcctacccgcgctcgacaagctgcacagtgatttccgcatcccgtattttgcggacaacatcgtgtacctgacctccgactcggaaaccaagcgactcgacacggacatcttcttctccatcttcgccgaccaccccaagcgcgcccgtgcttggtgggcagtcagcgtggaaaccaccgacgagccgttcacccgtgaatactcggtggaggacttcggcacgaactacatctaccgcgtgcgcttccgtctgggattcaaggtttcgcagtccatcccggcgtacatccaccagatcatgcacgacctgtccaaaaccggcgaactgcctaagcagaagtcgatttaccccaaggtcgacgccgatccggacatcggcaccatccgttacgtgctgattcacaaggccctgatgccggaatccaaggtttctgcacgcggtgccctgtcgttgcaagccaagtacgcaatccgccacatggccggctcgccggttaagtggttcggtctggcaccttacaacccgttggtcgaggtgcagccgctgttcgtctccacccgccgcccaccgcgtctgaagcgcaccgatacggccaagaccatcccgacgcccacgccgactcgtgcagtggccgacccggccgccgtccctgacccgatggacaccacgtccgggcttgggcgattggtacaggagctcgatgccgccgtatcggccgaggcgcggaagaccgctgaggccgctgccgccgatgcgcccgctgagcagggcgataagggcgataagggcaaggccgagaacggcaaacccgccgccaagcctcagcgctccgccaaacagaagcgataacataccagtttgcagcggcgctgatgcgctctataaagaatgcctataacagtcgccgcacgtcgccacacggtttcggtaagttgaaataccatgtgcagattactgggatacgcgacggcaggcttcaacctgagtctcaacgctgtgttggggcaagacaatgtcgaggatttccgtgaactgtctgaaatccacaatgatggctggggtgtagcccagctttccgatcctgccgaagcaccgcacgtgcgcgacggtggcgcacccaccccggaaaccggcacccgaatctacaagtcgaccatcgcggcccgtcatgacagcacgtttgaggcgctggccgacgaaccgtctcgcggtgccatctggcacctgcgcttggcaagttccaatctgccgctcatcatggagaaccagcacccgttctatgcgaacggcctgagcttcatccacaacggcgatatctcggacgccaatggccgcaacatcgtcaccaaccgctcatacccggtgaaccacagcgtgttcctctccaccggcggccgttccgactccgccatcttcttcgcggtgattctggaatacatcggcttcggcttctcgctcgacgaggccgtggcccaggccgtgcgcgaactgcgccaagcctacccgaagtccagctacaactgcatgattcagtccgaggaccagctcatcgccctgtgtgccgccggtcgtgagaagaccagcccgcgcatcgtggaaatctacgatgagtacggccgtggcgagcaggccgccgactaccgtgtgatgcgctaccgtgagctgcgcgacgacaacggcgactccgccggtgtggtggtctcctcttccggctacgagcaggaaggctggaacgtgctggagaacgaccagatgatcatcgcctccaaccgcaacggcacctaccgtctccgttccatctgaaatagcttcataagccccctctgacgaaggggctgtcagtcgacaggctgacttgggggagagacccctagagcctcaaatcatccgcatcccatacttctccgccaacgccggaatatccggcacgccatacttggccaccagatccagccatcgctgtttgttctctccgccaaatcgctcggctcgggccgtatacgcctcgacctgcaggaacttcggcggcactgacttgctatggaacttgtcggcgtacatcaccacttcctgctcgagattcatcggcacatagtcggctggtggcaacggcagctcctggcgcaccacatcctcgcgcgtaagtcccacgccggtatggttgcggcagaactgggcgatggactcgtccacgccctcgtcgagcagatactcgtagcccttaagaccgtgcagaatgtagcgtttcttgctgaatttgagcggttcgccgtcagagccgtcatgcttgaacacgcggtaggtgccgatgtcatgcagcagtccgccgatgagtaccaaatgctcgtcgagcagacgcggcggcacatggccgccggtgacgcctgtggtgggcggtacctccgcgtccttcggtaatgtgcagcggcgcgtgaacagcgcgttctgccggcgcacgatctggcagccgatggtcgctacaatcacgcaatgcgtgtgcaccagctcgtacgccgccttggacggcgcgattttgcggtgcaattcgtcgatctgctccagtgtgggaatatatccggtcataattatcaggtttcgcctcgtacggtcagatttatcctcagattagcgcggcaatgagccgcagcattgaaaaacccctgcgattcggcaatacgaatcacaggggggctctatggtctgaacatcagatttcgaagagtgtgtcggctgcttcggcgatttcgcgcgacgcagtgagcacgataacgcagtgcttcgggtcaccggtgtgcgccagcttggccagcgcggcgaacacggtcacctcgtcatccgcgttcagccctcgtgtcggctcgtcgaggatcagcacctcggcctcggtgctgattgcacgggcgatggccaccaaacgctgctgcaccaaaggcaatgtgccgacagccacgccgctggtggcctcagagaagccgaccttggccagcagttcgcgggcgatcaccggcttgggcttcaggaagttgcggttggacgcattcatggcgtacagcacgttttgttcggcgtcgagcttcggctgcacggcgtgcagctgcggtacgatgcccagacggtggccgcgcagttccacgggctcgagctcaacaatgttggcgctcttgttcatcaccgtgccagacgccggcgtggtcaaaccgctcatcacgcccatcagcgcgcgacgcttggcgtcggcggtgatacccgaatcggggtcgtcgctgatcagcagcgcgtatgcgtgtccggaatagcagaagaaattcgcgccatcgaggatgttgaccttgcccttggggccggcgaccgtcaccttgttcagggcgaaggtcgggtaggtcttgagcagaatgtcgtcagaaccgccgcccaccaacacgcgatcgatacgcgaggccagcgtcatggtgggttcggacgctttgccctgaggctccgcatgctcggccaatgcgtctttgtgatcggttttggccagtcggagtgtttcgttgacgcgggcggcattgcgctcggtcacttcggcggatgcgttggccgaagcgatggcgtctgcttcggcctcgctggtctcgtcggtttctccggtctcggcagatgccagtgcgctgtaaataccatcgtcaacagtgccttcgtcatcaacgtcatcgaaggtcacgctgaactgcatggagtcagctggaacggattcaatggcgtcgttcgtctcagtctcagaagtcacttcgtcagccgttgcgtcagtggtcttctcgagttcctgatcgttgttcctgtcgctcatgcctgtgcctccgcatcgtcggttgtggtggtcgtcttgttggtctcgctcacggtgccccagtcgccatcggcggcaaacagcttgtccgcgctgaagaacgcaaggcgcagggcggcaagaatcgcaaggatcaggattgaacccagtccataccagaccatggtccaaatcaggcccgatgtcaccggggtggcatggccggatgccagggcagatccgatcggattggcggcgaacgcgcctccgaccagaccaatcacgtagaagggcagggtgacgatgaacacttccagcatgaactgccatcccaaacgcccgcgagtgacgccggacaccagtgccatgccgatctcgtcgtcacgcttgggcgcccacacgcccgacagcacgaggatgagcaacagcacgccgcccacggcaaccaacacaatggtgccggtcttcgcgcgcgaggatagcgtatccagcggctccagagaagcgttgtaggattccagcgaaggggaagagaactcgtaacccttggcgggcagcttggatttcttgagggtggacaccaaggacttgtatgtagcggaatcaccggcgtcgaacaccacgtccagatccggcatcgcccagccggaggcggtcttgtcgttggactgtgggtcgagtccggccttggcgaaggtctgatagttggtgaagatcgcgttctcgcggttgcgggcggccgtcaccggattggcgacggcggattcggatgtgtacttgtagatgccgcgcaccttgagctcggccgtggtctgggcgtccgaggcggccgccgccttgagcgtatcgcccaccttcaggttgttggcggaggcaaacgcttcagagaccagtgcgccggtggtgttcgggttggaggacttgttgtcgtagctcaggtccttgccgtccacgatttcgaaggtaccgaggtcgctggccttggcggcatcctcggtccagaaggctcgccaaatgagctggccgccggtctcgtcatcggaggccgagcccagcgatccgccgtccagggccttcaaatcaccgctcacgcgggccggcacggtttcggtaaccgtgaagttcaacgagttggtggccgactggacgagcgtggcgtattcggtgtatgaggtccacgtcatgtaatgcttggtggaagccgagtccgtagcggagaccttcttccacgtagccgcagtcgggcgaatggccaacgtggccttctgctgatcgtacgcggtggtgtgtgcgttggtatcttcttgaatgatggccagtccggcgactgtgccgaaggtgaccgccaaggtgatgaacgcggtcagggccgtacgtcctttagaacgtgtcagggcccgccaggcgttgctgaggacgaacatgtaattacctctcccgttctcctaagccgaacaaatcaatacggctctaactattgttgcgtttagtgaccgttttcttgcgcaatactgttatacccctcaatgaagtctgagaacattctgacagcgatgtggtggtcatgcggggatttgcacccggtatgggataaatcctcggtctatttcggtggcatcggtacactggcatgagatatgcgtggcgtcacgtgtgctccggcatgtctgcgattccggatttgcccggagtccggcatccggaagcgtggcctcgcgccgctggataagagtatgagctgagcagattttcgggcagggtaagtatgcgattcacttcagggcattcgagccataaggctgtggggcgtaggagaagacgtcatgccggtaacggaaaattcaatcgctccgcatctacgaatagcgctgtgaatcagcagacgggtcccgtaaacctgaagactccccagcacgtgggtggtaacggccgttcgctgatcagccgtacgccgatatgggcgcgagtggtggttgtactgctgctgacgttgctggccagcgtcacctgtgtgggcacgctctacgcggcatccgtctcgagaatggccacggatgcgcagcgcgtgctgacatccgccgaaagtctggccaattcggcacttggctgtggcagcgataagagtctgtcggacatctcccaagagctggtcaatgccaccaatgatctcaatgcggagctgaacggcccacagtgggacttcttccgcgaccattcgcgattcggaagcgacatcaccgccgcccgcgaaatgctggcttccgtggatacgctggtcaacggtccgttcactgatctgctgaacctgtccaaacgattgcagggcttctccctgaagaatggctcggtggacgtcagcgccctgatggatatgccggatatcgtcaagcaggcgcataaggatatctcgcagcagctcaccaagctcaacaaggtgccgactccgagcgtcgccaaggtggccaccgtgctcgaaaccgaaaaggctgcgctcaagaccgtggattcgatgctcggcgaatacgatggcctcattaacttgctaccgcaactgcttggcgaggacggcaagcgcacgtatttggtgatggtgcagaacccggccgagctacgttcggcgggcggcatggtaggcaccatcgccgcaatcacggcagataagggcacgattaccatcggtgatttcgccaccacttctggttgggacattcctgaggagccaatggatgatacggtgctgaaggagcgccaggtatttggtggcacttttgaccagtacccggccaccacgaccatcgaccccgaattccagcgtgtggcacagatgaacaaatacatgtggctgtatcagaaaggcaacgaagacgagaacgtagcgggtgtattgtcactcgatcccgtatttctccaggcattgctgggagccacaggcgaggtcaagctttcggacggccgagtgctggatggcaccaccacggtgccgttcttcgcttcagacctgtacacggattacccggacttcgagcagcagaacaacttcgtttccgaagcggctcaagcaattatgaaccatgtgcttggcaacgcgaatgcctctaccgcatccccgctgttgaaggcaattagagataccagcgctagcggtcatttcaagctatggatggctgatccggatgagcaggaggcgctgattgccaccggacttatcgacgataaggccagtggcgagttgtctgctgacagtcaggtgcccgaagccggcatctatctttcggagctgcagcaaggcaagcaggattggtatctgaagacctccaccacggtcacaaaaacctgcggcgacgcctcagccagccagaacgccctgtattctggcgtgctggataagcgcatcacgacagccgtgcgtaacacgcatctgggtcagtttacggaagatcagctcggtgacgaatacacggtcaccttcaccatgaagaacacgctgactaaggctaaggccgaatcgttgcctgatttcgttaatggcggctcggagaatccagtgctcggcggcatgttgtaccgcgtggtgcttaccgctccgtacggtggcgagatcaccgctgtgcaggctgatatagattcatggggtaccaacaccgcgagcctgtatgaccgtcagtacattatgttcaaccagcagtggatcgagcccggaaaagaattgacgattgcttataccgttcgggtcagcagcgatgccacacatccactgaacgtggtaaccacgccggtggtgaatgcggatggcgtcgagacgggctccaacggtaatgtgaccgatgagtgcacggcggatacgaacggcgccgatggtgcgaacggtgccgatggtgcgaacggcggcgcggacggcggcaagaacgacgcgcataagggcgcgtcctccgatccctcggccggcctggacaccttggacaagctgaagagccagatcagctgcccggtcgatctgaagtccctgacgggatccatgtgatgaccatgcccgattccgtttccggcgtcgccgtttccgacgccaccgtttccggcgtcgccggcaggccgcgcgacgtgaactacgatctgctgcgcgtggtggcgatgtgcctggtcatcggcgtccacgtgatcaacaactacatgcccgtcaagatgaccctcgccggcagcgcggaaacggtgcgatccgtgctgttcgcgttgttcatggtctgcaatccgctgttcattatggtgtcgggccggttcaacctgacattcgatgccgaccggccggtgagcacccactcagcgggccgtctgccgggctctggctctgatgcccgggcaggcggcggtgccggccaagccgatcccagcagcctcgcgccgtacgtgcgctactactacaaacgctttgtctcgctgattgtgccgtatctgctgtacgcgggcggcatgggattcgtcgcctacctggtgatcgatcatcgttcggttggcggcgctgtgtctggaacgttgtttgatctgttttccgggtatgacgattccgtctattggttcgtattcatgctcgccggtttcgtgttggcgacgccgtttctggccgcgatggtgcgcgcgataggccggtcgggtgcctggctgctgatcggtctggccgccgccgtggccgccgccgagcagatctgcaatcttgccggatacccgttgacgttcctgcagtcattcccctggcggggactgctggtctactatctgttgggattcgtgttggaatactatccgccgtccacgcgggcgcggcgcggcttgtatgcgttggcgccgttcgccctggcgtggaccgtcgccacgccgtacctgttcgccggccagcagatccaggtgggccgcacgctcacggttgcgttcgcgatggtggtaatggcgacgttcctgttcttccggtacgacgtgcacatcacgtcggcgcgggtgtgtaaggcgattatctggctggccggatattcctacacgatttacttggtgcactcaccgctgtccaaggtgctgattggcccgaggatgcctgtgcctacagatggatggtcgtatgcgggtatcagcgtgctgatgtttggcgctacgttgctggcggcgctgctattcgcggtgattgccgataccgtggtgcttaagcccgtgcagcgtctgctacggaaggtcgccccgccgcggaagggccgcccgtagcagacgtcgtttcactgcccttgcgcgcggtagcgggcctcggtggcttccttggccggcgcccaccagccgcggtgttccgtataccagtcgatgacgttacataatccgccggcgaagtcggtgtgcatcggcgaccagcccagttcggcgcgcagtttggatgcgtcgatcgcgtatcgcctgtcgtgcccgggcctgtcccgcacccagtcgaacgcatcctccggctgacccatcagatgcaggatcatgcgcagcacggcgatgttgctcatctcgccgtccgctccgatcagatacgtttcgccgatgcgcccacgggtgagaatcgcccacaccgcgcgagagtggtcttccgtatgtatccagagtcgcgcacgttctggccggtgccgtacagtttcggccgcgcgccctccatgatggaggtgatctgccgtggaatgaacttctccacatgctggtacgggccatagttgttggagcagttggagatggtggcgcgcagaccgtatgtacgcacccatgcgcgcaccagatggtcggacgccgccttcgaggcgctgtacgggcttgaaggacggtacggcgtgtcttccgtgaaacgcgccgaatcatccagcgccagatcgccgtatacctcgtcggtgctgatgtggtggaagcgcacatcgtgtttccgggcggcctccaacaaccgcattgtgccttccacattcgtgcggatgaacggttccggatcggcgatggaattgtcgttatgcgattccgcggcgaagtggactatggcgtcatgactgggcacgatacgctccaacagcgcgacgtcgccgatgtcccccacgacaagatcgacctgcgacgatggcagaccggcgatgttctccggattgccggcgtacgtcagcttgtcgagcacggtgatgtgcacatgcggatggttccgcgccacgtatcgcacgaagttcgcgccaatgaagccgcatccgccagtcaccagaatattacgcggctcgaacacgccgctgcccgccatgctgttcaccgttccagcataccgtcgcatgccaacggctgggggcgtttggcattgagatggcaggggcgaggtgcctcatttgaaaatgagcgcgaagcccggagtggtgcctcaccggtggtgagcgcgaaatcctagtcctcgtcggcttgcggggtttcgccttcttccggttcgacgcccgcgatgcgggcgagcgtcttgttcaagtatgccatgtcggggccgacgcgtctggcgagccgtgcggtgcgcggcgcggcgcatgactcgaccgcatccttgaccgctgccgggctgaccggctcacgggagaacacggccacgtgcgcggccaccggacggtaggcctgctcgcacgccatcgacgcgacgaacgccttcagcccgcggctggccttctccttgggcatgcagatgcccgtgtcctcgaacagcaggtagcgggggggccgccgtccggcccccggtaacggcgcacgcggaactcgaccgtccccgcgatcgccggcagccgcttcgtgctgcggcccgaagccttcagcgcgcggtcgcgcgatcggaagatctcgtcgtcgcgggccgtgagcctggctggattggcaacggtgtgttggactgtttctagagggtttttccttgttgtgtgaactccacggggctcaggtacccgagggtcgagtggatccgttggtggttgtaccaccacacgtaccggttgacgtccgagcgtagttgctccacgttcgtgtagacgttcctgtggatgagttccttcttgacgagccggttggtggattcgaccaccgcgttgtcgtatgggttgccgggtctggaaagggaacgtgtgatgccgaacacgtcgagcatgcgttcgatgcgttccccggtgaacccgccgccgcggtccgtgtggaacacctcgatctcatccagcgggaagcgcagcgcggcgaacgcggccagcacgagatcggcgtcgtgcccgacgccgaccgaatggccggcgatctgccggttggccaggtcgccgggcaggcagacgcacgcccacgaactgccgaccctcacgtaggccgggtcggaggccggatgggtgcgcggcgcatagccattgaactcgcgggcgaggatgttgggagccgggtcgtcgttcggcctggccgggcgtggcctgtaggcggccttggaataggagccggccatgccgttcctcttcatgatccggttgatgcggcggcgggacagcgtcacgccctcgtgccccagggcgtgcttgatctttctggccccgtacaccttgccgctgtccctccacacgcgctccgcatccttctcgtaagggtcggcgcgttcggcctcggggtgttcgagcatccagtagtaggtcgacctggcaacgcccaggatcccgcactgcgctgatatcgggcagcggccggcgtcggaccgtatcacgtctactttcgtgcgaataccggcgccgcttgttttaaaacgtcgaccttcatctccagccgcctgttgcgtttccgcaattcgatcagcccgttctcctcgggagtgcggttgtcggccgctttcgtggagccgctgttacgtatcccctgcacccaacgctgcagcgtggaacgcgggatgccgtactccgccctgacctgcgacgacggcttgccgttctcgtacagctgcacgatctgcctcttgaactcctcctcgtaatgacggggacgattcggatcggccatgatgatcaactccttcgttgtcatgtcccgcatgaaccagtccaatacattgtagccaatccaggcgcgcaccggttcaatcgtctgttccggtgtaccgtttgtataactccaatgccggtgaccaccattacacgctgaacagttatgagagggacatgcttgtctcgaaaggttggcgatatgaaggtatcggttggtattcctccgataccaatcggagctatccgctgtaccgccagtacaatccgaatgccaaagccggtgctcataattacacattgaacagcaatgagaaagacatgctggttcgcgcgggttggcatgatgaaggattggcctggtatggtgtcggtccaggtgaaggagcgccggctccgcaatatcagcgcccatccggtggcgtgtacccgaacctgagcgtaacgccgaacctgagtatcaatgtatcgattgccgatcaacgtgtatatgtcaaaagtggttcaaacgttatctacacgctgattgcttcaacgggcgtcaacaacgcaactcctaggggaactttccgtatcgggaatcgtggttcctccttctacaatgcacgcgagggtatgggggccaattactgggttgcatttgagcccactaacacgtatctcttccattcggttcctacgaattcgagtggtcaatacatcgtcagtgaaggctataagctaggttagcccgcctcacacggatgtgttcgattgagcatcccggacgctcagtggttctatcaacaattgccgagtgggaccgtggtgcatatttttttgatgtcgcgaatacgcggtgccgctgatgctgattaataggcagataccgttggactagtgcaaccgatgattgtcgttggcttgttgctggcagtaggctcactgaaattgcatcgtgaatagtcggcggatatacatccgtgtgttggcacgcgttacacatctatcatgggtggtgagaggaaaacttaatagaagtgaggagtggttatgcgaatcgcaataaagcgaatttgtgccgtaatcttgggattgatgatggtgctatcgatatcgatagcagtctccggccctacacatgtggcatatgcggatgagggctcccaagagatgtaccgtatgtacaatccgaattccggcgagcatttctatacggcgaatagctatgaacgggataatctgaaaagccttggctggcactatgaaggtgtcggatgggtggctccggtaaagtcctcggttccggtttaccgtctgtataattccaatgccggtgatcaccattacacgatgaacagctacgagagggacatgctcgtctcgaagggttggcggtatgagggtgtcggctggtactctgccgatacgacgaacgaattcccgctgtaccgtcaatataatccaaatgccaaagccggcgctcataactacacgttgaacagcaatgagagagatgcactggttcgtgctggctggcatgatgaaggtctggcttggtatgcattagggcttggtgggccagctcagtcgcagccgtctggccctgcaacggttcccggggccattacccctggtgcatggtgcaagaagattgaagcaggccaatacgggcgcagcgaagatggagatttgtaccagtgctcgtatcagcctggtgacaaaataccgcattggtatcgagtgcagtgagtgtgaccaatagacactgattacatattcatgagccgtccgcaacaagtcaatctagttgcggacggctcatcagtatataagagcgtttccatgctctattcagaacgttgacgcttagtgaagtgtcgcctgaggtatgcgaattggttggtgtcggtgatgtaggtcttgcggtcgttcttggcgatgacgtcgaggattattccggtgacgaacagcagcaggccgacgatgacgagcatgatggcgccgatgagtgtggggaagtgggccacggatccggtcgcggcgaactcgtaggtcacccctccgcagagcgcgatgccgacgatgccgatgagaaggccgatggtgccgaagaagggcaggggcttgtattcgcggatcatgcggaatatggtgctcatgaccttgatgccgtcgcccacggtgtcgagcttggataccgatccggcgggccggtcccggtactggacgggcatctcgtagagacgcaggttgttgttcagcgagtggatggtcatctcggtctcgacctcgaagccgtgtgaaagcacgggataggtcttgacgaacgtgaagctgaacgcccggtatccggtcatgatatcggtgacatgcgcattgaacaggccgttgatggaactgcggaccagccggttgccgaagttgtggaagggccgcttgttctcctggaagtaggtggaggaaagccggtcgccgatgaccatgtcgtagccgtcgagcaccttggcgaccatggccggggccgcgtcggccgggtaggtgtcgtcaccgtcggccatgacgtacacgtccgcgtcgatgtcctcgaacatggcgcggatcacgttgcccttgccctggcggggctcgcggcgcacgacggcacccgcgttccgggcgatctcggcggtgtggtcggtgctgttgttgtcgtacacgtagatggtcgcgcccggcagcgcggccctgaagtcgcgcaccacattgccgatcgtgacctcctcgttgtagcacggtagtagaaccgcaacggaatgggttgggcaattatcaaacatgtaaaatatcctaacgtttgggatagcccgaaaacattaagtaatcgttctcagagctgccaagggaatacaaaaaggtgagccagcaatagtccggaataagaccatccgatcaaggcagatatgaagatacggattttcttcctatcgataacgagtatgcctagattggggattagcagacagacaagggcataaatggggatgaagtacctactttggagaccgcttgcataactgccaagtgcgactcctccccaggatacgatgagacctgtgcaagttaaagtgtagaaaagaatgattattgctgcagtggctgtaatctcagctatgtggaactcagggagattcttgtttcgatatagaacaagtaaaacaacggcaaaaagaataggcatcatgaccgcaaatggtaactgtgtatattcagctccagtaaagaattggatgttgcggccggtatcgtgcttatcgttggttaaatccaaagggttaatgagagatattccaaggcttttaagaatctcaccgggatgatgcagcacagtcaattttgcctctttatattgttcgactgtacttactgcactgggaggcacgttttttgtagcctgcatccaacatatggctgaagacaaggaaattatgacgggaattacaaacctgtagtcgattttatgattcaactggtactgtcgaatcatgggaagcgcaatcagtagtatgagaattatgcaggtcattttaatttgacccaggaacaatgccaaaagacaagttgctaatatattatgccatgataatttctcttgctggtaaagatataaaatgaaagcaacccataatagtgaaattgaatttgtgatggcatctgccgttgggtatatagaggaaagaaagaaaatcggaagaattgcgattccgaatataatcgtgtcgtactgctttgctagtgatatagcaatacatacaaatagcgtggaaaataataatgtaagaaggcagctgattcttagatgtccaccaccgaatacacttggaaaataagtaaaaggtgaattgatggcagtattattgaaggcctcaaatactccatctttattgattgcaccatagttgccggttcctgatggatctgggattgccgtaaactggccagcggcaatttgctcagctctattccaatgatcaagaaaatcatttctcgatggagctttatcgaaaaaaatgagtataattccaacagggatggttaatgatgcataaagtacgctgagcttatattttctatatatagaagtggatatttgttgcattctagtagtagaacgagtcatctgttttttctccgcgtcactttctgacaaattaatattataccatggtgttcgtaatcaacctcgtggttaatcatgtcctatgtcaaccgtgtgcacaactagtttacacacggcgagaaccagcgttttttgtcggtgtttcgccgattattgaacatgaagggctatcgttcgtggtaactgatattgctgagagcgattgatgtggaataagggggcgcggatgtttttttggacggtcaggtagccagtccaaggtgtttgcggtattgcgcggggctcatccagtccagtgacttcttgatcctagtctcattgtaggtgggtcaggtaggtggataagcgttcgcggaactcctcgtagcccacgcccctccagtcccgcccgtagaagaactcgttcttgagcctgccgaagaacccctcggccgccgcattgtccgggctgcatcccttggcgctcatcgacctgtttttgttcaataggaagttgaggttttgggggtggtgacgttttgttggacttcgttgtctgtatggtcgttggtcagtgtaccggatggtttcaggcgacgagcccgagctggatgcgtttgtccatgatgctcatgccgtattcggtcttgatgcgcttgtcgcggtaccagaccatgtactcgtcgagcatcgcggtgaactcgtcgatcgtcacgccctggaagctcctcttgtggaagaactcctgcttgagacggccgaagaacccctccgcggccgcattgtccggcgaacagcccttcgcgctcatcgaccgggtcagcccgtgctcggcgcagatgcggatccattccggccaccggtaatggcaacccctgtccgagttaaaccgatgtcggtttaattccgattaagccggttttgttgttaagccggggaacggttcggggtcttggtggctggccgtgtcccatgtggtttcccggcttaacgttccgggttatgttcgtcttgtcccatttgattcgaacgaaggagtttgccatgggtgagacgacggttggccatgtcgcgggcgaggtggtccgcgcgctttacggggccggttatatggaatccaccataggccagtaccgcaagtccatcagggcgttggaacggtacgccggaggcccggatgcggtgtacacgcgtgggttgggcgcggggttcgccgcgtcgaccttcagtgagcggacgggcggtttcagcaggcagcggtggttcgattacggcaggctggcgcgtttgtgcgactcgtatctgcggtccggttcggtggacctgggcaagtggcgcaggagcaggcttgcggagccggtggttccgggtttggccgtggtcatggagcgttgggaggcgtatctcgccggttcgggactggcttcggcgacggtggggcattaccgtcggatggcgggcttgttcctcacgtggctggaatctcatggggtcgtgtcgttggacggttcggatggctcgcatgtgctggggttcctggccgggctgcgttcacgctggtcggagtcgtcgatgcggcacgccgcgtcggacctgcgcccgttgttcagatggctcgggcgggatgacctggcggacgcgatcggcctggccggcatacgcaggacccacgcgatcgcgggaacgttgcccgacgacgagcaccgccgcttgctggaggcgtgcgcctgtatttcgtcaagtcggtgtttcgtgtttagtcatgtatttttttcgggtttagcgttcaacgaacccaccaggccgtacttcgcgccatacacgaaaccccagatcaaagtcgacaccacagccggcaccgcgtacggcaggaaggtggagatacggaagaacttcgtgccatgcagcttcatcgaatccagcgccaacgccatcaaagccgacaggcacagcatgatcggcacctgcacgcacgtgaacaaagccacacgaccaacactgctccagaactggccatcgcccaacaggcgcacgtagttctcgaagccgacgaacttggtgccgccgatcatctgcttcttgaagaacgaaatataaacggcgtacacgatcggcacgatgaacacgaacacgaacaccaccgcaaaaggccacatgaatttccatccacgccaatcggccttgtgcttattcacacgagccttgcccgaatgcacgggcgcagctgcgatatcggctgaagccattcccaacccctctccttcgaaggttgaccaaaatgtttgcgttatcatcataacaccatttgtaacattgtccaatcgtgttgagtaccgtgttgaattaagggtttctcagtcactctgctacaatggtcacgaagacaacgatgttatcgttaccgtaagcgaccctaagataagcgttgcaaacgaaacaccgacattaatgagtcaagcgagggtgaaatgtcgaggccaacacaggtgtccatgcaagacatagcgaaagccgccggcgtttcgccacagacagtgtcccgcgtggcgaatggcagcgatgcggtgaaacccgaaacacgccagcgtgtcgaagccgcaatggaacgccttgggtatcgtccgaattatgcggcccgagccctaaagcacggccgcttccaggatatcggcgtggtgatgttcaacaccgccacgttcggcaacgcccgcatccttgattctattgtggccaacgcggccgatgacgattattcagtcaccatccagaccatgcgccacggtgcggaacgcacgctttccgccgccatcgatcgcatgcagcgtcagccggtggatggtgtcatcgtagtgctggaggaacgcatctccgatttcgtcggatacaagcctccgcgagaatttccagtcgtgctcatctgcgaatccgccgccgaccactgccccaccgttgacgccgaccagtatggctgctcgaccgctatcgtcgattacctgatgagcaaggggcacaagaccgtctaccacattgccggaccgtccacctcgcgcgccgccgaaagccgcgcccgcggttggcgagaagcgttggaacaaatgggagcacgcataccgagcatgtacatcggcgattggtgcgcggattcaggctaccaggccggcgtggcgttggcccacgaccccgactgcacggccatctacgccgccaacgaccaaatggcatacggcgcaatgctcgggttgcagtcagcgggcaagcgcgtgcccgaggatgtcagcatcgtgggcgtcgatgattcgctggtcgatatggtcccgcgcttgaacctgacgaccatgaagctgcgctttgacgacattggcgccaccgccttctccatggtccgccgtcaatgcgaaggcgagaagataccggtcggcgtcaaaaccgtaatcccgccggaactgattgaacgcggttccgtgctcgacatcagctgacgagcggcatgcgctggcatccactggtacctgccagtgatccacctgccagtgattcataggcaattccgcaccgaccaatcgactcggttgtgcaatattctgcacatttccaactatgtgcagaatattgcacactttactatactgtgatatattttgcacatgattgtcatggatatcgccgaatacgcgcggcttatcaaggatgaaaggcaacgccagggcatcagtcagaccgacatggcccaacggctgggcgtgtcacgtcgctggctgatcgaatttgaacacgcccgagtccccaatcccggattctccaccattctcagcgctctgactgagcttggcttgtcgctggatgtccgcaaaaccccgcagcccgccgaactctatgaatggtgacaccatgagcgaaatcactctcaatgcatttctcggcgaaacacccatcggccagtttcgaagaacaaacgatggcagcattattttccaatatcacgattcctatcgttggtcgcaatcacccacaccaatatcgctttccatgcccattaccgcagccgaatattcaggcgacatcccgcgtaatttccttgaggccctggtcccggaatcccctcaggcccgagatgaagccatgcgattgcatcatgcccgatcgacaagcgcatttgatctgttgcaagccatcggattcgatgccaccggcgcattacggctgtccgccgacccgcacttgcccatagatgacgattcgcttattccaatcagcgattcgcagatcgcgaatcgactacgcgcagccgcccccacaggcatccagtccgcaagcgtagacgagcattggtcggtcgcgggacagcagggcaagatcgcactgaggaaccgcaatggatcatggttctccaccactggaatcgcgcggacgactcatatcatcaagcccggcataccgacccttccacaccaagcattcaacgaacacatcaccatgcgcattgtggaggcgatgggaatacccgtggcccacacctcttttcacatctttgatggggtcccagccatcatcagcgagcggtatgaccgtatagtgtccgccaatggtacggtgacggccctgcaccaagaagactttacccaagcgctgggcattccctcatcgctgaaatacgaggaacacaacggcccaacgtccaatgcatatgcggaaatgttgcgcaagcacggtctgcccggtcaggccgaaagcaatatccgagccttcaccgacggcatcctcgccagttatctcgtcggggcaacagacagccacgccaagaactactcgctattgctcgatggcgcgtccgtgcggcttgccccgctctatgaccttgcttcggtgttcccttatttggggcatggcaagcagatcataaatgccactttggcgatgaacatcggcggacgccgagatcttcttcaattacgccgcaaacatctggaacgattcgcacagcggatgggattagatgaggaatccgtgattttgcgattccacaccttggtggataggctgccggaggcattcgacagcaccgtgcaacccgctcacgacgttatcgcgagcattggtgcgcaggaattcatcgatagctatcgcaagcgcatcatgatggtgtacgacgatgcaatgagctggatggccagtcgaaagggacagtgattcggacgggcggggattggtctcgccatccccccccctaagaaatcagatcttaagcggcacacgggaaacgaattcgcgcttctcgcctgttattggatcggtgaatcgtagcacacgcgccactaattgcagcggttggctgaaatcgtcgtaggggcgcgtctggatgcgcgggtagaagtcgtcgcccacgatgggcaggccgagcgaattcatgtggacgcgcaattggtgggttttgccggtgcgcgggtggagtgtgtagcggcagatggggtgattccccggatggggaccaccctccggcgcttcgcgccacctcccgtcagcgggagggaaacagaggtcgccgcgctcgatgagggtttcggcgttggccaaacccggttcctcgaatgcggccatcgtgccgtgttccttggtgatgtgcgatcggcgcagcaatgggaacgggcgtggcggttcgacctgcatgatcgtgccgaatcgcgggccgctgatcggccggcagggtgccaggcattcatagatcttgacggcctgccggttctggaacagcatctgatacgcgccgcggcaggccggatcccgcacgaacaccaatacgccggcggtcatgcggtccaatcggtgcgctggcgtgatgtccggatcccccagccgctcacgcaatcggatcagcgcggtctgccgataccacatgccgcgcggcatggtggccagaaaatgcggcttgtccaccacgatgatccgctcgtcctcatacagcacgtccatctcaaacggaatatgaggctcgtcaatcacataccgatgtggcttactcaacggtcacggacttggcgaggttgcggggcttgtccacgtcgtagcccttgagctttgccatgtccatggcgaacagctgcagcggcaccacgtcaaccagcgggctcatcagcgttgggcaggcggggcgccagaacaccacgtcagcgtaccgttccacatccgggtcgccctgctcggccacggcgatgatgtacgcgccacgagccttgacctcctcgataccagagatcaccttggcgtgcaacacattgcggccgcgctgcggcggcacgatgaacaccacgggctcaccctcgtccaccagcgcgatcggtccatgcttgagctcgccggccgcgaagccctcggtgaacgtgtaggcgatctccttgagcttcagtgcaccctcaagcgccaccgggtagcccacgtgacggccgaggaacaagaaggagttggcgttcaccatgcgctcggcggccgcctggatggtcttgggctgggtgtcgagcacccactgaatcttgcgcggcatgtctttcagggagtcaagcacctgatgaatctcatcgcggaacatcgcgcccttgacctgcgccagatacaggcccagcaggtaggcggcggtgatctgcgccacaaacgccttggtggatgccacggcaacttccgggccggcgtgtgtgtagagcacggcgtcggattcgcgcggaatggaggcaccctgcgtgttgcagatggccagcaccttggacccctgttcgcgcgcgtggcgcagggccatcagagtatccatggtttcgccggactgagaaatggccaccacgagcgtacgcggggtcagaatcgggtcacggtaacggaattcgtgcgcgagttcgatttccacggggatacgcacccagtgttcgatggcgtacttggctacctggccggcgtagctggcggtgccgcaggccacgacgatgattttgtcgatggccttgaagtcgtgttcgtcgatacgcacttcatcaagggtgatgccgccattcgcatcgaagcggccaagcagggtgcgctgcactgcggcagggtcttcgtggatctccttgtccataaaggaatcccagccgcccttttcggcggccgaagcatcccaatccacggtgtaggtcttcgggttttcgaccacgttgccgtcgaaatcggtgacgatgaccttgtcggcggacacgcatacggcctgatcctggtcgacttccatggcgcgcttggtgtaggccacgaatgcggcgacgtcggaaccgaggaagttctccccctcgccaaggcccacgaccagcggcgaatcatggcgggctccgaccacgatgtccggctggcggcagtcggtggccagaatggtgaacgcgccttcaagcatgcgggccatgcggcgcacagccttgaacaggtctggcttgccttcgtccgcgataatcttgtccacgatcttgccgagcagcttagcggccacctcagtgtcggtggcagaggcgaatcggtagccttcggcttgcaggtcgagacgcagctgagaggcgttttcgatgatgccgttatggatgatggccaccttgccgtccatgctggtgtgcgggtgggcgttcacgtcgctcggctcgccattggtggcccagcgcgtgtggccgatgcccaccgtggcaagcggcatcggcttacgctcgatgtcttcgaccaggttcttcaaacggccggccttcttgcgcacgaccaccttatccatgccgggcgcggtcagcgccacaccggccgagtcatagcctcggtattccagacgttccaggccttgcaggcagacctccaaaggcttgccgcatgccgtttcaatatttcccgcgtatccaacgattccacacatggttcaccagcctagcggacgattattgcgcaaagcgaatccaacccgccgcctttgcaggattggaacatgccccttcgtgaaaaccgtacactgactaccactcagcgtacgttcttcacgagatgggggtgcgattaggcgtcgcaaaaaaacgtacgctgagttcatcagcgtacgtttttggagctgcaacaacgagccttcctacagcacgtgctgcaagaagtccttaaacctaggctcggtggggtggtcgatgatgtcggggccgcccttttctacgactacgccgccgtccatgaacacgatctggtcggcgacttcgcgggcgaagccgatttcgtgggtcacgcacaccatggtcatgccttccttggccaaggaacgcatgacgttgagcacttcacccaccagttcggggtcaagggcggaggtcggctcatcgaaaagcatgatctccggcttcatggccagagcacgggcaatggccacacgctgctgctgaccacctgacagctgggaggggtaatagtccatgcgatcgcccagaccgacgcgctgaagctcggccacggccaggtcacgggcggctttcttggactggtgctgcacgtgaatcggggcttccatcacgttttccagcgcggtcatgtgcgggaacaggttgaagcgctggaacaccatgccgaggcgagaacgctgtgcggcgatctccttatcgtccagggtctgcagcatgtcctggccgtttttggtcacgtgcttgtagccgatgagttcgccgtccacctcgatggaaccgccggtcagggtttccagctggttgatcagacgcaggaacgtggacttgccggaaccggagggccccagaatcacggtcacagtgccgggcataacggttagatcgatgcccttgagcacatgcagcggcccaaacgccttgtgcacctgcacggccttgacagcaggaatcacggaaccgtcagccgccttgcgcacgaccggagcggagttggtgatgtcgttcgtagtcataattctcgctcccgccttacgcattcagcccagcgaaggtggtctgattgattttgttcacatcgtccttcggctcgccgtcagacttgccggggtacggcggatcgtatggcggctgcttgcccttggtgcccaccggtcgggcatcgaagcccttgccgaagtgcgcctcgaggcgggactgcacaaccatcagaatggaggtgatcagcaggtaccagaagcaggccacgagaagcagcggaatcggcttgtagatacggttggcgatggcgttggtggcgaactgcagttcgagggtgaacggcacggcggtgaccagcgaggtggtcttcagcatgccgatggtctcgttgccggtgggcgggatgatgatgcgcatggcctgcggcagcacgatgcggcgcatgatgagcgtgcggttcatgcccaatgccttggccgcctcggtctggccggggtccacggcttcaaggccggcacgcacgatttcggacaggtaggcggcctcgttcagagccaaaccaatccatgcggcgttgaatgcggtgaccaccacgttggagtcgatgctccagaactccaccgaggtgaacggaattccgaggctgatcttgggaatcagcacggcgaacagaccccagaaaatgagctgcgtgtacacaggcgtgccgcggaagaaccagatgaagaaccagctgacgccgcgcagcaccggattgatggatttgcgcatgatggcaagaatcaccgacaggatgatcgccacgaccatggagatcacggtgagctccaaggtatagcgaatgccttcaagcacgttctcgttgaacaggtacttccagacggtgggccaatccagtcgcggattggtaatcaagccttgaatgagcatcgcggcgagcagtaccacgatcactgcggccacaatcgggccggggcgcttgaccggcagcgccttgatgcgattggggatgttcagcccctcaccgtcgacttctttcttcgccataatctggttccttggatgtgttgggcagcctgaactgcaagttgcaactagcattgaaccttagtgcacgaatggggcgactgtgttacaaacagtgcgccccattcgaattttcgcgacagcttgtcgactattcgacggccgggttgatttcggccttgtccagtgcgccggattcgacgccccagtgctggaggatcttggtgtaggtgccgtcgtccatgagcttttgcatggccttctgcacggcttcggtggtctgggaatcgcccttcttgatggcgatggcgttcggcacttcatcgaagtccttgccgagctgttccagctgaccatcggtctgggcgatggcgtagccgacaaccggggaatcggcgaagaagacgtcggccttgccggtcaccacagcggtggtggcgtcggtctgctgcttggaggactggatggtgatgtctttcttgccgtccgccttgcactgcttggcggtcttgttgatggcctcttcctcgacggtgccggtctcgacggcaacgttcagaccgcacaggtcgttctcatcgacgttcttggggttgcctgtggccactgcatagcccatgcctgcggtgaagtaggagacgaagtcgacggattccatgcgctccttggtgatggtgaaggcggcgatgcccagatcgtacttggagccgatggccggaatgatcgtatcgaagttggaggagacgatttcggtctcgagaccgaagatgttgcccatggcgcgggcgagatccatgtcgtagccgatctgggtcttgccgtcggcgtcgaggaattcggccggggcgtaggaggggttggtgccgatggtgagcttgccgtccttggtcacggattcaggcagcagtgcggcgatggtgtcatccttctccacggagctgacatcgtagctggtgatggtggcggcatcggagcccttggcggaatccgtaccggcatcggccttgtcggaggtgccgcaagcggcggtggcgaacagcatggccgagctcagtgcaatggccataatggacttcagtttggtggactgcataatcgtttcttcttctctcttacgccgcttcaacggcaacgatcaacggttaagcatatttatacactacagtgcatacatatacaaaaagactcccgccgcagggcaacgggagtcttcatagtaaccgaaactactcgacggacgggttgatctcggccttgtcgacggcgccggaagagacgccccacgtgtcgaggatcttcttgtacgtgccatcatccatcagcttctggatggccttctgtacggcctcggcggtcttggaatcgcccttcttgacggccacggcctcaggggtcacaccaacgtcctcgccgagggcctcgagcgtatcaccggtctgcttgatggcgtagccggcaaccggcgtatcggcgtagaagatatcagccttaccggaagccacggcggtagtcacatcggtctgcagcttggaggactggatgtcgatggcatccttaccgtccgccttgcactgctcgttggccttgttgacttcctcttcctgagtggtaccggtctgcacagccaccttcacgccgcacaggttcgaggagtcgaccttgttcgggttgcccttctgcaccacgaacgtggaaccggccttgaagtaggtcacgaagtccacagcctccatgcgttccttggtcacggtgaaggaggagatgccgatgtcgtacttggagccgacggacgggataatcgaatcgaacgtggaggagacggtgttttccttcagtccgaacactgcggccagcgccttggacaggtcgacatcaaagccgaccggggtcttgccgtcctcggccaggaactcggccggggcataggaagtatcggtgccgacggtcagcgtgccgtcgccggccacggaatcgggcagcagtgcggcaatctcgtcgtccttctggatgctgctggtgtcgaagccttgaatcgaagtgctggacgagtccttggatgaatcgccgctcttggatgcggtgtcggtgccgtcagtcgtgccacaggccgccacggcgatcagcatggccgcgctcagggcggcggccgcagcggattgtattcccttgcttagagacattggatttcctctctccggatagtcagctgggcgggtatgtttcccagatggttccagagcgtaggagtgcaatgctacggaagcgttaatcgtgggcgaaatggcccacaacgtggacatcctactcttggctcccctccggaggggagccaaggggcgggactagtggcgcatgttggcgtagcgcatggcgcgtagggcttcacgcttgtcctgctcttcgcgcagggcctggcgtttgtcgaattccttcttgcctcgggccagtgcgatctccgccttgacgcgaccgtccttgaagtacaggctcagcggcacaatcgtgtatcccttggcctcgatgccgcgggcgagcttggtgatctgcaatcggtgcagcagcagcttgcgcttgcgcttgggcgcatggttgttccatgtgccgttcaggtattcggggatgttcgcgccctccagccacatctcgccacggcggtcgatggagatgaacgcctcggacagcgatgcgcggccttcgcgcaacgacttgacctcggtgccggtcagggccagccctgcctcgtacttgtcttcgatggcatagtcatgccgggccttcttgttctggacgatgagtttctcaccggtttccttgggcatgtctcctcctttcgtgggcaataactcgtgagtagcaactcgtgggtagcaactcgtgggtagcaacgcaacatccgacgatatcacggaccggcctcgaatacgaaaagggttcctcttcaagaggaacccttcaaccgcatatatcggccgaaccaaccggtcagtggacgaaccagtactgacccaaattggtcaaggtgcggtagtgcatgttccacggaccaccccagttcatttcggagatctggaatgtgccgtcgccatacacggcttcgactacggcaacatggccataggtgccgtcggcgccatcctggccgggcaggaaggagagtgcggcgccgacctgcggcgtgtggtccacgcgcaggccgtacgcgggggcgctgcgccaccagaagccgccattgcccagataggacggcgtgccgatgcccatctgcctgcgacgttcatacgcccagtacgtgcactggccggcggcataggcgttgccatagtcgccgttcgacgtgccttggccgccgacgctgggggcgggggcgggagcgggagccggagccggcgccggagccggagcgggcgccggagcgggggtcaccggagtggacggcgtgccgccctggttaccggtatccacccggttggcggcgtcctgctgctccttctggaactgacgattgtaggaatcgacctgggaggcgatcagtacggtctgggccgcctgcttggcggattgggaatccagactgtcgaccatggaggacagttcgttgcgccgcgtctcaccctcctggcgtagcttgtccaaagcgtcacgttcgctttgcgcggtttcggcggcggtctgtgcggaagcggccttctcatcggactgggtcttgagcacagcgatctgcttttcgatggccgccaagcgctcgccacggttcttcgacgtgctcagtgaggtcgcggcggaggaagccgcattcgcctcgttgcgggacaacgcgtcccgggactgcatggagttgacgaagtcctgtgtgctggtggcacccgtcaccacgctcatcacgtcggaagcattcgagccgtgcatctcgtcacgggccagctgggccacggcggcgtgcgcgtcatcgtagtccttgccggtctgcttgatctgctcctcaagcgtctccttgtctttctgcgcggcggaaagacgtccggatgcggcatcggcctcgtcctgagcggtggcggcatcctcgttggcctgtgtgaccttggcctgcgcggcgacaatcttgttgttggtcagatcgtccagctcaagtaccttattcgccaggtcctggctggcaccggccagctgctgcttgagttcggcctcgcgctgtaccgacgcggcgtgctggttctgcgcattgatcaggtcggaataggtgtctgcctgggcaggctgtgccgagctgaacgccagacctcccacacaggctgcggcggccaccagtgccgccagtgcgggcttgatcacacgtacgttcgtcatatgtgaatagtcctttcgctcacttaagccaataccataacatgcgaacctgagaggcttgcacatgatgtcatcacatttctcgcgggtaagccggtcgcgttacgccctcaaataacgccgcaacgagatggttgaagcgatgatggacagcagtatcgcgcccacaaccaggaacggcgatatcaccagtaccgtgagctgattcacataaggaatccatgtaacggatttcgccagccagccggtgacgaacacgttgacgatagccgaaagcatcaggcacgagagcaccgagccgatcagcgaggcgatggcgccctccagaatgaacggcagacgaatcgtccagttcgaggcacccacgtacctcatgatttcggtttcggttcgtctggatgcggcggacatacgaatggtggttccggtcagcaggatggcgaccaccaccatcacgccggcgagcacagccgtaaccgccgtggctcggttgagcacggcgaacaccgggtcgaagatctggcgctggtcggtgacgtcttccacaccctccttgccagagagcacttcggagaccacctgatatttggtggggtccttgagcttgagccagagggagtcctgcatatcgtccgcggtcagcgtacggccttggaattcaccgttcgggtactgcttggtgaaggtgttgtcgtagaaatcctgcttgctgacatagtcgatgttggagaccacgtcgttgagttcatcgcgaatggttttctgcagtgccgtgatctcattggctgagggcgatttgccggaagcgcagttcgcggattggctggtgccgtcggggcatagccacaccacgacctcgaccttgtcgtaccagtcgcccttggctttggtgatctgcgcctgagtaagcaccgaagcgccgatgaacaggaatgagatgaaggtgaccagcgtcagcgacagcagcatcgacaggttacgggtgaggttggcccacgtttcggacagaatgaatcgtgctcgcatatgatcccccttactccttcgcgccctcagcgggttgatcgtcggatgtttggtctgcggcggactgctcgccgacaggcggtacgggcggttccggcggggccggcggctcgggcggttccggcggggccggcggctcggcggcggatgacacggacgtatcggcaaccgcggcggtctcgccggactcgtcattgaacgggtcgaacgcctgggtgctttccagggcggcggcctgctcgtccaacgggatgcccttgccccaggtcagcgtgtcttccagcggcgcgaacgtctcgccatagcggccggtgcggccggaatgcacggagttggacagacgggcgatgccttcggacggctcgtcactgccctcgatggccttggtcgccgccgccagcacatgatgggcggcgtcggacttggcttcgacttcggcatccgggaagaacagggcggaatcgtaggagccatgagcctcgtcacgcacgatcttgccgttgtgcagttcgaccacgcgcttgcgcatcgagttgacgatctcttcgttatgcgtggccatgacgatggtggtgccggtgcggttgatggcgtccagcacttccatgatgcccagcgaagtggtcgggtcgaggttgccggtgggctcgtcggccagcagaatctgcgggtgattcacgtaggcgcgggcgatggccacacgctgctgctcgccaccggagagctcatgcggatagttcttttccttgccggtgaggcccacggtattcagcaccttgggcaccaacgatttgatggtggaccgccgcgtgccgatcacctcaagggcgaacgccacgttctcccatacggttttgttattgagcagcttgtaatcctggaacacgaagcccagcgaacggcggtactgcggcacttgacggttggtgatgcgccgcagatcgttgccggccacgcgaatctcgccgctggtggcctcctcctcgcgcaacagcaggctcaagagcgtggtcttgccggagccggacgcacccacaaggaacacgaaatcaccgcgttcgatatcgaggttgatgtcgtcaagcgccggtcgggtgcctttgggatagatcttggacacattgtccagtgagatcagtgccataatgctgtttactcctcggtttcggcggcgcggcgctgttcatggcgccagcggatgccggcctcgatgaacgcgttgatgtcgccgtcgaacacggcctgagtctggctggtttcgtagccggtgcgcaggtccttgaccatctggtaggggtgcagcacgtaggagcgcatctgatcgccccagctggccttgatgtcgccggcgagctccttcttcttcttggcctcctcctcgtggcgcagcacgagcagtcgggactggagcacggccatggcggaggcacggttctgaatctgcgaacgctcatcctgcatggtcaccacgatgccggtgggaaggtgggtgatgcgcacggccgagtacgtggtgttcacgccctggccgccggggccggaggaacagtaggtgtccacgcggatgtccgtatccggaatgtcgatatggtcggtggcctcgaccagcggcaccacttccacggcggcgaagctggtctggcggcggccctggttgtcgaacggggagatacgtaccagacggtgggtgccgccctccacggacagacggccgtaagcgtagggggcgtccacctggaaggtggcggacttgatgccggcctcttcggcgtaggaggtgtccatgaccttggccttgaagccgttacgctcgcagtagcgcaggtacatgcgcaacagcatctgcgcgaagtcggccgcgtcgacgccgccggcaccggagcggatggtcaccacggcggaacgttcgtcgtattcgccatcgagcagggtctggatctccatctggtcgagatccttctgaatctcgccgatttcgctttgcgcctcgtccagagagtcctgatcgccctcctcgtggccgagttcgacgagcgtttccacatcgtcgatgcgctgggaggcggagttcagacgcttcagctgcgattccgcggcggacagccggctggtgatcttctgggcgttttccgggtcatcccacaggcccggggccgcggcctgcgtttcgagatccttgatatcggccttgagtcggtcgacgtccagcgccttggcgatggattcgtatttggcgcgggcttcgccgatcgcctgggtaaagtcaaattctgccatcgtggtttaccttactgttgattctttgagattccttgggaagtcacgtccttgttgacagccttcgcacattcctctggcgttggcgggcattgccgcgccacacgcgcatccgcctgcaatccatgctgtcagaaggttccgggcctgccttgccgataaccggccgggcgacctcacgaatccctcgcatcagacgtgttcaactgcgggcacgaatatgcgaaggcaacgtcaaagccccgcgtaaatcgccgggatgaccagggagccgagcatggccacagctatgaccacgcacaccacacgcacgatggtgcggcggcggttctcacgctgctgtcggctgtcctgatagttactcacgagaccaatagtgtactcaccgcttacgaccgcaggacttgccgccgacgcccgccctgccggtggacccccacggccctttcccttgcgctttcagcgccgccagatggtgtttcatggccaccagcatgatgtgcgaatcctcaaggcccaggtggcgttcgttgtgggcggaatcaagcgcgccctgacgtttggcgtaggcgtcgagcgtgttgtctccgtaaggatgctcgttggtgggtaccgcgccggggtcccactgccggctcatcggcagggtatcgatgatggtgatgcgcccggcgcggtagctttccgcgtatccggcgacgttcagcatgaaccagctatgttcgaaggtggcgttatgcgccacgtacggctgctgggtaagccgcgcgagcaggccggcctgggcttggggccattcgtcgaagagtcggtacccggcctcgctgctgcggccgcgtacatcgatgccggtgagtttggcgatgagggcgttgccgagcgccgcgttttccggcggcacgccaaaagcgaggcgggactggccgtaggcgtcgccggcggcgtaatagccctgctcataggcgtatgtctcgggttcgccggccgggcgcggactggccatgttcatgaactcgaagccgacgtcgatgatgtagtcacgtgccggatcgatgccggtggtttcgatgtcgatgcccatcaccgcatccacgtcgcggccgggcaggtaggcgtcgcgccagtcgggcttgggatggtgtccggtagcgttgccagacgcggcggcaccacccggcagagcggcaccacccggcgaagtcgcgccggagagattggcgcgggccatcgccgcatcgcccgcccgcttctggaagcgctgggccttacgccgttcggcgcgtgcgtcaagaatcgccgccgtacggtcttggatatcgtccaaggcgactgttgtggggaacttgacatcgctgttttcggcggcagtgtttccggcagatgtgccaccggcttcgccgctcagatccagcatgccttggtcatcgttcgacgggccgctgccggagtacggcttgagcacggcaatggtggccctcccccgccgttcgcgactgaccgcccataggtgttgctgttcgcccagatgcaacagcgtgttgatgttgtcgttgagccgacgattggcgtaggcgagcgcgcgaggcagacgataggagccgatgaaccggtcgaaatcggtcatgaatgcgctgttgcattgggcgatgatcgattccagacgctcgcgtgtggcgtagtcggccttcaatgcgtcgtggatggactgtggggtggattccggtattgtgccgacgccatgcgccaggtccagagaacgcacccagtcccagtcgatggtggtgccatcggcgtccttgggcatggacgccgcccattggggaatgtctcccttggcggcgtcgaaccatgcacggtcggtcatagtgcgaaaccgagctcttcagcggcctcggtgggcaccgggtcttcgcaccagtagtcctcgaggttctcgttggtggtcagcgaacggatttcggcgcgatcgatatacaactcgccgctcaaatgatcggtttcgtgctggaagatgcgtgcgggccagccgtgcagcggctcgctgtggtgtttgccgtcttcatcatcccattcggcggtgatgtcgagccaacgcttgcgcacagcttggtatccgtcgaagctcaggcagccctcgtagaacgaggcggttttgtcgctggtgggtttgtagctcgggttgatgatcacgtggaaggggaattccgcgatttcgcgcggatcatcctcgtcgtcgcgcacgtggtcttcgaccacggcgagcgcgagccccaagccgatctgggtggcggcgagccccacgccgggtgcctccagcatggtggtgtgcatcgtatcgatgagtttggcgagcgtacgcttggaaagctggccattataggccactgtccgttggcgcaacaccggttcgccggcctgcacgatgggcaggagcttctccttgccgccggttttgatgagttgttcgacatcacggttgagttcgaggtcgactttggcgttctttccaaacattgtttttttccttagggaagggtgctacagcgcgagttcttcggcgacgatcttggcgaggcgggtgcagacttcgtcggcgtaggcttgggtggcggcctcggccatcacgcgcacgagcggttcggtgccggaggggcgcagcagcacacggccggtgtctcccagcagttcctcctcacgggccacggcatcctggatgcgcttgttggtggaggcggccttcttgtccacgttcggcacgttgatgagggtctgcggcagctgcgggaagtcggcggcgagctccttcaggctcttgccggacttgacgacctcgttgcacagggtcagtgcggtcagggtgccgtcgccggtggtggcgaattcgcggttgatcacgtggccggactgctcgccgccgagcgagtaatcgcccttgagcatttcctcaagcacgtaacgatcgcccacggcggtttccacggtcttgatgcccatatctttcagggcgagcttcagaccgaggttgctcatcacggtgaccacgagggtgtcgtggttgagcttgccttcgcgctgcttggcgcgggccagaatgcccatgatctggtcgccgttgatcatgttgccgtcttcgtccacggcgagacaacggtcggcgtcgccgtcgaaggccacgcccatcacggcatcggtggccttgaccatggcctgcagctgctcggggtgggtggaaccggcgttcttgttgatgttgtagccgtccggcgaggcgttgatcacgattacatccgcaccggcacggcgcagggcttcgggagccaccacggaagtggcgccgttggcgcagtcggccacgatcttcagtcccttgagcggcttgggctgggttttgtcatcgttcagcggagcgatggtggccaccagatgatcgatgtacaggttggtggcagtggtctggtcgtggctcacgcggcccacgccggcaccggtcgggcggtcccagtcctggccgagcacggcctcgatgtcgtcttccttctggtcgggcagcttgaagccgccgcgtgcgaagaacttgatgccgttgtcgggcatcgggttgtgggaggcggagatcacggcacccatctcaacgttgagcacgctggtcaggaacgcgatgcccggggtcgggatgatgcctgcgtcgatcacgtcgaatccgccggcggccatgcccgcagacagggcggaagccagaaaatcgccggacacacgggtgtcacgacccacgagcgcgcggcggcgcccctcaggctgatcgtcttgggtgccggcgtcgccgagcacacgcacggcggcatcgcccaaatccaacgccagacgtgcggtcaaatccctattggccagtcctcgaacaccatcggttccaaacatcttcggcatatgaagttccactccttgtatcgcgttacccgcaccatcgtagtcgttgtgctccaccctaggacccgactcggcaaaaaaccgccacggaatctgctccagaaccggaaatcagcattcaacagccgcaatggcatcacccacaaacccgcatattcatcttgttcggcggatgaatgatgagatacattcgttagcgggcatgccgggcggaccgatgcactccggcacgggaacgaagccatcgcactagtaagaacgggccggcaaacgcgcctgtaaacaatacagcggcaaatacgacgaacggaactacccagcgtacatcgataaccggcaaagcaacaccaaacagaacgacggcgaggaacacgctgagccatgcgatgaacatgcccaacggcatctcctctaccggggtggtctcggccatgaatgcaacgatctattactccgatgttgtggtcagtatgtgcggcagttgctcgtcgcggttgaggaaagaacgcgtttggcagcgaagtagcgtatgccgaccttcctcagtgcgggcgtataccatggtgcaatgcgtcaggcagcggtccaactgccggctcagtatctcggcgtcctgctggcggcgggcaaatacggacgggcaggggaagctcacgcagtaagcgcgcacgccccattccttaccgatgatgacatatcgcggattgttgatgggcgcgagtagctccttcataacgccggcgaacagcacctgctcgcgccgcgaaccgccaatcagcatgacacgcaatgccgtgaatctgcgacgtgtctggcggatcgaggaagtcgttcaccgcttcgcctgccgcgctggtttctaggcgctcaggttccgcagtcgccaaatgccagacattggccaccttatcggggtctgcgaccacgctgcggttgacggccatgctgtatgcttcactgcatcagtgtaaggcacgaatcaataggttttgagccccagatcgatggtaagaatgatgccggcgattacggcggcggcgcgcatgatgtttgcgggaatcttgcgggtgatggacggggcgatgtacccgccgatgaagcatccgatgcacagcatgatggcggccggccaatcgaccgcgccttggatgatgaataccactgaggcgctgatgttcgcgcctgtgccgatcagggttttcaatgcattgatcttgtggaatgggccgattttggcggcatcaagcacggcgagagccaaggtaccggcgcccgcgccgaagtagccggagtagatggcgaccgccgctacgcccagccatacccaccaggaatcctgactcatgggctgcacgagttgttccggcgggcggtgaggtgcggtaggggtggttgcgcgcttggcggcttcagtggcttcagtggcttcagtggcttcgatgtgcttgagttgcgcggtggcatccgcggcggcttgcttggcctgcatgcggccgcgcggattgatggcgatgatcagcgagctcagcaaaatcagcactggtgcggcaaattcaaagacactcgggtcgagtttgagcaacagaaacgcaccggccaccccgccgaatgcgccgatgaccacatacgtaatggagcgtaccgcttggcctttgagttctttgcgcgcacccatcacgccaccgatgcccgtgccgaccacgccaacggtgttagaagcgtttgccaatacaggcggaatgccgaacgcgagcagggccgggtatgagaccagtgacgatgcgcctaccgcatagcccacgaatcctgcgccgattccggccaacagaatcagcagtaatgaagttatggaaaagcccgcaatcattccccgtatccttgtcgctcatcgaccggcatattgccggccttgagcgagaatacgctgttgaggattggttgcgggttttatgttggaatgtggacgtagcttctcgcggaagcgactcccctcagtcgcctgaggcgacagctcccctcgcgcccgaggggagccagaaggaaatcagagcgcttcgttgtattcgcgaaccttgagggtgcggtgggaggatgccacgttttcgacgatcagacgcttcagggcattgtcggcggcaatgtgctcgtccagccaggcgtcaccgagcttgaccagcgtggcgggatcggcgtagcccgggtacaggccgttgagcaacgcctcggccatgtgataggtcttgttggcccagacccagtcaacggtctcgaagtacttggcggcgaacggctcggccagatcggggcgcggggtggcggagaagccacgggccacggcctcgagctgggagttggtcagctcgtcgttgtggagcgcctgatcccaagcccattccttggcctcagcggtggccatggaggcacgggcgccgtaggcgaactcgcggttttccgtggtctccttcttggcgagctgcgcgtccacgtcgtcgttggtcatctcgttgacggaggtgagcgcttggacgatggtccacgtgaagttgttgtcgatttcgaggccttcaagacgcacggtgccgtccagcagaccgtgtgcgttggcggcgaatgcggcgtcgccctcctcaccgtagcccaagtaggcggtgacgagctggaactgggtgtccgagccggcttcggcggcgttggccagagtccacagttcggcggccacgtggcgcagcacatcgtcgcggcgggcgggcgccacgtagtggtgggcggtggtgctcatgcaggccagcgcgtaacggaaggtggtggattcggtttccgtggccagaagacgcagggtcatgtccacgaagcgttcggccgggaattcgccgtcacgggtcatatcccagaaggcgagccaggtcacggcgcgggccagggcatcatcgaaacgatgcaggttggcttcggcgaatgcctgggattcggcgtcgaaacgaatcttggtgtaggtcaggtcatcgtcgttgaccagcacgaatgccgggcgcggcttgccggctgcggcctcgacgatggtggtttcgccatctacatcgagttcgaactgctcggtgcgcacgatcttgccggttgcggcgtcttcgttgtagaagccgacggccaggcgatgcgggcgcagcaccgggtgttcggccggcgcgctctgggtgagcttcagttcggcgatggtgccgtccgcgtttacggtcaggccagtggcgatcgtgttgatgccggattcctccagccacttggcgctccaggccttgagatcgcggccggaggtcttttccagttcgctcagcaggtcggccagggtggcgttggagtaggcgtgacggttcaggtagttgtggataccttcgaagaactgcgtgcggcccacgtagaatgccagctgcttcagcacggaggcgcccttggcgtaggtgatgccgtcgaagttgacgtaagtgtcgttgaggtcgttgatcggcgcgacgatcgggtgcgtggtgggcagctgatcctggcgcagcgcccagctcttctcgccggagcagaaagtggcccaagcgtcatgccattcggtggcttcggcagtggccagcgtggaggtgaattcagcgaaggactcgttgagccacaggtcgttccaccacttcatggtcacatagtcgccgaaccacatgtgcgcaagctcgtgcagcacggtcaccacacgacgctcggccagcgcgtcggtcaccttggattcgaacacgtaggagtcgcggatggtgaccatgccgatgttctccatcgcgcccgcgttgtattcgggaacgtagatctggtcgaacttggcgtacgggtagggcacgccccaggtcttggcgtagaacgcgaagcccttcttggtgatgtcgaacaggtagtcgacgtccttcgcgaaggccttggccaacgactgtcggcagtactgggccattggcacggtacggccgtcttcgttcaggtattcggtgtgccattcggcgtacgggccggcgcagatggcggtcaggtaggagctcatcaccggggtcggctcgaagtcccacagacgggtgctttcgttcggcttgtcgccgagggtgccgtcgagggtttcgcgcggatcgtcctcgatggtggcaaccggcatgttggaggtgacgatccagctggcgggagcgagcaccttgaagtcgaaggtggccttcaggtcaggctggtcgaacacggcgtagacgcggcgcgcgtccggcacctcgaactgggagtacaggtagatgttgccatcggacgggtcgaccgagcggtgcaggccctcgccggtgttggagtaacggcacttggcttcgacggtgacctcgttcttctccttgaggtcggtcagttcgatgcggttgtcctggaaggccacggctgggtccagggacttgccgttgaggtcgatggatgtcacttcgtcggcgatcaggtcgaggaaggtcgacgaaccaggcttcgcgttgaagcagatgagcgacttggaaccgaagttcttcgcgccgaccgtcaggtcaaggtcgacgtgatagtgaatcggcgcttcgataacggccttacgttcttcggcttcaatacgagtgagattagaaccgggcatgacttcaattactccttacggtcgtccctggataatccggactacttggtttctacggtttcgacgtcctgggcgatgtcggccacgacgggcacgatcatcggcttgcggtgcagctggcgcgcaacccagctgccgagcgtgcggcgcatggtctgctgcagcttgtaggtgtcacgcgtgccctgcatcatctggtcgttgagctgttcgacgatctggtgacgcaccttgtcgaactcgctttcgtcctcggccacggcgttcaggtagatcttcgggccggtgacgacctcgtggttgtcggtgtcgaccaccacgaacgcggatacgaagccctcggtgccgagaatgcggcgcttttccagctcgtcatcggtcagctcgccgacggaatcgccatcgacgtacacgtaaccgcacggcacggagccgacgaccgcggccttgccgtgatacaggtcgaccacgtcgccgtcttcggccaagaccacgttctgcgggtccacgccggtcttgacggcgatcaggccgttggccaccaggtgacggttctcgccgtggatcggcatggcgcacttgggcttgacgatgttgtacatgtacagcagctcgccctcgttgcagtggccggacacatgcacggcggcgttgtcgcggttgacgaccttggcgccgagctgcacgagcttgttgatcaccttgtagacgccgtgctcattgcctggaatcagggagctggcgagaatcacggtgtcgaactcgttgatgtggatgtcgcggtggttgccgtcggcgatgcggccgagtgcggccatcggttcgccctgggaaccggtgcacatgaagacgagcttgtcgtcctgaatgtcgttggcctgcttcaggtccacgacggtgccttcggggatgtgcaggtagccgaggtcggcggcgatggacatgttgcgcaccatcgaacggccgacgaacacgaccttgcggccgtacttgtgggcggcgtccaccacctgctgcacacggtgcacgtgggaggagaagctggcgacgatgatcttgcgggtggcctgggcgaacgcttggtcaagggccgggccgatggaggtctcgggcttgacgaagccgggcacctcggcgttggtggagtccatcatcagcaggtccacgcccttttcgccgatcttgccgaattcgacgaggtcggtgatgcggtggtcgagcggcagctggtcgagcttgatatcgcccgtgtcgatcagggagccggccggggtcttgacatagacggccagggcgtccgggatggagtgggtgacgttgacgaattcgaggtcgaagggacccaccttgagcttctcacggccggcaacctcaaccttggtggggttctggtggtgttccttgcacttggcgtccacgaaggcgagggtcagcttggaaccgatcagcgggatgtccgggcgcagcttgagcaggtagggcacgccgccgatgtggtcctcgtggccgtgggtgagcaccagggcgtcgaccttgtcgagacggttcttgatgtagctgaaatcgggcaggatgagatccacgcccggctgctcctcctcggggaagagcacgccgcagtcgatgagcagcaggtgaccgttgtattcgatcacgttcatgttgcggccgatttcacccaagccgccgagcggcgtgatgcgcatggagcccttgcggtacttcggcggggcgatcagcacggcatcctgctggggtgcggtggcctgccgggtggcgttgatcttacgggacggcgtacggctgttggatccgttggcgttgcggccgcgcgcggaaccgcgacggcgagaattcgtgttcttgcttgttttcttttgttcttgtgccataacctttttgggatttctgttgtggtgcctctgctctgtcatgcaggggcggcgggctggcaacccgtatgcagcgtttcgggcttacagcagtccggcagcgcgcatgccctcttcagccttgtcaagctgagtggcgtcgggaccgatgttcggcagacgcatggtggtggaggggataacgcccttgaccttgagcgcagccttggccatgacggcctgatagccgtcgccattcaacgcgtggacaaggggggcgagctggttggcgaggcgacgggcggtagtgatatcgccgcgatcgaatgcctggacaagctgctgcatggggttggaggcgacgtgggcaatcaccgaaatgatgccgacggcaccgatggagaggaacggcaggaacaggccgtcatcgccggaataccaggcgaggccggtgcgctgctgcttctccactgcggctgcaagatcgccggtggcgtccttgacagccttgacgtgttcaagttcggccagtcggtcgtaggttccgaccttgaccttcaatccggtacggccgggaacatcgtagacgatgatcggcttttcggcggattcgtcgacggccttgtagtggccgacgataccgtcctgcgaggggcgggaatagtaaggcatgacgacgagcaccgcgtcggcacccgcttcctgagtctgttcgaccatacgcacggtgtgtgcggtgtcgttggagccggcgccggaaatcaccggaacgtcgacgacctccttgacggccctgaccagctcgaccttctcatccatatgggtgacgggcgattcgccggtggtgccattgaccaccagaccatccgcgccatcggcgacgaggtatttggcgagcttctgcgcggcggcgaaatcgacgctgccgtcggatttcatcggggtgaccatagccggcagaatgcggccgaaaggtgctgaatcaagaaggtgcatgtcatgctcgctcatagtgtttaccgtacttcccattgtggactcttatactacgtaccttgattgttgctgaatgcgtggcattatggccggagccggtggcaatgccgtgatgcgcgtcccggcgcgcttccctgcctgaaatgcgggggcaactactggtcgactgcgggtcgattacaggtcgaggaagtggtcgaggccgatggtcaggccagccggagcgtcgccggcgagcttgcgcacggcaagcaggacgccgggcatgaagctggtgcggtcgaagctgtcggcccgaatggtcagctgctcgccggcgttgccgaagagcacttcctcgtgggcgttgaggccgcgcagacgcacggcgtgcacgtggatgccgtcgaccacctggccgcgtgagccgccatcggtttcggtggcgtccggcacgggggcgagtcctgcggccttgcgcgcttcggcgatgccgtgggcggtgtggatggcagtgccggagggggcgtccaccttggtggggtggtgcagttcgatgacttcggcggattcgaagtatttcgcggccttggtggcaaagtagtcggccagtacggcggagatcgcgaagttaggtgcgatgaagaccttctgggtttcgggcttcggaccgttggcgatggcggatttgacctgggcgagtttctcgtcggtccagccggtggtgccgaccaccatgtccacgccttggccgatcagggtcagcacgttgttcaggctgacggacggcacggtgaattcgacgaccacatcggtgttgtcggtggtgatctgggtcaggtcgtcgccggcatccaatgcgagcgccagctgcgtatcctcggcgttgttcaccgcttcgaccacgtgcgagcccatgcggccctttgctccgaccaccgaaaccttgatcatgtcttcttccctgtctacccgtacctgcccggcaatgtacccgggacgttttccaatcggcaatcagcctatcaccgccaagccctcacgccaataccccgtccacagaatcaagctccctctgacgagccgaaccgtgaagtcgagctccctctgatgagccgaaccgtgaagaaaacgccggaggcgtttttaggtgagggcgaacgacagtgagcaataattcagttggctgaaagccatcattaattgcgttcgagctggacgcgaagcggactgagggagagaccccggcgaagccgccaaccatccatcgggcgtagcccgatcccgtttcacccacgccgcttggccaaggcccatccggccaacgccaatggcacggacgccagcgtgaagatgaatggcagcatcatgcccacatgagggttggaggcgtcaagcacaatgccggccacggacgagccgatcgacgtgccgaccgtgcctgcggtggttacccagctcagtccttcggtcagggattccgccggcaccagatccttgacgatgaggttgccggtggcgaacgtcggcgagacggtcaggccggcgaggatttcgaagacgcccagcaggatgagattgtccattgacaaccggaagaacacgtagccgacggtcagcagcgacaggaacatcaccatatgcgcccaatgggagcctttgagttggcaagagccgaacaccagcgcgccgatgcacgagccgaccgcgaacatcgccaattgcagaccgaggaagggctcaagtcccatggatttcatggtggcggtaatggacacgtcgaaggacgtgaagctcatattgaacacgatgaacacggcgagcaacggcagtacgccggcatagagcaatacactcttgggcttggcaccgctgcgtttgagttggcgcagggtcagctggtcggcatcttcgcttgcagcggggctgccgtcatcgtgcgcggccacgctgacctgttccacgatgaccggcggctgggtggatttcagcgagaagaatatggtgccgccgatgccgcatgccacggtgggcacgaacagttgggataccggatgcacggaggtggccagccaagccgccagaatcggccccagaataaagacgatctcgtcaatggcggcttccatggcgtaggccgtgttgagcagctgttcgccatcttccacaccgcgcaacgcataggaccaacgggttcggaccaatgcgccgaatgagaactgcgtcagacccatgatgatggccagggcgaacagcagcggaatcggcacgcgcaccaacgccgcgaaggcgaaggcgagcatggccacgatctgcacggcgagcgcaagccggcccacgcgggcttggccgaaacggtcgaaggcgcgggcgtagaacggggtgacgcagctcatggccagcacataggcggcgctcatggtgccggcgatggtccaattgtcgtagagatggttgagcgccagaacgatgccgagactcatcatggagatcggcaatcgtgccaccgcaccggacaggcagaacgccttggctccgggcagcatgaacaggcgctgatagggcgagtgggcagcggacgacttcgaaaccgcgcgagtcgtggacacaataactccttactggtgcgttgtccggcacgtgcgcccgcccacacgtgccatccgaggggtagcggttcccaagcaacgtcacgcggcgcgtttcaaccgcggaccggtacgtggccagtcgtcttcatcgtcggagatgccttgcgatgcataaggtctctccgccggtgaaggccgtccgatgctgtacaggtcatgagcctttgggctcagtcgttgtcagattgttcgggaatgccggagctcaactcggtaaggatttcctgtttggttttcgcgcgggcgtgaagctcgcgcaagccctcgtcgggctcactgacatagtagagagtggcgtcgatactgtccaattccacaccttcgaccgctgccagcagcagtcggtacatgtcgagctgggcgagtttgcgggtgatgtcgtctggcttggtgggccgacgaccggttttccagtcgaccacggtaaagcgtgcggtggtgctggacgggtcaagtccaccgatgaataccgcatcgagtttgccattgaccaggcccacgcccggcacgtccacgacgatggcacgctccgtccacgccgggatgcgcttggcccacgatgattcggccagtctgcgctgccacgccaccagcttggactcggtggcattgtcgctacttatggaagtggcggaggcggcggatacggcggatgcggattgttgagccgtgggctgtgggacagcgggctgccgtgtggatggcttgcggcattgccgctcccgttcggccaaatcggccaacatggcttcccgggaaacgaatcccgcatcctgacctgtatgcggcatacttgattcggcttcatatgccagtaccgcttcatccggcttaccggcattgatgaattgctcagcccacgcatggaactgcgtgccggcctcggccgccggagacgatatgcgcggaatcgggcggataatgctacgccagtagaggcgctcctcccgttcgttcatgccacctacgcgggcttgcaggcttgtcacgttctgacgtccgacggccagaatgcgttgcgccttggctttgactgcctcatcaagcgactggccgctggcggcatcggccatcaaatcggcgtcgtccaccagcaattgcgcccgttgcagcagtggaccggcgtcctggtgctgctcaagtgacgaggaatctgcggcgataacatcgatgccacgtgacagctgttcatgcactgcgtcgctgagggtagccggccacggcaattcgacagcggcatccgtctgcgtaatcggcgtctgccatgcctcccccaccacggcgtcaccgtatgccgcggcatgctctccgataaagaacccttcgggagtggcaatcgcttcgccttgcgccgagatcagcataggcttcccggcattggcggcttgcagccgttccacacagtcctgagccgatatcgcatgttcacgggcttggagcgcgtcatgcacttcaagccagaaattggatggctgagcggcgcgagagcctttgggcaccactgacgggtcccgcccggattcgcccgtataggcgcaataggtcatcagggcatcttctcgcgcacgggtaagcgccacatacatcaatcgacgttcgtcggcatgcagccggcgcccatattcctccgcctgcgtcaaataccagccggatgcatccacttcttccacgccatcgccgaattcgcgcatggagccgaacacttcatcatcaataagctccacatcatccaaagccgccaacgatgcgatggggtcggcttccacatcggcatcatgggggaatcgcggcagaatgccggcatcggcacgcataggcacgggtacggcggtggggttggtgagccaggagtcggcggtctcatgatattcgggtgcggtccagtgaccttgctcggtgcctcccgtatggtgctcgtccagcacgatcttgagatggtcgccctgattgctggggaatccgacggcggtaagccccactaccgcaacggcatcccattccaaccctttggactggtgtacggtcatcagttccacatccaccggagcgtcagggagactggcggcttcatcctccaccgaagccagatgatccacccatgtgatgaacccatgcaacgagggagtttgctcagcggcaatctcttgcgtgtacgtatccaccaaatccacaatcgcatccataggcatatgcgccaaagcgggattggcgcggtgctgcggattatgcagcacaccggccaatacggtgtcgatgtcaagatccaacgcttctatgccggcgcgaatcacgtcgcccagtggccgcccgacggcatcatgcacctgacggagcatcaccgcggcccgggttatggcgttgcgcccgtgtgcgctcaaccgttcaagcagttttaccaggtcgccgcgtagcaatacgtctggcaggaataccgcattggccacctgatcgcggtactcacgcaccacagccgcccattcattcgctggtgtatccggttgggcaaggccggcctgcaccaatgcttggaagcgttgttccgtgttctgttcttcagcaaaacgggccaacatggtcaaatccgctgcggacatggtgaatcgtggcgtggccagcaagcgcatcagcgatcccgtatcggtgtggtcggcggccacgtgcagcaacgccatcagatcgcggatttccggacgttccaacagcgcggaatagccgaccacgaatgtggtcaatccggcctgttccaatgccgcctgatattcgggcatatgtgatttggaccgaaacagcacggcgaccggcgctttctgttcgcccggcatctgttcctgttgttcggctgcggaacggtgccgtgcgatggccgtcttgcagaaacgcactacggcgtcgatctcctgcccggccgtggcgaagcccagtactcccaatgttccttcgggggcatcaggcatggggtcgagcgatgagacatcgacctcacgcatcaatgagctggaaggacgcgacggattggagcgcaacggcagcgtgagattattggcggcttcgagcactatacggctgtttcgcctggtgacggacagcgggaatggcttgtatccggcagacaggtggaaatcttgctggaacatacggaatgcaccagggctggcaccacgccatgcgtaaatcgactggaacggatcacccaccgcgttgacggcggacctctgtgacgcatccacgtggaacagtgctgccagcagagcggcctgcgtggtggaggtgtcctgatattcgtcgagcagcacgtggctgtacctgcggcgcgtacgctctccgatggaggggaagcgctcgataagctgatacgcggcaatggtgaagtcggagaattcggccatattgcgttcccgcttggcttgggcataggcctccaccagctggagcagaatatcgcgtttgcgtgtggtctccagcagcgcaccgcaatgataggtgcagcgggcgtgcaaatgttcggcacggtcatcgagcttggcttgccagctggcgtcggtatctttcttcagtcgtttgatcttggggattttcggctcgtcctcgggcatgggttcgtctgcaacggcttgttgcaatcgattgatgaatgccgaatcccattgccgtactcgattgatcgcatcatcgaagctggtgcagccggcaccgatcatggcactgccaatggcatccgacaacgccagaacacggttcgccaaactggagaaggcgccaaaatcctcactgaacgccagatccatgtgactgtcgatgacttcggtggccagttgaagcgctccggctgcgctcaatggttgcgtgttctgatcgaatccgacaagcagtccatattggcgcacgatggtctggaagaaggcgtcatacgtgaaaatggccggcttgaggaatgcccgatcagacaccgtggcggtcgtagagcccgccatatcaccggccactgcggcggagacgcgttccagcagttcgcctgcggccttgcgtgtgaaggtcaggcccaggatgcgttcaggtgccacacctcgattgataagcgcgatgatgcgttgggtcatcgtaaaggttttgccggaaccggcaccggcaaccaccaatacgtcagcatcgactggcgcatcgatgatggcggcctgttccgcactgggagtgaacgtgctcatgcttgcctcgtttcgaaaatcgtgtcgatctggcctgcacaggcagggcagacgttcttcatacggcagaatccgatatgggtgtcttgcggatgggcctcgatgatggctgatctgctggccgccgcggcatagaatacgcgggcgatcatggtcagcgaccataacgtctgcgtaccggcgagcgcggcgaattgcgcccacgcttcggcactcacaccttcgggaggagtagccggatctatggcgggtatgtcgaagaaacggttggggtctttataccagtatcggggcgtgaacggttcggcattcaacgagccatcagtgaacagcggcggctggaaggcaccttccggagcgtagcttctggctggtgccgcattctgcccgacatggaatagcacgctttggctgatatgcggcattgcggcaagtgccttggcaccgcgcggcccgtcttcggggaacacgaggccaagctgatagcacacgagctgcaaatcattgaaaatctgtttgaccgtgggcgttctgcctgttttgtagtcaatgaggcgaatgcattcgccgccgtctgcgagtacgcgggtttccatacggtcgatgcgcccggacagtctcacggtcagatgctcgtccatgccttccggccaccctccgaccagtgctcccatcagacggaccagcgtgttccgaccgattgggtgcaggccgggcacggcattgtatgcgtcgagtatgtcacgcacatcgaatcgtgcggcaaactcccgttcgcattcggcaccggccaatgcgccaatgctgaagttgctggagttcttgccaagatacgtttccggatcggcgtcgctgcgcacaaagtaatcggcgatgttgcgcagggtatccgccgcggactcgtccttacgggtggcctcatagcggttccgggtgtcggctatggcattcggatcaggacgtttgctctgatagatggcattaagccgtgccgagacagcctcgatgcgacgttccgcgccggccgtggagtccaagcccagtgcggccaacgcctgggcattgtgggaaagatggtccagcccttcctcgctgccttgctgcgcaaccgcatggatgagggttccgaaactggtggccacggagctggggcgaggaccggcgaaccggttctccagcatccagcacaccgggcacgcccataggctgtcgaccgccgatggagataaggtgaccatgggcgcggcctgcgcatccgtcttgcctttccctgtttggataccgtcaggctgtacaccaccagatgacgcgctgtcggatgaggcactgtcagatgaggtatcgccagatgacgcaccgccagatgacgcaccgccagatgacgcgctatccgattgggccggcgattccacaaacgcccagctctgcggatttgcggcgcgcacaccatgctctaacaggagtgtcaacgcaatcgcggcgtcctttgcggcagcctgctgcggttgagcagtggccagaaccgcgcgggcggcgctgaccaacccacgtgggtcggcgtccaatccggccagatcatattcggcgaatcccgcatgtgcccccactgtggtgaaaggcgcctgttgccggttgcgcggatagtattccggcagatacccgaagagaaagtccgaggggctcatgctgtcgttccataccgcgctgatcatgattcgccgtgcacgggtcagcgcgaccaggaaactcttcttctcgcccgacaatacagccgcgaaccgcggatcatgcccggttttgtcgctttcttcaagcgctcccctcagcacgagctcggcaaggtcttcaccaccgaacatggtgttgcgcccggcgaggttcggccacacgtcttgctggaccaccggtatccacgcatattcccagtggcgtccggccgcgcctgccggcgtagtcaatgtcaccgcgtcttccaccggtcctatgtgggccaaggaatcggcctgcacttccatgccccgaacctgtgccatgaatgacgtgatgtctcgactggcggtggaatcatcggcgaactggaacaggcgcattgccgcgtccagccggtcattggccgtacgcccctctgccgtgttgaataatgccgcacgctgccagaccggtgccagaccggtggcgttccacgcaacagacagcgcatagcgcggctgtacgcgctggcttgccggcagccgctccaagccggaagcaacgctgcccaccagatgccacaggttcgcaaaagcgcgggcctgagggtcgttgccgagcaccgcgtggatggatgcgagcgcagcctgcgccggcgcggcggcatcatcaatggcaagcatcacgtacagcgcgtcaacgccaaaggccaagtcatcgccggacggttcaccgagtatttcgacagacactggcaacgaagtcactgacgacgaaaccgctgacgtcgaaaccactgacgaggatgtttcacgacctgtttcacgccgtgtttcatggtatgtttcacgcaatgtttcccatgccgtcgtcagagaggtcagcatggcatcatccgtggcgagatgcgccagcgactccaacgaccccatggccgattcgatcggcgcaagccttgcgggacgcccctgaccgggtttggccccggcactcaccaacgggccgttcatcaacgtggccactctagtccttatatatgccgcgcaggaagccaacgtcatctggcattccgccatcccctcggcacgcaatcgggcaagctccacaagcgcgaacaatccctgcacgaaagtctcgtccttcaaaggacgggtgaccgacgaataccgcaccggtacaccatctcggcgcagtcgttcgccgaacagccgcacggcggcattgtcgtgggtgatgaccgccatgtcgttccaccgaatatgccggtcaagatgcgcccgcttgatgcgccagaccacatcatccagctcctcacgtgaggatcggtacaggccggcggtcaccgtgccgtccgcctgataattcgctgcatcgactccgcccagtatggcggtcagcttgccgggacgctcggccggaggcagcggctcgtcttccggcgagggaatcgacagcgaaatacgagacgcgatcacatcagccatcgtcatgtgcgactgatcagcgacggcactgccgccaaccagctgttcttccttggccttcagccgcccttccacggcacggcgcatcagatattccggatacgatccgcggaaggtctgcaccgattcatccgggttgccgaccagcaccaacttgacgccggcattccccaactcctccaagaagcgcatgccggccagcgtggtgtcttgaacatcatccacaaccagcagccggggcaagcccaacgcctccacacacataggccggtcggaatcatccgcgtgatcggcggcgaatgcctcacgcaccacacgagcgcctgccaccagcaaatacgaggcatccaaacggtattgccccggatataccgcgctttgggctgcaatatattcacggcgcaacgcgaaagccaaacgccattgcaccgacaatcgcgcgtcctccgtcacggcgtccaagagacgtggctcttcgtgaacgcctacaccgagctcatccaatcgggccagcatatcgcgcaactggctgataaacgcatctgaaatacctcgcgtgaacctatccgcgctggtcgagccgcctgccgacgtcggagacggcgaatccgacccttgttgcgagaggcttgattgtgcggaagcggccgagccgggcatctcgccggcaccggcatcgcgtatgagtctcgcccagtcatcctgggcaaagtagacgcgcagcaaatcacaggtgccgcaatcatctcccgctacggcatggcgcagatgcacggccatgacttgacgcagcaaagcatcctgttccgcaccgttcagcaatcgaggcgacggcaatccagttccctcgcgcgaagccgatatggcccggaatgccacggcacccagcgtggtgaccggcctggcctgcacggaaaacccgagctcacgaatcacccgattgcccaatgcgtcggcggccacacggccggatacggccatcaccgcctgcgtgccaccgtagcggcgcagccccgccatcaacaccgataaggcgaattcagttttgccgcttccaggcgtgccgacaatcagcctcgccgctccatcacggtcgatgccgtccagcactgttccaggttcaagtctcgtcatcatggctccagcctaaacccgaccgtcacagagggaaaaattttaccgaacccgacgaagaatcgtacccttgacggtatcctgtagaacgaatgcagggagagcgcattttccaaggagggagggaacagatggacaacattccgatgagaccgccgaagctgcccggatatgatttcgtccagatgttgggaagcggtgccaccgccacggtgtacctatataaccagcgtatgcccgaacgcccggtggcggtaaaggccagcgccaaaacccttgacccacgggccgctgccctgttcaaccgcgaggccaacttcatggccaagctgtcatcccacccgtacattctgccggtatatggtgccggcgtcacctccgatggccatggctacatcgtcatcgaatatgcgccgggcggcacctacaacagcatcatgaaggcccggtccatgacctgcgagcaggtactcgacctcggcatcaagctgtcaagcgcgctgttcaccgcgcatcgcagcaatatcatccatcacgacatcaagcccagcaacattctcatcacctcgcagggcttgcctgttctgggtgatttcggtatctccaccgatgtgtatgaccgcaccgaaaccggattctcgccgccgtgggcaccgcctgaggtgcttcagcatctgaccaatggttcggaagccgccgacatctattcactggcggccaccctgtacgccatgttcgtcggctgctcgccattccagcacgattatcacccgcgttcgcaatcggaactgatttcgctgatcgtcaaccagccattgcctcgcctcaaccgccccgacgtgccggccgatgtggaagcggtgctgcgccgggccctgaacaaggaccccgaccagcggtactactccgcgttggagttcgcacgtgccatgcagcgtgtgcaattcgcatatttcgggcatgccactcccgttaccgtggaagggatgccggcctatcccaaagacatcgagcgtcggcgccgggccacggaccagcgagatcagatcacccgttcgtcacggcgatgggtcaaaccggtgggtattaccgtcggtatacttgcggcgatcaccgcagcggcactgatattcgccttcgtggtcgttccccgcatggacagcgccaccggatcagataccaaacaggtggcgacgcccggcaccaaggatgatgacaacaaccgcaataatcaggatgacgtgatcaccgataccgcgaacgcccagattccttccccggagaatctgaacggcacctatgcggcggatgggtcatccgtgacgttcacctggacgaatccagacccgcaaagcggtgatacctatgcgtgggccatagtgcagggcagcaataccgaccagagcgcgcaaaccgtcacaacgtcagatcccacggtgaccgtcaacgcgcaggaaggctcgcagacctgcattcaggtgtccattgtgcgcaagaaccgccagatgtccgtcagccccgccatcgcctgtgcggccaagccgcaagaatgatccgctcgccactgccgggcatgccaccctggcattgcgtatcgcatcagacgtgcgcccagcagcggcgaattcaccaaatggacaacaggaacggcaggtattggaaccgtaaagcgttgtcattacaccagcaaccagagaaaacaggggtcagggagttcagatggccacatcgtcccagtcatacgatcgtcgccgacgcatcagcgcggctttgcgccgccttatgccctccggagggcatacgtggacggttcccgtaatcacgctcctgctgcttctgggacttgttgccggcgcggtgatcatgagcaccgtcacgcgccgccatgtgcaactggacgatggcaccgtatgggtcacttcgctgaaaaaccagaaggccgcacgattcaacgtaaagaacaaggaggccgacgccggcgtctcctcctccgccccacgattcgacatcgcacagcataatggcgacaccatcctgaccgaaacgaccaaagcctccaccatcaaggcatccacggtcagcaccggtgtcaagaccgacatcaaagccaacaccaccactgtggtcggcggggataccgcagccctgatcaacgagaagaccggcaatgtgtggaccggcttgtcggaaaaccttgattccgtgacccccaccacttccgatccgaaaataaagctgggcgagggcgggcgcatcgcagtaacccacgatggcaaggtctacggataccgtccatccgacggtatggtgctgcgtcttgacaatcccagcagcgccaaggccaaaaccctcgaatcgctgaccgacggcaagcagcagaccgttgaaagctttaccgtcatcgggagcacgccggtaatcgcaaccggcaaaaccgtcatattcaagggcggccgcgtcgatgtcgacacgaccggcaccctcacccttcaggagcctcccaccgatgacatacagtccgattgggtggccgcggcatcaccgagaggccttgcgcttatcccgttgaagtccaatgccaaggcgaatttcatagccaacgggggcaaggcgaatccagcacgaccggtatcgtccaagggctgcgtgtactcggcttggagccagaaggccagcaactacattcgcgcctgctcccccacggataccagcgtcaagccgcaaaccctcgaatccgtcaatactacttccgaattggtgttccgcaccaaccatcgccttgtggtgctcaacgacacggttaacggcaatgtgtggaaccctgaggattccaccaaagtcatcaaaatacagtggaacaaaatacagaccgagcagaccgagaaagaacagcagaacaacgactcggccaacaaccaccacgacttctccaagacctgttccgcacaatccggccaaatcaaagccgaggatgatgaaatcggcgcacgagccggttcggaacagattctcgacgcgctgcgcaatgacgagcagaccgattgttccgtactgaaaatcaccaaggttggcgcaccaaacaacaaagacgtcaccatttcgccgatttacgacggccggtatctgcaactcgatgcctccgccgcatccgcaggcaccgttacctttacttacgatatttccgatggtcgcggccagacctcttccgccacggtgaccgtaaccctgaatgatggaggcaaccacgctcccgtacagttcgacactcctcccgagatcgatgtggagcagggagccagttataccgccaatgcgctgagcagcttcaacgatccggatggagacccgctcactctggtctccgctgtggcccagaacaccgaccaggtgcaggtgtccacccgagccgacggccagcttacgttcaacaccggtgcgctggcgtcgggacgtgtgggcgtcgaggtcaccgtctccgacggcacggcaaccggcaccggcatggtgtatttctcggtcaagcccgcgaacaccttggccgcggtcatcgacccggtagcgaaaaccaccgttcccaacacggataccgtcgtcaagctgtcctcttatgtgcatggcacttccttgcagccggcacaactgactcaggtggatacgcccaacggcgcttcgacgaccaccaatgcggcggatatgtcgttgacgttcaaggccaccaatcccggcacctattatgtgccctacatcattactcaaggttcgattccggccaccggattggctcgagtcgaggtgcagcctgccaccggcgaggccgccaaaccggttgccgccaacgatgtcgccctgcttggcgcggataataccgccattgtggagccgctcaccaatgacgtcgatccgatgggcggtgtgctgtccgtcaccacggtgagcgcaccggccgactccggcatcaaggttggtctcgtcagccataagcgcgtgtatatcaccgcgcgtcaggtgcccacgaagcccgtcgcccttacctacaccgtggccaacgcctccggaaccgccaagggcaccatcgtgttgcagccgccggctctggccacctcgaattcagtgcccaaggccagcaatatcaatgcccaggtgcgtaccgacggcatcgtgtccgtggatgtgcttgaccatgtggcctactcggatggcaccacggtcaaactcaagaacaacctgcaatacgacaaggggacgttcaagggtctggccttcgtctctggagacacggtccgctaccaagcatccagcgagaccggcaacttccccatcacctatacggttgaagacaatctgggtaatgtggcttccgccaatatcaccattaccgtgcataagagcgacgcagcgagcaaggccgcgccaaccccgcatgacgccgaagcgcaggttgccgccgggcagaaggtccgcatccccatcacactgaccggcatagacacggatggcgacgacgatcagctgttgggtctgggcaacaaggcacccacgctgggccgcatatccgaagtcggttccgactacttggtctatgaagcgtatccggattcgtccggcaccgacaccttctcctatgccgtggaggattggaccggtcagcgcgcacaggcgcagatccgcgtgggcgtattccaaggatcgtccgactccggcgtatacgccagggatgacgaaatcacgttgaggcccaatacggccgcaaccgtgccggtcgcgcagaacgacatctccggcgacaacaccaatctgaccgtcgacaagcatgtcgaggtccaaggtctcgacggggtgagcgtgaaagacaatatgatctccttcaccacgcccggcagcgccaccaccgactatatcgcctacacggtcaaagacaaggccggcttgtccgatacggccaccctcacggtaaacgtggatccgagtgccgccatcgagccgcctaccgcctacgactatcgtgtgccgtccgccgccaccatcgataagaagtccgtggatgtggatgtttcccagtggatcgccaatccttccggcacagccaatgagctcaaggtcggcgtgcatccctccgccagcgctcacgctcacgtcaagggcggcgagcattcgaccaccatcaccgtcgacctgacgtcacaggcgcgagccgtgccttacacggtgaccaatacgaaatacaacatcacctccaccgcgttcatccaggtaccggcctatggtgtctttccgcccacgctgcgtcccaaggcaccggaattgaaggtcaactcgcgcgagaccattgaaatcaacatcaatgactatgtccgcgtcggcgccggcaaggaaccgtatatcgaaagcgctgattccgtcagcgccaccaaggcttccaactccgatttctacgtgaacgacaagaccctgaagttcactgcggcaaaagactacgcaggccccgcctccattacctttaccgctgtggatggcaagcagggatcggataagaccaagatcatcaattccgcagtgatcactctccagatcacggtgataggccgcgatgtgccgccgcccacgttctcgtcctccactattgatgtcgaggcgggcgcggaccccaagaccgttgatctgacggcgctcacccatgcaccgtccggcgtgtatgacgacgaaaagcaatacacgtattccggtggaagctcatcatccaggcaaatcaccgcaaacctgtcccgttccggtagcttgcaggtttccgccaccaaggatgccgatcctggcaccaccgcgtccattcccgtgcaaatcgcatacggcgcgggcaccgtgaatgccggtgtgaccgtgcgcgtagtgtcttcgacccgtccgctgacacgcgtcggcaacaagacgttgaagatcaaggccggtgccagcgatgccgtgaacgtgcttaccggcgcgtacaatccgttccccgattcctcgctgaccgtcatcagctgcaaggcggatgacgccgccaaactcaccatcgccggatgcgatgcctccggaaacatcaccatcgccgtcgcatccgatgtaggtgcttccacgaacaccgtgctcgtcaccgtgcaagacggcaccaagtccaaggatcgtgaagtcaccgcatcgattaccgtgtccgtgatcgacaagcccgagccgccactgctctcccccgtagccggggaaccgcaggacagcgcggtcagcctcacatggacgcccggtgccgccaatggcagcccgatcaccaactacaaggtcagttggaccggtgccgtcaccggagagaaggattgcggtaccgtcacctcatgccaggtcactggtctgaagaacggcaaaacctattccttcaccgtcgccgcgcgaaatgacgtcggctggtccaagccgtccaccgccgccgaagccacaccggacaaggtgccgtccgctcccaccgatgttacggtcacaggtggcaataaaaccgccaaggtgacgtggaaagcgccgagcggtgatttcagcgccgtcgacaactattcagtgaccgtcaccggtgcaggtgctccgcagaccaaggaaaccggcaatacggccaccgagctgtcgtttacgttcaacaacaacgacatttccgatggcaccgccattacggcgaccgtcaaagcccataacaaaatcaattggagtgccgagtccgccgcatcgccgtcagagaagatctggggagacccggatgcgccgaacattgcgttgtcgaacgacgacaccacggtaacggcgaaagtcactctcggcaataaccacaatgccggctgccggcgaatttccttgggaggagacgtcaaggacaccatcgattgcagtgacagtggcgctacgttcgatatcaatgagaacgatttgaacacccgggaaatcaccgtaacggccaccgtggtgccgcagcgcgatgcttcctccggcacgggcaagagcagctttgtcccgcagtacaaggtccagccgcccactgacgtctacaccaccggatccggcagtacatgcaccgtgcattggaccaagcagggacatgcgcagtcctacagcgtgactgccgatggcatcgattccggtacagctactaaccggaactcactcgacttccgaatgagtccttgggccaaatgcaacaccgcatcggtgcaacaggtgttcaacggcgctaccagcgacgccgtcaccggaggcccgcacaatggcgctccttacacctatgagaagaaggctgtaatcaacaaaccgcaggagctgcgctggtcagacaacgctcacgtcattaacgtcaccggcggttcggttgatgtctatggcaagtcggccactgtacaaatcatcatcaatggccaaccgttcacgtggaactccggccagccattggatgtcaccgacttggccgtggccgccgatggcaactacgcgtggagcgtcaaagtcaccggcgggccgggatactccggtctcgacaacactgcggacggaggcagcgtcgcgggcacacgtccctctgactcctcggaggggaccaagtcgctcaaatccggtaccgatgtcaccactttggccaagaacccctggattcttggtttcggcaataccccaatatcgtcaaccaccattcacaagcagtaggagaacatccatgagcgagaacatcgatgacgcgacgcagttgtctgacacgacccgtctgtccgacagcacgcagctatccgacagcacgcacttgtccgacgccacgcacctggcatccgcaccacacaccggcacgaccccaagcaccgagtcggcgccgcagtccgttgcgctgcctaacctgccgcagcggccgtcacaagcgccgtcagaaaagccgtctcctactactgatgccgcctccattcctgcgggcgatgacagcaccgtgctcaagccgcgcaagggatcgacgccagccatcccgcagcaggccaccgcgcaatcccagccgcaatcacagccgcagcgtcagtcgagcaaagccgcgcaagcagccgcatcggcactgcccgccagcatcaattccggactactgccccagcccacggctcaggtccgggatttccagcagtccttcaatgcgctggtcgaaaatgtctccaaggtggttatcggcaagaccatccctatcaagcaatgcgtcaccgcactgatggtcggtggccatattctgcttgaagacaaccccggcaccggtaagacccagttggcccgaggcttggccaattccatttccaccggtttcaagcgtgttcagttcacgcccgatctgctgccttcggatgtggtgggtgtgactttctacgatcagaagcgcggagaatttgagttccgcgaaggcccgattttcgcctccatcgtgctggccgatgagatcaaccgtgcatcgccgaagacgcagtccgcgcttctggaggttatggaagagcagaaagtcaccgttgacggcgtcacacatgatgtgccgcagccgtttatcgtgattgcaacccagaaccccatcgagcagctcggtacctataagctgcctgaggcgcagatggaccgattccttatcaagacgtcaatcggctacccgggccatgatgtgtccgtcgatatcctcaagcaggtcgatatcaccgaccgtgcgcagaccatttccccggtgctgagcggtgacgatgtcatgcggctgcgtcaggtggccaccgaaatctatgtggataatgcgattcgtgaatacatcgtcaggctcgtcgaggcgacccgccacaacgagaagatcacggtcggctcctccatgcgtggcgctttggcactgacccgatgcgcccgtatctgggccgcggccgatggccgtgcctacgtggtgccggatgacgtcaaggaccttgcagtggccgtgctcgcacaccgtatcacgctgactccggaagccaccttcgatggcgcgactccggaaagcctgatcgcacaggtgctcgaagacgttccctcccccaccatcggttcctgatagggcccggaaaggtatccgaccatggcatctacatccgccgcattacgccgtcgccggcgcgctgaacgcatgttcaagcgcgcggtaagacgcatcagacggttcttcgcatcctacgtctcgcccttgggctgggcggtaacgggcgcaggcatcgcatgccttattgcgttcccgtttctgggctggtatgagctgctcgtattcggcatcgtggcgatggtgatgatgctcgcggcaatcgtgctttccctcggcaacacacgcttccacgcgtccatcgtcgtatccaatcatcgcgtgaccgtgggagacaccgtatccgttatcgtcggcatcgacaacaccggcagaacgccgacgaccacggcacgcggatatctgccaatcggcgatgcgcatgaacgattcaacatccccatgctggctcccgggcaatccaagcaaaccgatgtggagttccgtaccgtatcgcgcgcaatactgcccatcggcccattgcgcatccgcaagggagacccgttcggtctggtgcgtcacgaaaaggagctggccgaccgcatcaccgtattcatccaccctcgtaccgtgcgtctcgatactctgaatgccggcgtgccccgcgacctggaaggccaaccatccggccagatcgtggatgatgatctcgacttctacggattgcgcgaatacgagccgggcgacgacgtgcgtaacgtccactggctgagctccgcgaaaaccggcacgttgatgattcgccaatatgaggccacgcgccgcaccgacacctcggtgaccatcagcgtgaacccggacgaatacgtcaacggcgaggaattcgagatggcggtgtccatccactcctccatcggcgtcaaatgcctgctgcaggatcgtccattgttctgccacgcgggcaacgcgcacggccagccgcgcaacgccatggagttcctcgacaacgccagtgccatagagcctgatcgtgaggataatccgaatctcgccgagggcacgctgaagcacagtcctgatgcttcgttctattttttcactgttggatcgctgaaagacatcgagcaaatcaagcgcatgaccttggccttgccccgatcggccagctgcgtggtattgcaggccagcgccggcgccaatcgcggcatcagaagattcgccaacttcacattggccaccatcggcgacctcgatgatctcccgctgatcatgggggtgctcgcatgaccttcgaccagtccagtatcaccaataccaataccgctgcgtacgccggatcgagcggcacatacaccggcacttcctccggcacgtacaccgggacctccaccaccaccggctcctgggccgactccacacattcggttatctggatgaccagaggcaatgtgcttcgcggcatgggcctcagtcgccagccgtggggcaaacgaatcgccagcctcgtactcatagcggcgatgatgttgctggcgcaagccaatctcatcgacgtgtacggcggcgtggccacttgggcgattgccgctgtaccggccaccttgctgggcgcgatcatcgctctggcgggcatgttgccggcgttgcgactgtggtggcaaatcgtgtttctggcgtttgcccaattcatcatcggcccggtggtaacgctgagttccactacgtcccattacgtgattcccaccttgaagaccttgagttcaggttgggaaatgacgtttggctcgttcaagtacattatttccgtcgatccgcctctgggcacgcaagacggcgtgctgatggcggtatggaccatcggcctgtggcttacgttcttcaccggcgtgtttgccattaatgccaacgcatggttgtctctggtgggagtgctgccccttgcggcggccgtggccgtatgtgccctgctgggcacagacagcggctggcaacgcgccatctgcggtattgcctttgccttgctgctgattatctggctgtcttggcgtcttgaactgctggaaggggggcgctggatatccgcgctgatcatcgtcgtgctcgctgccggccttgctttcgggggcacgttgctggtgccacaggaccgtttcgtgctgcgtgaccgctacgatccgccgttaagcccctacgattacaccagcccgctcagcggcatgcgatcctatatcaaggaccacaaaaaagacgtgttgctgaccgttcataatctgccggccggaacaccggtcaaacttgcggtgatggatcgattcgatggcacagtatggaacctgtccgattcttccgaagccacggactcctcgaattatcatcgcgtgggcaccacgatcaaggcggatgagcagggtaaatccttcactgcgaccttcaccgtcgatcaggaactgaccgacacctggctgccgctggcgggagcggccactggcgtgagcttcgccaacgatgccgacaacggcaatgacacgttttactacaacacggataccgattccgccattattcccgccggcacgcgtaaaggcctcacctataccgaatccggcattatcgcccgcaagcccaccgataagcagatcagcagtgcggctgcggcccgcatcacccaaccagaagcccaggatgttcccgattcggccagcaaactggccacgtccattgccggcgggcagtcctcgggcggtgccgcagccacggcgttggccgacacattgaaagactccggatggttctctcatggacttgaaggcgactatccctccgatgccggccatggcaactaccgcatcaacaagctgctggcaggcacggccatggtgggcgactccgagcaatatgcctccgccatggcactgatggctcgtgatctgggactgccctcccgtgtggtcctgggcttcctaccgaaaaacgaggatggcgaaatcaccgatgcccgcacggagaagacctcaggcaatggcaccaaaatcgaattcaccggcaacgatgtcaccgcttgggtggaaatcaaattgcagggcctgggatgggtggcgttctatccgacgcccaaggagaccaagatgcctgatgaaaaccagaacctgacgccgccgaatccgcagacgctggtccggcaaccaccagtgccgttgaccgatccgctgcgcgatcagacgcaagccaagggccaaagctcattggccggcgccgacgccgatgattcgccgaccaacctgttctgggcgcggttctggcgagtgacccgcaaggtggccctgtacggcagcccattgtggaccctactcatcgcctgcggtctgattctgatgttcaaggccatactgctggcacgagcgcggcgacacggcagtccgaaaacccgtgtggcagcaggttggaatgccatacgcatgcttgccgagcaaagcggcatcacagccaagggcactcgtcgagatcaggccggtgccatcgcccgtcaactcggcacagatgaccaggctttgatccagcttggccgggaagccgactacgccacgttctcggggcaagacattgaatcgggccaagccaccacatattggacaggagtcgaccaattacgcaaggcaatgctcgcttctttgccgcgtttcaggaggatacgtacacgactttccctgaaaagcgtggctatactgtcaaatgggcacgcagcaaagccgcacacgacgcatgtcaagcgcacgcgtaagaaggggaaggcgtcatgaccacaggctccatccgtatcgcgatgaccagtgacgtgggtcttaggcgcaaaaacaaccaagacaccggattcgcgcaacaaggcgtgttcatggtctgtgacggcatgggcggcggcaaaggcggcgagcaggcaagccagttggctgcccagcatttcgcacaattggccgccatgccttcacgcacccgtcaggatatcgacgacaccttggcacgggcccagcacgacattctcgatctgggagaccgccttggcggcgtggccggcacaacctgctccggtttggtactgccccaagatcatgcggattccgccagcgcccgcagcgctgctttgttcagtgacgccgatgatcaggacttctcggaccagacctatgtggtcaatgtcggcgattcccgcacctaccatctcagtccgttggcgcatgccgatgctcccgccacggatatcattcccgtgtgggacgccgcttcgctgacccgcatcacgcgagaccattcccagcgccaagaagccatcgattccgggcagatgttgccggaagaggcggaggcgaccattccacgcaacatcatcacccaatgtctgggtgatccggatggcatcatgcccgacgtatatgtcgccgatctgaccggccgcttcatcatctgttcggatggattgcatggcgaggtgccggacgaacagatcgcggccatcgccgcggcgcattccagtccgcaggaggccgtggacgccttggtggcggccgctcttgatgcgggcggaaccgacaatatcactgtgattgtggccgatatgccattgaccgaacccgaacatcatgcgttcagcgcattcaggctggacgaaggtgaggatatcggcgccattgaagacgcaacactacaaacactacggaccatacgttcggcataaccgagcgaacataaggaggtaatcccatggttgattatgatgctgcggtcgctgccgttcaggatccgaacgcggatccgattctgctggcaaaaatcgcctacgagaatccggaattcggtgccaatgtcgccgtgaatccgcgctgttatcccggcttgaagcgttggatcgccgagttcggtgacgatcgcgcccgcgagaccctggcgcaatacgggttcactgccgaggcattcggcggcccggttcaggatcagaaagccacggcacaggcggcccagcagcccgccgccgaacaggctcagcagcctgcggctcaggcggcattcgaggagcctgtggccaccaatccttacggtttcaccgccgaacaggccctgaccaccaccgaccagatgcaaatcgcccagattgcccagtacgcgcctgaactacgcgcctgcatcgcacgtaatcccaacacctatccggcactgatcgaatggctgggccagctcggcgacccggcaatcaacgccgctctggcttcccgtcagtgaaaggacggcatcatcatggccaaacttccctaccctccagcacctgaactgggttggtattctgacgatccggtggaaggcaccccggattccgcagttggcacagccgaaccgcagaacgactacgggcagcccagtaccgcggaagcggcaaccaataccgcttttaccgcagagcctgccgccacggccgccgccgctgagcccgctgccaccgctccggcagacaccacaccgcacgccgccgaaaacgacatcgaggattgggacagcaccgtgctctcctcctcgttcacgtccaaggcaccaaagaagacgtacctgctgcataacgatgtcaccggccagaccatcgtgatcgataagagcacgttgctgggccgcaagccttccatggatgtgccgcagggtgccaaggcggtgcgtatcgtagacccgacccgcaccacatcccgcaaccatgccgccatcagcatcgacaccgatggcgcgctgtggatcgaggactacggctcgttgaacggcacctacatcatcaccaatggccaagagacacaagtcaccaagggcacaccgctcaagctcagcgcgcctgccacggtgcgtatcggagaccagttcttccagttcaccgaaaaacaggcttgagtaatcaagcaacgagcggctgcctgctcttgttcaacaggaaaatcacaatggcaaatatacggatggcccggaactgatatagttccgggccatcttattgcgattaacgcaagatctgagtcctagaaggggcatcctttctaggaccttctcacttactcctcgatgtcaggctgaccgccctgatcggagtagaaatcatccgggttgaagtcgtcgccgagcttcagatcgccgaactcgaggttcgagaagttcaggtcagacaggtcggcgtcggagaagctcgcgtcgccgagatcgccatcgccgcccagaccgaagttcgggtagatggtgtcgcggatggccttgtcaggctcgaccacggcgttgcggtagcgcgcgaggcccgtaccggccgggatgagcttaccgatgatgacgttctccttgaggcccttgaggtcgtcgaccttctcggagagggcggcttcggtgagcacgcgggtggtctcctggaaggatgcggcggacagccaggagtcggtggccagcgacgccttggtgatacccataagcgccggacgaccgacggccggacggccaccgttcttgacgatgttgcggttgatctcgcggaagcgggcgttgtccaccagctcacccggcagcaggtcggtgtcgccggagtcgatgatggtcacgcgacgggtcatctggtgcacgatgacctcgatgtgcttgtcgtggatatccacaccctgggagcggtacacggtgtgcacttcctccacgatgttgacctgggcggcgcgcttgccgaggatggtgaggatcttcttggggtccacagaaccttcgaccagctgggtgccgaccttgatgtggtcgccgtcggcaaccttgagcggcacgcgcttggagacctggtaggtgatcggcttgatcacgccgtcttccttcggtgcgccggaatcggcgtccggggtcaggatgatctggcgaccgcgatcgttctccacgatcttgatgctgccggcgaactcggtgatcggggcctcacccttcggggtgcgggcctcgaaaagctcggtgacacggggaagaccctgggtgatatcggaggccgcggccacaccaccggagtggaaggaacgcagcgtcagctgggtaccaggctcaccgatggactgggcggcgacgataccgacggtctcgccaacatcgaccagcttgttggtggccaaggaccagccgtagcacttggcgcacacgccgcgcttggactcgcaggtcagcacggaacggcacttgacttcctcgacgccgtgggccacgaggtcgttgagcacgtccatggacagggcgtcgtcgcgcttgtacagcacggtctgtccgtcggccgggtcgatgacgtcggcggcgagcagacgggagtacgggccaccgtcggcggccttgacgagcaccaggttgccgtcgttgtcgcgctcggcgacgcggatgggcagaccggccttggtgccgcagtcctcttcgcgcacgatgacgtcctgggagacgtcgaccagacgacgggtcaggtaaccggattctgcggtacgcagtgcggtatcggccagacccttacgtgcaccgtgctgggagatgaagtactccagcacggacaggccgtcgcggtagttggacttcacaggacgaggaatgatctcacccttcgggttagccacgaggcctcgcatacctgcaatctggttgatctgcatcatgttgcctcgtgcaccagactgcacgatgatggccaggttggaggtcgggtcgaacttctcctcgacttccttggacacttcggcggtgcactcggtccacaggtcgatgagttcctgacggcgagcttcctcggtcaacagacccatctcgtagttggcgttgaccttgtcggccttggcctcgtactcggcgatcttctcgtcgcgctcgggcggctcgttcacgtcggagaacgcgaaggacacgccggaccacggtgcgcgggtgaagccgagatccttcagggcatccagcgtggcggccacctgctgggtggagtaacgcatggcgatgtcatcgacgatcttggacagacggcccttggccacctgctcgttgacgaacgggtagtcggtcggcagggtctcgttgaacaggatgcggccgtaggaggtggcgaacagcacggtgccgtcgtggaagcgttcttccttgacgacctcgtcctcgccttcgcgcgggtcgagcaccttgacttcgccgggctcccagttcttcggcagcacgaagctctcgggcaggcggatgagcaccttggcctgcatgtcgatctcgtggcggtcgagggccatttcggcctcttccagcgaggagaacacgcggccctggcccttgacgccttccagcacggtggacaggtagtacaaaccgaggatcatatcctggctcggcatggtcacggtgtggccgtcggccggcttcaggatgttgtcggaagccatcatcagcgagcgggcctcggcctgggcttcggcggagagcggcaggtggactgccatctggtcaccatcgaagtcggcgttgaaggcggcgcaggccagcggcggcaggtggatggccttgccttccaccaggatcggctcgaatgcctgaatacccagacggtgcagcgtaggtgcacggttgagcagcacggggtgctcggagatgacctcctcgagcacgccccacacttcggcgtcgccgcggtccacaagacgcttggcggacttcatgttctgcgcatagttcaggtccacgaggcgcttgatgacgaacggcttgaacagctcgagggccatcggcttcggcagaccgcactggtgcatgcgcagggacgggccgaccacgatcacggaacggccggagtagtcgactcgcttaccgagcaggttctgacggaaacgaccctgcttacccttgagcatgtcggacagggacttcagcggacggttggaggcaccggtgaccgggcgaccacgacggccgttgtcgaacagggagtcgacggcttcctggagcatgcgcttctcgttgttgagcatgatttcaggggcgccgagctcgatcagtcgcttcagacggttgttacggttgatcacacggcggtacaggtcgttgaggtcggaggtggcgaagcggccaccgtcgagctggaccatcgggcgcaggtccggcgggatgaccgggatcacgtcgagcaccatggcctccggcttgttgccggtggtcaggaaggcgttgacgaccttgaggcgcttcagggccttggtcttacgctgttcggaagcgtccttgatctcctcgcgcagttccttggagatggtctccaggtcgagggactgcaggcgcttcttgatggcttcggcgcccatgcagccgtcgaagtaatcgccgtagcggtcctgcatctcgcgccacaggtccacgtcgtcgaccatgtcgccgggcttgagcttcttgaacttgtcgaagacggcgtccacacgggcgatctggtcgttgtagcgggtgcggatggcagccatatcacgctcggcaccgttacgcaacttggtgcgggccgggcccttggcctcgccggcctcctcaagggcggcgagatcctcttcgaccttcttggcgcgggcttcgatgtcggagtcacggcgctgctcaaggcgcttgatctcggaatcgaactcgtcctgcaggccgggcagatcgttgtgacgctcgtcttcgttcacctcggtgaccatgtaggaggcgaagtaaatcacgcgctccaggtccttcggggtgacgttcagcaggtagccgaggcgggaaggcacacccttgaagaaccagatgtgcgtcaccggggcggcgagctcgatgtggcccatgcgctcacggcgcacgcggctgcgggtcacttcgacgccgcatcgctcgcagacgatgcccttgaagcgcacgcgcttgtacttgccgcaggcgcactcccagtcacgggtcgggccgaagatctgttcgccgaacagaccgtccttctcaggcttcagcgtacggtagttgatggtttcaggcttcttgacctcaccgtggctccaaccacggatgtcatcggcggtggcaaggccgatgcgaatcttgtcaaatgcgttgacgtccagcacttgttaatccgtttctgttcttgagaccttcccaagctccccttgtcaggggagctgtcagccaaggctgactgaggggtagtgcaaaccggaaaggtctctgtacgttatttatttcacgttggcggagctacacgcggcgtattgaccgcatgcagcccgagggatcactggtattcgggctcttcggccttctggtcttccttggcggccgcgtcggggcgggcgccgatgttgaagccgaggtcgtcagcggagctggccggatcgtcatcctcatccttcatgtcgatggccacgccttcggcgttgagcacttcgacgttcagggacagggactgcatttccttcaggagcaccttgaacgactcggggatgcctgccggcggcaggttatcgcccttgacgatggcaccatagacacgcacacggccgtcgacgtcatcggacttggtggtcatcatctcgtgcagcgtgtaggcggcgccgtaggcctcaagggcccacacctccatctcgccgaagcgctggccaccgaactgggccttaccaccgagcggctgctgggtgatcatggagtacgggccggtggaacgagcgtgaatcttgtcgtcgaccaggtggtgcagcttcagcatgtacatgtagccaacggaaatcggcttggtgtacggttcaccggtacggccatcgaacagggtggccttgccgtcggggccgaccagacggtcgccgtcgcggttcggcagcgtggtggacagcaggcccttcaggacctcaggcttgacaccgtcgaacaccggggtggcaaccggggtgttcggctcggccttctcggcaccggacggaatcagtttcttccactcggcttccagattcggatccaaagagatgtcccaaccggagtgagcaatccagccaaggtgcagttcgagcacctggccaaggttcattcgggaaggcacacccagcgggttcagcatgatgtcgaccggagtaccgtcagccaggaacggcatgtcctcttccggcaggatgcgggagatgcagcccttgttgccgtggcggccggagagcttgtcgcccaccgtgatcttgcggtgctgggcgatgtagacgcggatcatctggttgacgccgttgggcagctcgtcgccgtcctcctcggcatcctcacgggtgatttccttgacgccgatgacggtaccggtctcgccgtggggcacgcgcagggaggtgtcacgcacctcgcgggacttctcgccgaagatggcgcgcagcaggcgctcctccggggtcagctcggtctcacccttcggggtgaccttaccgaccaggatgtcgccggcctcgacctcggcgccgatgcggatgatgccgcgctcgtcgaggttggccacggcgtcctcgccgacgttcggcaggtcgcgggtgatctcttcggcacccagcttggtttcgcgggcgtcaatctcgtactcctcgatgtggatggaggagagggtgtcgtcctgcacgaggcgctgggagatgatcacagcatcctcgtagttgtagccgttccacggcatgaaggcgatgagcaggttcttgcccagggccaggtcgccgttctggatggcggggccgtcagccataaccgagccggcttccacacgctcgccgtcgtggacgatcgggcgctggttgtagcaggtggtctggttggagcgctggaacttggccagcttgtaggagctggtggtgccgtcgtcgttcatcacgcggatcaggtcggcggacacgtaggtaaccacaccgtccttctcggacttgatgacgtcgccggagtcgttggcggcgcgccattcggagccggtgcccaccagcgggcgctcggattcgatcagcggcacggcctgacgctgcatgttggtacccatcagtgcacggtggccctcatcatgctccaggaacggaatcagggaggcgccgagggagaccatctggcgcggggagacgtccatgtagtccacggagctcaccggcacatcgaccgcctcttcttcgccgactcgggcaagggcggacttctgcacgaagttgccgttctcgtcgagctcctggttggcctgggcaatgacgtggtcaagatcgcggtcagcggtcatgtactcgacctcgtcggtcacgtggccgttgacgaccttgcggtacggggtctcgatgaagccgaacgggttgacgcggccgaaggttgccagggagccgatcagaccgatgttcgggccttcaggagactcgatcgggcacatacggccgaagtgggacgggtgcacgtcgcgcacctccatggaggcgcggtcgcgggacagaccgccggggcccagtgcggagagacgacgcttgttcgtcacaccggacagcgggttgttctggtccatgaactgggagagctgggaagtgccgaagaactccttgatggtggcgttcaccgggcggatgttgatcagggactgtggggtgatggcctcggcgtcctgagtggtcatacgctcgcgcaccacgcgctccatacggctcagaccggtacgcagctggttctggatcagctcgccgacctggcggatacgacggttgccgaagtggtcgatatcgtcgacgtccacgcgcaggtcaacgtcttcgccgttgcgcttgcccgggaaggtcgccgcaccgtcgtgcagggccaccaggtacttgatcgtggcgatgatgtcttcctggtggagggaacgatcgttgaaatcggcctcgacacccagcttgcggttgatcttgtagcggccgacgcgggccagatcgtagcgcttggtgttgaagtagaaggagtccagcaggttcttgccggcctcgggggttggggtgtcggccggacgaatcttgcggtagaggtcgacgagggcctcgtcctgggtctcgagggtttccttctccagggcgtcgagcaccagcgggtaatccttgaaggcctgggcgatctcggacttggtcatgccgatggccatgaggaacacgatggcggactgcttgcgcttgcggtccacgcgcacctgcggctggtccttcttgtcgatctcgaactcgagccatgcaccacggctcgggatgatcttcgcgccgaagacctccttgtcggaggtgcggtcctgctggcggtcgaagtagacgcccggggaacgcacgagctgggagacgatgactcgctcggtgccgccgatgatgaaggtaccgtgcggggtctgcagcgggaaatcgcccatgaacacggtctgggacttgatctcgccggtgtcgccgttctcgaactcggcattcacgtacagcggtgcggagtaggtgtaatccttctccttgcattcctgcacggtgtgacgcggctcttcgaagtacggatcggagaaggtcaggctcatggtctgagcgaagttctcgatcggagagatctcgttgaagacctcatcgaggccggaggtgtgggccacggtgttagtgccgttcttttcatcctcctcgacgcgcgccttccagcgttcgttgccgatcagccaatcgaagctgtcggtctgcacgcccagcaggtagggcacatcgatgggttccttgatggaaccgaagttcacgcgatccgacgccttgtgcaggtcaatatcatgctggtcggcgcgtgcgatgatggtggtggtgttcgtcgtagactcagtagccaatggacgttccttatcgctcgctaatatgtggtaattcccctgggagcgccggcatggccaccatatgcctatgcggacgcttcattgtcgacggcatgcccgcaatatgacacacctcatgtaaattcaaaagaatactgatatgcgaggacatctttagctcccgctgacgaggaagctgtcgagcggagcgagactgagggagagacccagcgtccaaacaccaaccgcagatcctaccccaccgtaaacgtcaccggatcgctcttcaccttcggatgatccttcaaactcagctgcgccacgtacgttcccgcattgaccttggcccaatccgactcatccgtgcattcggtgagcgtggcgttcgcattggtattccacgtgaccttctgaacgtccttatcacccttggccatcagcagcagacgtgaatccgccgggcacacatcggacttgtaaatcgtttcctgaccggaagtaatggtgagcacacggccggaatcggacccgtccaccaaacagttgcctgacccctcgtgcacgatggtcgcggtgaaatcaagcgatcctcctaccggcacggattgggaggccgcggaaagctgcaatgtcacatcactggccgagcaatccttgacgttgctgactttcttcggcgccggcgtggcgtcgcgggaaatcgcatacacctcgtcatggtgaatcatcgtgttcacggcaccgataccccggccgaggctgtacacgcagaatacgatcagcgcgattatcagcagcaacaccgtaccggccacgatacgccggcgacgatagatggcctgctgctttttgctgatcctgcgcttgcgtggcttgccggaacggttgttctgggagggcctgccggatggcccattggccccggtgccggctccgcgtgccgttctcgcgcctgatgtgttcctctgcactgccataactcttccagtctacggtcaccacacccatacacgcttggggagcccaccattttttcacaatgtcagctgggtagtcgcaggccgccgtccagaatctcgatcaggccgtcatcgtcaaggctggcgatgcaggcggcaagctgaatctggtccttccaaagctcgtcggcatcttccctaggcaacgtggctccagcgggaagctcgcgcagcgcggcgaggaccagaccgcgcacctgtcgatccgtgccttggaatcgttggcgcgggcgggtgcggcgctcccccagtccggggcggccggccttgagaaatgcacagtcgtccgcaatcgggcaggtgtcgcacagcggcgacttggccgtgcagaccaccgcgcccagttccattaccgactggttccacgtgaccgatgggcgttcgccacgatgcagtcgggagcgtttgtcgccccggatagtgctgttcgcggcatgttcggcgctaccggcattatcggcgacgtcagcatcgcatccgaaaatctcgtctttgggcagcatgcggttcgccagcgcacgttcggccggactggccgctcccccgcgcgattcgatgccaaggaacacacggctcagcacgcggcggatgttggtatcgatcacggcaattcgttcgccgaacgcaaagctcatcaccgcggaggcggtgtaatcgccgatgccgggcaacgcagtgagttcgtcatacgtgcgcggcagtttgtcggcgtactgctcggccaccacgcgggcacattcctgcaagcgcaatgcacggcgtgggtatccaagccgaccccatgcggtaatcacctcggccttgggggcctccgcgagcgcgcgggcgtcgggccagcgttccatccagtcggtccagtacggcactacacggctcatctgcgtctgctggctcatgacttcggataccagcacgccccacggcgtggcccggccgaagcgccatggcaaatcgcgcgcattggcctcccaccatgcgcccaatcgcaaagccgcgttcccctgacgattatcgtgcatgccgagactgctgccgttaccgctggaaacgccgtctgaacacgccatggccgtatcggcgcagtctaccgccggggcatagtgagccatatcaacgccatgcatcatccgcgtcctttccaccggtttgaccatcccgcaattccagttgcttccctgagcaaacccattcgaatccatcgagcttatcaagttcacgcatattcccctatccttcgtacactgacatctagagagacgacattgacggaaaggacaatatggacgacgatgacgcgctgcccccccctgagtaattacccagcgttatctgtggtagtgccctgctacaacgaggaatcctgtctgccgctgtttttgccggagctcgcgcgggccgccaagcgcatcacctgcgaacatcccggcgcaaccatcgaactggtactggtggacgacggttcaagcgatcgcacggtgcaattatgccgtcaggcagccgctcatgcacaacggtcatcttcgggcgccgccgatgcgattgacccggctgccacagatgattctgctgccatgacagatgcgaatcccacacattccacggagcccatgccacaatggcccttcagtgtgcaatggatgtcattctcgcgaaacttcggcaaggaaggcgcactgctcgccggtctcgatgtggcgaccggcgaattcgtggcggtaatggacgccgatttgcaagaccctccgtcattgctgccccgcatgttcgacatgctgaccaacgacccggacatcgactgcattgccactcgccgaaccacacgtgccggcgaaccacccatccgttccgctttctcacgcctgttctaccatgtcatgaacatgctgtcgccggtcgaggtgcccgatggcgcacgcgacttccgcatgatgcgccggcccatggtggatgcgattacctcactgcccgagcacaatcgcttttccaaaggactgtacgcctgggtggggttccgcaccacatggattgcatacccgaacgtgccacgtgcagccggcaaaaccacatggaacttcttcaagcttgcccgttatgccgttgaaggtctggtctcctgttccaccgccccattgatcttcgcctcatacgtaggcatcgtgttgtgcgtcgttgcattcttcgccgcatgtttcatcgcggtacgtgcggcactattcggtgatccggtcaccggctggccatcactcgcctgcatcatcaccttcatcggcggattgcaactcatgcgcctgggcgtaatcggccaatatctggcgaaaacctatctcgagaccaaacgtcgcccggactacatcattcgcacaggcaacatcgctcgatatccgcatcagcatcatcgccaataccgctatcgcgaccaacgggccaactgatcagcgattcatccgcaacgtcacgtaacgattcactcgaaacaggacaaccgcatgcatcatctttccaccatcgccgttcgggtccgtcaatcacgctggtcgttctccatactgaccggcgtatgcgcacttgccgcaatcatcatcagctttctgatgggtcgaaaccagtctctgtggtttgacgaacaatactcactgctaatctgcagcaaaccggtccggcaaatgctggcattgactgcggtagacgcacatcctccgctgtactatctgctgctaaaaacatggatgacactggtcggcggcaatgtagccatgctgcgcctgctgaactgcatcttcctcggagccaccgtaggcatcatggcattgttggtgagaagcctgtatggtcggcgcgtagcagtggcctgtctgccattactgctttgcggcggattcatattgcgctatggctacgaattgcgcatgtattccttggctatgttgctcgtcgtcttcggcacatatgccttgctgcgagccaccggctccatacctgcgcatacgcaatcttcaacggcctccgatacgacggaatccttgagtcaccatcacattcacggatggcatgcggtctatgcactaaccgttgcactcggcatgtatacgctgtacctgaccgcgctggtgtggataacccacgtactgtggctgttcatatgctcgtggaaagacagccacgaatccacggtggtgtcgcgccttcgcaagctctccgcattccggtggataccgatttatttcgtctctattatcctgtatctgccgtggatcccgtcactgttcgggcagatggggcatcccgtactaccgccggtcagacgttcgatgaatatgactgggctggcaaatgcctttgacgccatactgctgggacgaaccgaatcgagcatgccatcaatggcctccttgctggcgctgtcaattggtatcgccgtaatcgttcgtctcagtattgccaaaccgcatgatcgcgcattcctattaatcgcgacgctgttcgtggtaccgctgctgatgatgaccatctggtcggcggttcgagaattggtgagcaatggctatggattcttctcggtgagatatctgagcttcaccgcaccgtttttgtacattgcattggcgctgctctgcttgcattcgccggcgatacggttgcgtacttcccggttgttgtacgcagtcgtattgctcacgctattcgccggcacaatggtgttcgcgacgcaaggcaattacaatttcgatcgggctgatacccccggcacggcacgcttggcacaacaggtcaggtgctccaaagcgcatccggtggtggcgcaagacgagtacacctatatcgacgcctactggtatttccgcgactgccccgcctactatttccttgatgacaaagatgttcccacgcgtggcggctacgcgccattgcatgattccgcggcgcagttacataacatcaataatctgaaaacagataatttcacgctgctgagctggtcgaaactgcatgacacaaaatatgatgcattgctcaagtcaaaaatctggaagcgtggtacggttacccgagtcaatggcaatgcgagcgtcctgtaccgaagtaagttgatagattgaccgtgccggagtgcgtgccggcgatagccgagcgacaatcggcgacgatagcccggccgtgaatttgcatccagcagcggcctcgccgcaaaatcgccgaaaatgccggacagcacgcggtgtcgttcatcgttcttattcttagcagctatgacgaacgaggcaaaacacaacccccagagcacaccgaatccagccaatcccgaaaccaaagtcgagaaaatgttcgaatacggctatcgcaagtcgaattacgggccggacgagctggtgaccgacgcacacggcaaccccatctccgtggtggacgcgatgctttccgccgagaaggccgccgccaccgaaaccgtgacgccgcacctgtgctattactcgccgcgtattcccggcaacaccggttcggccatccgcctgtgcgcagtgaccggcacgatcctgcatttggtggagccgttgggcttcaacctgcgcgacaccaagctgcgccgagcaggcctcgactaccatgacatggcccacgtggtgttgcacccgaacttcgacaacctggtggagtccatgcccaattcgcgcatcatcgcgttcaccgcgcacgccaccaagctctacaccgaagtggaatacaagccgaccgacatcctgctgttcggccccgagcccggcgacatccccgacccgatggacatcatggagggccctcatgtggccgaacaagtgcggctgcccatgcgcccgtccctgcgttccctgaacctcaccaactgcgcatccatcgccatctacgaagcctggcgccagctcaattttgcgggcggagcgtgaggagaaggcccggtgggccttcgagtagcgacgacgaacgaacaccgacaggcgtgagagcggaaacactgagcttcgcgcagtgatgaacgctgaatataaggctacctgcgtttcgaggggcggatttggcatccgccggaggtctactgccgcttcaaggggctgtcaaaggacgagaccccgagtatggccgttgaaatatcaatgcttgtactcggggtcttcatatataccagcccctcgaaacggaagtagacctccagaaaggtcggaatcagcccctcgaaacgggaatagacctccagaaaggtaattcgagctggtatctgccttcaaagaggtacattcgagcgtttgcagaatgctatctgccttcaaagaggtaccgcaatcgagaaaccccgggtatgagtgttgatattccaacgctcatacccggggtttccgcatataggtacctctttgaaagcagatagctctccgcgaggggccaaatgcacctctctgaaagcagataccctaccgaatcaattcttgaagctgtgaatcggcgcagggattcggccgccacgggtcacaaaggcctcgcagctggtctggttgaccggcatgatgggcgcgtagcccatcaggccgccgaagttcgccatctcgcccacgcccttgccggcaaccgggatcacgcgcacggcggtagtcttctggttgaccatgccgatggcggcctcgtcggcgatcaggccggagatggtggaagcagaggtatcgcccggaatggcgatcatgtcgaggcccaccgagcacacgcaggtcatggcttcgagcttctcgatggtcaggcaatcggaagaagccgcgtcgatcatgttcttgtcttcggagaccgggatgaacgcgccggacaggccgcccacgtaggaggacgccatgatgccgcccttcttgacctggtcgttgagcatggcgagcgccgccgtggtgccgggagcgccgacctgttcgaggccgatcttctccagcacttcgcccacggagtcgcccacagccggggtcggggcgagcgacaggtcgatgatgccgaacggaatgccgaggcggcgggatgcttcctgggccacaagctggccgacgcgcgtgatcttgaacgcggtgcgcttgatggtctcgcacaggaactcgaagtccttgcccttggccgcatcgagtgcgcgggagaccacgccggggccggagacaccgacgttgatgaccgcgtcgccctcggtgacgccgtggaagcctccggccataaacgggttgtcgtcaggcacgttgcagaaggccacgaacttgacgcagccgtaggagtcgttgtcggcggtacgctcggcaacgtccttgatgatatggccgagcagttcgaccgcgttcatgtcgatgccggtcttggtggagccgacgttcacggacgagcagacgatgtcggtctcggagagagcctgcggcagggagcggatgagcagctcctcggccggggtcatggacttggagacgagtgcggagtagccgccgatcaggtcgacgccgacctccttggccgccttgtcaagcgcgtgggcgatcttgacgaagtcctcgctcgtcttgcaggagctggcaccgaccagcgagatcggggtgacggtgatgcgcttgttgacgatcgggatgccgtagtcgcgttcgatggccttgccggtggaaacgaggtccttggcataggtagtgatcttgcggtagatgttgtcgcaggtcttgtcgacatcgtccgaggcgcagtcgagcaacgagatgcccatggtgatggtgcggacgtcgagcttctcctgctcgatcatctgattggtctcgtggacctccatgatgttcagcatggtttgttccttacaggatatttgaagactagtttggcggtcaccctcatcagagggataaggatggctccgtcagcggaaagcccaccgggctttccacctcctcgcgtgaggcggcctgctgagccggtcgcctcaaatacggtgcatcttggtgaagatttcctcacgctggcagcggatgcgcacaccgatgtcgtcgccgaggtcctcaaggttgccgaccatcgcgccgaagtccttgtccgcgttggcgtagtcgacaatcatcatcatgttgaagtaaccgtcgatgatggtctgggaaatgtcgagcacgttgacgttgtgctgggacaggtaggtgcagactcgcgcgatgatgccgacggtgtcctgaccgacgacggtgatgattgccttgttcatggctctccctggtcgtatacaaaaagcgggtgactacccaagtatagggaagacacccgccattatgttcattaccgattcatgtatcgtttgccgcccttgaacatgaaggagaacaccagcacaacgcccgagttgacgccgatggtaaagaacagtgcgccgccgatcgcggtcatcaccacgccaatggccagtatgcagccgacgaccatccactgggcggtaccggaggatacggagaactcgtccatcaaatcgggcagggcgatgttcatggatgtctcggacagcatgccgaggaatgcgccgatgtacaggccgagcatcaccttatgcggatggtcgaaatgcctggtttcaggagcgttatgggggttatgggaataagtggtgccggattcgccggcgggcatggtggtggtgcgggataaaacgaagctccctcgtcagagggagcttgcaatggctcaggcctcgcgcaaagcgctcggcgctgcgcacgcggtcctgcaattacggacgacctacggccgacccagcattacctcggcctcgcctattggctcgacctcgaccgcatccgccggacaacccaccgggttgtcctaggcctcgcgcgaagcgctcggcgctgcgcacgcggccagggcgcgaggagcgtggaagccttgcttttcgaattcgtcggcgatcttctgagcgacttcctgagaacgacccttgtccaccaacgcgatgatggagccgccgaagccgccgccggtcatacgcgcaccgtaggcgccgttcttgcgggccacgtccacggcgatgtccagctcggggacggtgacctcgtagtcggcggccagcgaatcgtgggaagcgttgaacagacggcccgcagccttgatgtcgccctgagcgaaggcacgcacgaaggaacgcacgcgctcgatttcggtgacgacgtggcgcacgcgcttcttcatggtctcgtcaggcagggcgtcaagcgtttccttgagggcctggaactggtcatcggccttggagatgccgtcggcggtaacgcgcaggttggccacaccgagaatcttggcggcttcctcgcaggtggcgcgacgctgagcgtactggccatcgttgagctggtgcggagcctgggtatcgaccacaagcagctcgaggttgtacttgtcgaggtcgaactcctgctgggagacgttctccagcggggtgagctccgggcggcagtcgagcagcagcgcatggccggcggtgcaacgcatggaagcgttctggtcaagaccgccggtggaggcgccggccatctcgttctcggacttgatggcggcgttgatgagggtcacacggccggcgtcggaatcgccgtagccaaggccgtacacgtcgtccagagccagagcggtggagcaggtcatggcggcggaggagctcaggccggagcccagcggcacgcaggagacgaaggcggcatcaaagcccttgaccttgtcgaaaccagcctgacgcagcgcccaggccacaccggtcgggtaggcggaccagccgtccacgccacgggccttgaggccatcgagatcagcttcggcgaccttgtcgggagccacgccggagacgacgcgaaccttggtgtcttcgcgcggcttcagggcgatgaaggtgcggtgcggcagagcgatcggcaggcacaggccggcgttgtaatcggtgtgctcaccgatcaggttcacacggcccggagcagcccacacgccctcgggcgcagcgccgtaggtgtcgacgaacagcttggtagcttgcgagacgccttcctcatgggtcagcggctcaatgaattcaacagcagtcattgatgttttctttctatcagtcggcgatgtcgatggagccgagctcgtggaagcgcttggcgatgagttccggcgtggtgtcggagatccaggcggccatgccggattcggagccggcgaggtacttgatcttgttggcggcgcgacggaaggagaagaactgcaggttcaggcggtagttctcgcggcgggcgtcgtggatcggggcctggtgccaggcggcgatgtatggcaggtccatgcctttgccgtcgcccttgtcgaagaaggcgttgccgcgcttcaggaggtgcgagtacatggaggcgaggtcccagcgttcttcgtcgttgagctggtcgagggtgagcacgtcgcgcaccggagccacgtggacctcgaggggccaacgggcggcggccggcacgtaggcgacccagctgtggttgcgcatcacgatgcgttcgccggcttcgagctcggcgttcatgatgtccttaagcaggttgccgccggtcttctcgtggtaggcctcggtgtgctggagttccttctccatcttcggggcgatgaacgggtagcagtagacctggccgtgcgggtgggcgagggagacgccgatttcctggccgtggttctcgaacgggaagatctgctcgatgccttccatcttggagatttcggcggtacggaaggcccaagcctcaaccacggtgcgcaggcgggagaccggcagatcggccggcaggccgtcctcgttcgggtcgaagcagatgacctcgcagcggccggcggcgagcttcttctcccacagcgggttgccgtcaacgtaggtcacgtcctcggagacgccgggcacgcgcaccatggaggggaagcggttctcgaacacgacgacgttgtagtcggtgtccggcacttcgccgtcctggtacgggtcaccgggcttgcgggcggccagcgggttgcccttggcggtagcgccggggccggcggtgatcgggcggttcatacgggcggtggccatcgggatccagtcgccggtcagcgggtcgcggcgcatctgcggggcggcgtacggcacttcgttgccgtcggcgtccaggtgcggggcgaaacggtagtccagcgggcgcgggtccttgagctcgcgggtcttggcaccggagacgaactcggggtcgtcgtccaggtagaagaagtcacggccgtcggcaagcgtcgtcggcgtgatgcggatgtgctccttcgcatactccccgggggtgtagttggcgaaatcagccatgggtttactcactttcctcaatgatctcgctctggtgggccagcacgagttcctttaccaaatccttggttttggcggcggagtcgggatcgagcccgtcgtcagtaatgaccgtgtccacctggtcgaagcgcgcaaacagcgacagcgatgtgcagctccacttggtgtgatcggtcaaaactatggtgcgatcggcgatgtccatcatcgccatatcggttgcggcttccagcgaattcggcatcaggaagccacggggaatcgacaccgagtgggtgccgaggaatacggtgttgacacgcagcgaagcgacgaccttgtccgcgatcgggccgacaagcgagttcgatcgggtgatcacgccgccggtgacgatcacctccacatccttggattcgagggcctggaccagctcggccacgggaatcgaattggtgaggatggtgatgccgctggactgctgcgattcgagcagatgctgggcgaagacataggccgtggtgccgccgccgatggcgattacatcgccgggagccacatatttgatggcttcctgggcgatggcgtccttcaggccgatatccatctgagacttgacagagaacaggggttcgctgagcaaggtactggtagtcaccgcgccgccatggacgcgcttcaacagtcccttgtcggcaagttcggcgatatcgcggcggatggtcatcgccgacacacccagttccttcgatagcgccgtaatgcgcactgccccgcgtgtgcgcaacctgctcaagatgaggtgctgacgttgtgacgaaatcatgcgaacattatcgcacacaaaagctcacaaaccaaaccggcttgagcgttttggggacaatctctcgaaaatcccgggcaattcaggtgttcatttccacaaaaccgcgcaaaatcgcacattgtgcgaaccgatattctcgcagcgaccactagcgcgatgactcacgaccgacgactctcccgagcgcgttgctcagcggcgagtcacgcctgatacctggtgcatcccgattcatgtatcttctgccgagccgacgcctgcgtgcgcctcgacacgcggtagccccttccccaattcgcctaggcaggaatcgcctagccgcaccagcccaagcgtgagacaataggcggtatgacttacgtttctgaaagcttctggcacgacgccgtcaacaaagccaccaccgatctgttcaccttcggctacaagcacatcatcaaaccgaacttcgtgttcaaccaccgccccgatgaggcacacgatcagatgatcgagttctgccacgtcgtcaagaacgtcccgccgctgctgctcgccgagcagctgatgctcgactacaccgaccccattctggaaacgaatgtgatgggcgtcgatttcaccaacccgttcggcctgtccgccggcctcgacaagaactgcgacatgcccgtggtgctggaccatgccggcttcggttttgaaaccgtaggctccaccacctcgcgtccctgcccgggcaacgccaagccgtggttccaccgtctgcctgaatacgattcgatgatggtgcacgtcggcctcgccaacatcggttcggacaaggtcatcgagcgcgccgagaaggcttggactcaggcccgccagatgcagctgtctgtgtcgatcgcccgcaccaacgacgaccagtgcggcgatttggacgaaggcattgaggattactgcatttcgatgcgccgcgccgccggccgcaccgcgatggtggaggtcaacgtctcctgcccgaacacgcacgtcggcgaaccgttcaccgcgactccggaagcgctcgaccgtctgtttacggcgctcgacaagatcgaccgcccgcagcccacgctggtcaagatgccgttgaacaagccgtggggcgagtacaaggagctgctcgatgtgctggccgagcacaatgtgcaggggctgtccatcgccaatctgcagaaggaccgcaccggcctcgagattccgcgcgattgggagggcggcctgtccggcggcccgtgcaccaacgccagcaccgagctgattcgcaaggtgtataaggagtatggcgaccggttcgccatcgccggcatcggtggcgtctttacccccgagcaagcctatgcgaagattcgttccggctccagcctggtcatgttcatcagctcgctgatgtaccgaggcccgcagcagatcaccgtgttgaagcgcggtctggcccagctgctgcgccgcgacggattcgagcacgtctccgacgccgtcggcgtggacgtggagtgaactcacatattgccctattacccatggggcggtaaaaccctcatggggcggtgattgtcccatggggcggttagccaaatttcacattccgcagaataccgccgttttgggttaccgccccatgagggttttaccgccccatgggaaagtcaccgccccatgaggattcagtacgcaccggccacgtattgcggggcgtaggggacctctgtggacggtatgcccagcttgttggccgcacgcaacggccagtacggatcgcgcaatgcggcgcggccaatttccacggcatcggcttcgccacgggccaaaatcttggccgcctgcttcggcttggtgataagacccaccgcggtcaccggaatatcggccttggacttgacctgctcggcgaacggcacctgatagttcggcttgaccggaatcgacactcccgacatgatgccgccagtggacacgtccatcacatcgacgccatgctccttcagcaccttggatagtgcaatggtctgatccaaatcccaaccgccagcggcccaatccgtggccgaaatgcgcaccagaaccggcacgccctcagggacggccccacgcacggcatccacaacctcgaccaggaaccgagagcgaccggtcaaatcgccaccatattcgtcatcacgctcattgctcagcgggtcaaggaactgagaaatcagatagccatgcgcggcatgaatctgaatcgcttggaagccggcggccaccgcacggcccgccgccacggcgaacgcgccgaccagaccatgaatctcatccacggacagcgcgcgcggcgtacgcaacccaccgaacgcgatttcagacggtgccatggtaggccagccgcccgcctcctccggcacgttctgaccgtcgtaaccaacggcaaagcaaccagtcgaagccttacgccccgcatggttgagctggatggcaggcaccgcacccgcctcgcgaataccgtccacgatccagcgccaagcatcaatctgcccgtcttcccacaggcccagatcgcacggcgtgatacgcccctcaggagccacggcggtggattcgacaatcaccatgccgaatccgccgaacgcgcgagacacgtaatgctggtagtggaacggcgtgggcctaccatcgcgggcgaacgacgaatacgtgcacatcggcggcaaccaaatacgattacgcacggtcacctcgcgcagcgtcattggcgcaaacagccccggacggtccttgctgactttcttatctgccttgctcacagcttccctttcctcataatcatcgaacgattcgctcgtcttgcccgcgccggcccgcttcttggaccgtgcatcggattttgacttcttcttaccgtgcttacggttcttcgatgcatcctcgtgcttggtcttcggctgcttggactgatcgccgtccgaagacgaagccagcgtcaccgctttgagatccggcacgtcgaatccacgaaaatcaaaattctcatgcgtcagatcgtcgttgctcatcgttcccctttccgatgcacgttcatggcaaatattcgatgaacgcgatggcgttgtcattaagtattgtaaaacgggcgtcacctgaaacaggtaacgcccgcaaactacgtaatttgggtatcgcagtcggccatgttacgcagactcagccggcctgcaatcaccaaatgtcaaacgccaatcaccaatcactggccatcattcgactgctctgaattggtgccctgggtttgggtgttgttttgcccagtgttctgcgactgagactgattgttgctgctctgcgattggctgttgccattcgtagtggtctgcggcacgctgaacgttcgtccgccaatgcccagatacttgccagtcgtggtgtacttcgagacgggctggccgtaatcgttgtcaatcggtattttcttcttggaaatgtagctattgaagaagttggtaacggccggagccgcgattgtcgaaccatcccaatagctgttgtaccggccgttgatggcaatgttggaaatacggttggtgtacgggttctgtgcatcgccgaccacagcgaacgccgcaatctgattaggaatgaacgatccaccggacaccgcaagatcctcactggtaccggtcttaccaaacgacttacgcccgtcagccaatctgaatgaccaaccggcaccatccggccgcaccgtaccttggttcagggtataagcgagtgtttggatgatgtccttatccaccgcctgatggcagttcgcggatggaaccttgagatcgttgccgtccttatcggtcaccttgctgatggcaatcgggttgcattgcacaccattcgaggcgtatacggcgaagatgctcgccatggtcagcggggacacattcaccgagccgatcatcatggatggtgtatacacctgggttttgtcgatggtctcacccgtggcggcgtcatggtatcccagttcagtcgcggtgtccgccaccttgcacagtttgaggatggcacccatggaagcctgagtagtgttatgcgaacggaccagaccgaggaatgggctttctgggttcactgtacctgcgcccatggcgttcgacacgttccacgaatcggcaccgcccgaatagttactgcaggcgaagtccgtagtggggtatgacgtcgaggtctggaggttgtcgttgatggaatggcccgcttccatccacgcaatcaggttgatcggcttccaggacgaaccgatggtccaaccagaaccaccgccatccgccaaatcgacggcatagttctggctcgtcttggtgggatcgttcgcggctgccggagtggcgtcatagtaacgattcaggccaaagctcagcacttcgccggttcccggtttgactgcggccatggctatctccatgccgctgggatcgtccggtggaatggtattacgcgcggtctccatcatcgtggaattcgcttccacatccagcgtggtgacgattttcaggccaccctcctgcagcagcttgttacgctcggcacgagtcttgccgaattcttcggagttctggatgcgatgcaccacaaaatcgcagaagtacgcgtaatcgccggtgtcctgacagccgacattcacgtcctgtgctttcagcgtgtccttcaacggcgtgttcacagcttcggtgtactgcttctgggtgatgtatccttcctgcagcatcagcttgagcacgatattgcgttggttttcgctttccttctggttctcttcgaccagcggatcatacaggcttgggttcttggtgatagccgcgatggtggcggactgcaccacgttcaaatcggcggcggacacgctgaagtagcgctgggccgcggtttccacgccatacaggttgttgccgaactgggcgatgttcaaatagccctgcagaatctcggccttggaatacttcttttccatctgcacggaaatcagcatctcgcgaatcttacgggcgatggtgtcttcagtggcatggtactgggcgatcgaatcgtcatcctcgatcgcctgcatcagcagcacgttcttgacgtactgctgggtcagcgacgaaccaccctgctgggagcctttgacgaggtaggtctgcacgaacgcacgcatcacgccttgcacgtcgacgccggcgtgagtccagaatcgacggtcttcgcgcgccaccactgcctgctgcatggttttggaaatcttcttcagcggcacgacgatacggttttggttgtagaacgtcgcgataacggtggaaccgtctcgcgcgtacatcgtcgacttctggggcagactagtcacgtcgaagtccacgttttctaccttgagcgacggaatcaccgctttggcggctttattggcaccgatcacacccggtacaaacaacacgctggccgccacgccgccgcagacggcaagcatgatataggccaagaggagaacaagcacacgttggagagtgagggacttctttttgggcatgggccccattctaaatggggtgccctaccaaccgggcttacggtcagctcccgtgaacatatcatcacaagaatcgcactagcgtaacattggctggaagtcagccgaacggtcagcgccgcgagcgtcgaatcagcataccaggctggaagatgatgatcgatcggccgtcacgtgcgatccatccgcggttggaaaagtccatcaacgccttgttcacggtctcacgactggagcccaccagttgggccagctcttcctgagtcaggtcatgcggcactttgaggccctgttccaccggctcgccgaaacgtgagcccaagttgagcaatgtcttggccagacgcgccggcacatccatgaataccaagtcggagatgcgttcgttgttgccgcgctggcggctggccatgacctgcaacatgtcgatggccacacgcggatgctcatcaagccatgcgaacagggcatcatgctccagccagaccacgcgcgtgccatggctcatggacaccgcggacgcggtgcgcgggccaccatgagggtcgaataccggaatctcgccaagcacttcgcccggcgcgtggatggacagcagctgcacgcggtcatcggaagaagtgcgaatcagcttgacgcgcccctgctccagtaaatacatgcgctgatcggtatcgccttcggagaagatatagtcgcctttatcgaacgtcgcatgcttcaaatgcggcaacagctcctcggcttcggctggcgatacctgcttgaacaatgccgtatgcaacaggatgttttcctcgtcagcaaaagcgtttggcgtttccaagctcatcgcaccatccttattgtcctatgaccgtcgtcgcccatccgtcatattgtaacgcgccccacaggtttcgtcaggagcatgccctcattcgtcacttcatgtgtggcacgatccgatagccgtacgacatgctgacgaatgcgttaccgcgaaaaacggcactgtcgcggctaccgcgctcgcccatgacaaaaccgcgcacggccagcggcaaaatcgtatacggccatcggtgaaatcacgccgcaaaccagtcaataaggtgctcgacgatgtgttcgcggctgagacccgtctggcttttcatcgggtccacgcgtttgaccgctgatttcaccgctttgtctgacatcttctcgcgactggtgttgagcacacggctcatcttggccgcatcgatgtcatatgccatggtcacatggtgcagcaccgcgccgcctgagcctacggggaagcgccgctgcgccgctcccccgatcttgccgtactgcgaggcgatatcattgaggcccgcgaaccgcacatctaaaccaagttcgcgcagcgcttcgaccagccaccagtcacagagccggtaggattcttcgatgcttacgccctgaacgaaatcgagcggcgcatacagagaataggtaatggtgttgcccggttcgataaacatcgctccgccgcccgtgcaacggcgtaccacgtcgaagccgagctgcttggcaatgtccagattcacctcgtcctgggccgattggaaacggccgatgaccacagccgggcccgcccactcccataatcggatggtcggctgtcgtgttcctgctgcgacttcacgcgcccaggtctcgtcaatggccatttgctcgtccggagtacgcggatggccgtggatcacggtgagttgaggcttgagggcgttccagcgctcccggtattcagagcttttgtcgggctgcttggtttgtgtattgatggatgctgggatgttcggcgcatcggggctgcccacccccacccgctgcgctggagcccccgccagcgggggtaagttgctgcttacggctcggctgtatgcggttttgatggcaatttcatctgtgccgataatttggcaactaggatgggcgtccaatacggaccgcaatgaatcatcgctaattagagctcgttccaggtcatgcaacaaagcatgagattcggcatccgaaactgattcaataaagaaatcaccgctgatatggcatgactgtgcggtgccgtcatcatcgacggatacggtcacggcgactagtttgctgccaacggttttgcattccccatgtcgcatttgcatgcaactcagtatagagagttttctggctcccctcagcgaggggagccaagtttgaggtcacatgcgggccagaatgtccttgccgacctggtcggtggagcgcacggtggagccgagctcctcgatgtccgcttcgacggcggtatggatcttcttggccgcatcatcaaagccgagatgctcgagcagcatggcggcggagaggatggcggcggtcgggttggccttgttctgaccggcgatgtccggagcggaaccgtgaatcggctcgaacatggacgggaactcgtcggaggcgttgatgcagccggaggcggagtagcccacgccgcccaccacggagccggcctcatcggtcagaatgtcgccaaagaggttgtcggtgagaatcacatcgaaacggctcgggtcggagaccaggaagatggtggccgcatcaatgtgctggtagtcgtgggtgacctcagggtattcctcgccgaccttgtcgacgatgcgctgccacatatcaccggcgttgacgagcacgttcttcttgtgcaccagggtgacgtgcttcttgcgcttcatagcgagcttgaaggcgtaacgcaccacacgctccacaccgtatgcggtgttgatggacacctcggtggccacctcctgcggggtgttgcggcgcaccgcgccgccggcaccgcagtacagaccttcggtgccttcacgtaccaccacgaagtcgatgtcgccggggttggcgagcggcgaggtgacgcccttgtacagcttggaggggcgcaggttcacgtactggtcgaggtcgaagcggagcttgagcagcaggccgcgttccagaatgccggccttgatgcgcggatcgcccacggcaccgagcagaatcgcgtcgttggccttgatgcgctcctcttcgtcctcgggcaggatcgcaccatcgcgcagatagcgctcggcacccaagtcgaagttctcgtactcgaagtcagctacgccttcagcggccttttccaaagccttctgagcccacggagtgacttccttgccaataccgtcgccgggaataacggcgattttatatgtctttgccatagttcaaggagcctactcgcgctatcacctgccggcccgaacccgctcagctagtggacatggcctaatgagcgagccccatcacatccatgcaccaagcgttctcataggaaacctcttcccattgctcgtaacgcccggatagaccgccgtgaccggcctcgacctcaatcttggccaccgcgtccacgccggcggactgcaaacgggccagccatttgagcggctcgacgtacagcacgcgggtgtcgttcatcgaggtggtaatgaagattctcgggaattgcgcggcggcgaccgcgccggtggcagccccatcagcactgccgtcaccggcagcctcgtcgttgccgccctcgagcacggcgaccggcacattctcgtatggcgtgtacgacttcatatactgatacacctcagggtcatgcaacgggtctccccattcgtcccattcggtgacggtcaacggcaagtccgggtcaagaatggaggtcaacgcgtccacgaacggcacatccgcctcaacaccggcgtagcattcgggcgccatattggcaatcgcgcccatcagcagaccgccagcggatccgccgttggccacggtgcgccaagcatcagccaaatgcgccttctgcagcgcgcgtgtggcgtccacgaagtcctcaaaggaatgcttcttgttcagtctgcgcccctgctcataccaggcgcgtcccatttcgccgccgccacgaatatgcggcacggcgtacagcacaccgcgatccaacatgctcagacgagagaccgagaaccccggatcggaggaaatctcgtatgcaccatatccggtaatgaacatcggcgaatcctgcgccgggcaatcgcggtgccagacgagggaaacaggaatgcgttcgccgtcgcgcgcggtaatccacacacggcgttccatgtaatcgcgtggattgaagttgcccaacacggtggctcgcttcagcagcgcatcttcaccggtggcgggatcgatttcgtgcaactcgcccgggcgggtgtagctggcgaacgagtagcgcatgcgcggcgcctcatacgaggggttgccgccgacgccgatggtgtacaagcgccgggtctcaccgggcaggtggtcgtcgctagcaccatcggaagatgacgtgtgatccgtgggggcctcatcttcggtccacaagatttcgccatgatcgccggtgaagttttcgcgatcgtcggcaaccatgtcccagtcgtcctccagggcaggcggcagcaattccgtaaaccgccacggccgtccggccaggaagtcggcggcagccgcgctcttggtcatgtatgccacgtgcggctggccgtcggcacggtagctcagggacacaaagttgcgatgcaacgcaatgccttcgatgcccagaccgtgggcaccctgcaatatcgccggattgacggcgttgaagtatgcctcggtaatcggcttatccggctcaccatgttcacagccgtacggcgacccggcggcaatgcacacgccttcgccgagtcggtacggcggctcatggccacgcatgtcaatgacgtcgatttcgaaattcggattggcggcgttgtgatagaccacggcgagtggcacatccgcaccgttctcccccgcgccttcaaaacaggcaaagctcacatcatattcaatatcgttctgacgcggaatgaaagcttggaattcgccttcaggcgtggccaccggcagcatcagcacttcggtggtggttttggaaccggtgccgatcacgatattgcgctcatcaaaactgatgccaacgcccacccagaaccgttcatcggtttctcggtacacgcacacatccgattcgaccgccgtgccaacacgatgccgccacacagcgagcggccgccaggaatcgtccaattccacccagaacacccattggccgtccggcgtgaagcatgcgctgccaatgccggtgaactgttcgggcagttcgctgaccggctccccggtctccagcccggcaaggtcgcgaatgcggaaatcatatcgttcgtctcccgcaacatccacgccgtacagcatccaacggccgtccttgctcagatccaagccgccgagccggaagaagtcatgtccctcggattccttgttcgcatcaaaaacgacctgttcaccgggcatggagccgggcgcgccttgcggatccacgaccggcgggtcccagtcatcggcatcgcgcacggggatgcggcattgcacgccatactgtttgccctgctgcgtgcgggtgaagtaccagtaatcattgacgcgcgtgggaaccgacatatcagtctcttccacatgcgatttcagctcttcaaacaacgtatgccggaaatccgccagatgcgccatgcgacgctcgcagtactggttttcggcagctacgtagctgcgcacatcatcggagtctttgtctcgcatccactcgtaatcgtcttcgaaaacgtcaccgtggaattcgcggcgcttcggctcgcgcttggcgtaaggcggcatcgcggccgcggcgtttgtgctctcgtcagtcataccacgcgattataggcgaggcaccgcaccgggacgcattcagtgttcatcacgccgcgcctatcgcaacaccgtcttcagatacggcagcatggtcttcagaatgttcgagccggtggtgccggtgaatactggcacatcggttaccggagtcggctgggtcgaggtgagccccgtcaccgacgccaatccggttgattcgcgcgggctcaactcacgaatgacgatcgccagtacacgtccgggatatctgcgggcgatggtggcgtacgtggtcgggtctttctgcccgtcatcgcccaccagaatgaacttcatgtctgggaagtcggccataagttgttcggcaaactcaagtttgtgctgggggccggtgggtacgaaggtcttgggcctcgggtcgaggtcgcgcagcagcagcgggccttcgggaaaaccatggtcagtgatgaagttgcgaatcgaactctccacattccagggcgatgtcgaaagatagaagaacggtgcgccggggaacaagtcggcgatgcgggtgaacagcacgctcatgcccggcacggaggctttcttcttggggtcgaggaacagcaggttgtacgcggccttccatggcaccggggcctgcgtgatcatgatggtgtcgtccacatcggagatgatgccgactttggcactggcggggatggtgtacaggttggcgctcacgggtttgcggttggccacgctgtaggagacgcgatggatgccgggcaccagacgatgctcggccacgaggtcgagatatccggcggaatcggagatggcgtattcgctgccgagatcgcgcgtgcggtccaccttgtcatagacctcggagacaccgatctgcacggtgttgagcggcatgtcatcaatgctggcctgcacgtgggtgcgcggcgcgggtatggcaagcatgccgcggatgccgcggatcagttcgccggattgcgcgtgcctgggggcgtataccgtgcggcagatcagacgcgagtaatcgccggtaccataacccacatagggttccactcgcggataccagtcccattggcgcaccacctgagtggagatgcgtgaccatacaccgaacacgcgggtgacggcacgacgtatgaatcgggtgatcggcggcttgacttcgatgcgctcacgcttggagggggtgtcgaacgtcgtggcagccttgcgtgcgggaatcggcacggtgggcatgtcatcggaatgctcagcattgctggcattgtcgacgccattggcggatgccttgacgtcagagactggcgcggtggcggacagcgctgcattgcaagcagcagcatcccaaggcagtcgcttgcctgccgcctcaaaatcctcgcgtgggcttctcatagacaccaatataggccatacgcctcatttttcttggctccccctccataagaggcacggtgcatataggtttgatgccacatactggctcccctcagggaggggagccatgggtggaactaccgcacgaccttcgcgtattcgtcggcgctcagcagctccggctcatcgtcgtcaagctcaaccttcagcagccagccttcgccgtacggatcgccgttgaccacggacgggtcgtccgccacgtcacggttcacatacttgaccgtacccaccacggggctgatcagcggctggacggccttggaggattcaagctccacgatctcgtcgccggcctccacacgggcgccaggctcaggcagatccacaaacacaagttcgccaagctggtcggcggcgtattcggtaatgccgatgattgcggggtcgaccgaacggtccacccatgcatgttcctcggagtattcgaggtggtcgggaatgtcgagattcagcggctgttcgttttcgttgtcatcactcatagtcataagcctaacctatcttcgcggtccgtcacagctcgcgaccgagccattcctcaatcatgtagcgggcgatggtggcgcggcccggcgccgccatacggccggcgatgagctcggccgtgtattcgtcgcgtgtgacccatcgcgcggtcatggtctcctcgccgtccacacgcacgtcggtggtgatcgcatgtgccttgaacgccatcatcagcgaagccgggaacggccacggctgcgaacccaggtaccgcacctcgccaagcttgatgccggtctcttccatggcctcgcggcggcaggcgtgttcaaggttctcccccgcctccacaaatccggcggacaccgaatacagcctcgaatccttccatgccgcgttgtgttgcagcagcagacggtcgtgcccgtccacgatggcggtaatgaccgccggctccacgcgtgggaacagcacacggttgccgtccgcctcgttggtgcatcgctgcgcccatccggcgagcgccggccggaccgccgcgccacaggtgggacagaaccgctggcggctgtgccagatgcttaaggtgatggcactggtggcttgcccggcctcgcgcgcgttggcgtgaggggcgaatccgcgcaggtccacccagtcgaaccgggtcacggcctgttgcagcagcgtgggcttcggggccaagggctgtacgggcgcgccgaccgaatcatcgaaggcatcgtccgcaccttgcccggctgaatccggtacaccgagcggcccggcgattttggctgcggctacgccgccattacccttggcgtttcccggctgccgtattccggcggcagcacctccgctgatgccgttcttgcccagcgcgccgtccacagtgccggaatcctgggtgccgagcacgccgccgacggcaccgccaacaccggcaatcccgccaacaccgggaacgccggcttccggcacgcgcgtgatatccacggcgaccacggattcgccgcgcgccccgacataggagccaaggaacatggcgaccgcttcggggtagcgtgccagttcggcggacacataggcgcccggcaacgtggcgagccgcattttcacgttctcatagtccacaagctcgccttggccgcgcggtacggcgacaagtccgccgcgcgtaagcacgactttggtggtcggctcggccagcagctcgtcgatcaggccgggttcgcttcgccggtccacctgatagtcgatgtcgccttgtgcgagcggcaggaacggcagcgcatgggtcagtgccagaggcgagaaatgaatgtcagcggtcatcgaggtctcctatgcgttcttctgcgcgctctgcacgcgcttgacgagcgagagcagtgctcgcgccacggtatccggatgttcgacggcactgaaatggccgcagtccggaatatcgatgaattcagcgccggtgattcgttcggcgagcggccgcatcacactcggattgctggaggggtccagttcgccggataccaccaggctcggtgcgctgatcgtttccggcaccgcccccagttcaggccgtccgtaggtcatgcgctgacgccaggccagaccagccgggttctgttcgttgatccagccggtcatggtcgcgatgaattcaggagtctttttgacggtggaatcgccatcggccggctgcgcgaagtgcatcaccggttcgaccgagttcgtctgttcggcggcgtccgccatcttcagtcggttctctccgcccacgccgtcggacgcggccatcgtgtcacacaaggccagtccggccaccgtttcggggtacaggcgctggatgtccatcgccacgtagccgcccatcgacagcccgacccaaatcgcctgctcatagccggcggccttgatcaggtccacgtaggctccggccaggcgatccaacgcctcgctgtacgcgccgttcgccatgcgggggcccgaatcggcgtcgctcggcaccggggatgcgccggagccggccatgtccggagcccaaatcgggaagtccggcacatcgttcaggtcggcgaaatcggcgagcgccttcgcgcacacgtcccacatgcggtggtccaccgggtaggcgttcatcagcaccaccggcacgccttcgccgtcgcggtagatatgattggccaattcgattgccatgaattactccttcacattcgcgccccactggcggagctgtcggcacagtcggctgggagcggtctcaacgcggaccgccctccgtcgctacgcgccgtcccctccaacggaaggcaaaacaactgtcagattccggcccaggccaacgcctgccgcacgatgcgcccatggccgttgaccatctgcgccacgaacgtgtccattacgtcgctcttgggatccacccattccacatccagcgtctcgtcctgcggcttgcagtcgccggcgataggcaccacgtagcacagtgcgatggcgtgctggcgcggatcgtagtattcgcttagtcccggcgtggggaagaattcggccacggcgaacggctggagcccgatcggcagcagcggcaaggcgatatcgcccaaatccttggccacattgcgggcgatggcctcgcgcaacgtctcgtggtacagcacacggccggtaatcagcgtacgctcgatcgacccgtcttcggatacgcgcagcagcgagcccacttgggagatgcggcccatctcatcggtgcgcacaggcacgatctccacatacgcgatgggcatctgatggcgcgcccggttgatgtcggacggccccagccagcccggcgggttgccgtgaccggaaccgcctccgtggatgaagtcctcgggcgtgatgttgtcgaattcgccgcggccacggccggcatcataatcgccctcgtcgggcacttcatcattcatgactggcatgcatcccattattgcgcgcaaaaacacgccacgcgtcaccttccggcgaaatcttgggaaacgtttggccggcggcggaaaatacgacacaaatgttgggtggtgctgggaagctggtagccagcagggagccggcggccacgaaccgcacggccccaagcgccaagacgtattgcatgaataaggcaatcgcccggcggccacgcacgagggccgtacggcgatgccaaggaaaacacaaaagaagggaacatcatggcaaccaccgccatcacctccgccgatttcgagaagaccatcaccgacaacgaaatcgtgttcgttgacttctgggccacctggtgcggcccgtgccgcgcgttcggcccgattttcgaggcggcctccaacgagccggagaacgcgaacatcgccttcgtcaaggtggatatcgacgccaaccaagatctggcccaggccgccggcatccaggcggtgcccacgctgatgatcgccaagcagggcgaggtcatcttccagcaggccggcgcgctgcaggccgccgatctcgacgatctgatcgcccaggccaaggcgctcgacctcgccgccgccaaggccgcccagtccggtgccgaccagcaggcctgagcctgattttccttcatccactgcgccgcctatcatggtggtcagtgtgaaatccgatcaaggagcgcaatgacgagacatgccaagccgacccgtatgctcagaccgttgaacaagcgccagtggatgaagatcgcggctgtggtggccgcggcaggtctgctcggcgcggcgggattggtgtcgcgcagtttctaccatgctgatgatgtgaagccgatttccaccatcacttcgttctccgctaccgattcggccgcatcccgttctgccactcgtggcgcaatcaacagcgccgacaagaacaccacgttcgttacggtgaagattaatggcgattcgcgcgtagtacttggcgaaaaagccaacatgaccaccgtcaaggacgtgctggagacgggtgatatcacgcttgacccggatgatgccgtatctccctcgctgaaatccaaggtcaccgaggccaccgtggtcaccattaatcgcgcggatgccgatgtggagaccaacgataccgagatcgccttcaatgaagtacgcaaggagaccagcagcctgcccaagggtcaggaaaaggtcgagaccgagggccaaaagggcattatggagaccacctcgctgatcaagcgagccggcgacaaggtcatctcttccaacgtattcgcctcatgggtcaagaaggccccggtggataaggtgatcctggtgggcactggttccaccaagtcatcgtcgtcggccgatctcggcaccactgttccggctggagaagtgcagtcctgggcgcatcagtatctgttggacaacgggtatagcgaagcggacttcaccgctgcgaactacatcatcaaccacgagtccggttggagccccaccgccaccaaccccacgtctggtgcttatggcttgggtcaggcctaccccggtagcaagatggcttccgccggtgcggactggcagaccaactacaagacccagttcaagtggttcatcagctactgcgagcagcgctacggcggcatcgtcgcagcgtacaactactggatcgctcataacaattactgattgcgattattctctatgcaaagagcctctgccggttgattcccggcagaggctctttggttatgtggctcttcgcattttggtgtgtatggcgtgtggttagaggtgggtttggatggcttgtctgaagcctccggtgtggagcaggcttctggtgatgtagttgtcgaggttgcggaagccgagggctatgtccctgagggtctcgagcctgccgttgatggcctcggtggggccgttcgcgccgttggggtggtcgaagaacgcgaacacgtcgcccatgcggcgtttgagggtgcgtccgagcgtggcgagttcggggcatccgggcgcaccgcttttgacggcgagggattcgatgagctcggccatcatgccccgtcccttgcgccggtcctcgtgcgcgtagcaggagatgatcttctggtacgcgccgtgcgcgagggcgagcggcttgttcgcggggtcggcgagcagatcgtcggcgcgcgccttctgcctgtcggtgcgcagggacgcggtcttgagcaggatcctcctgcccttgtagagcgtccttggtgccgcgccgtcccgtccgttcgcgctggagccggcagcgcacctcgaaagcccgcgacgcacggaccccaagggccagctctaccgttcatggcggctcgaggaaccgctgcgcctgctcgggctctccctcgaccgggccgggggagagctgaaccgctgggtgttccgggcctcgcatagccgcatccccgagatcgtcgagctttccaaaaaaaatcaggagacgccgccccgacatcccacgcaccatcgaaccgggctgctccaacgccaggctcgaggcgttcgacaacaggatcaaggccaccatccgcatggcctacggcttccaccgcgtcaccaacctcatcgccctgatcatgctccgatgcagcggattcgacatccgactaccacaacccacaatctaacccacaaaaacagcagaagcctcaaagatcggtattcttgcagggctttttgggttatcccgcgggcatgggtagactggcatgcggtaggagaaatactcgctgaaaggtgcatgccagctcatgggaacgggtggccagccggaaaagaatacgacgccaacggctccggcgtcgcataacagtgtcgcggatcagcccacgatggtgcagtctccggtgtccgggcctgcccaaccgggcgatgcgcagcccacggaggcgatgagcggcgttccggtgccccgtccgaaccggcgggcacggcgattcccgttgccaatcacgacatcgtcgatacgttctgggacattcctccgatcacgttccccacggacctgtacgacgccggcggtgccggtgctccatccggtccgcggccaccccagtcagccgcgctgacacccccggcatcatacgcgatgtgcacgtcgtgcactgctacgtgccgtccgccgggctacccgtccagcgaaagcgtaatcgggcagccagccagtatcgatatatgtcataacgtaaggaagtagcccatgccatcacacgcacgcacggtcaccaggaaaacccatcgcgttcgcaacgcgctgctcgtcgtgctgctgttgctggtcgtgtgcgccgcggcggccggcttcagcggattcaaactgtacaagtcggcgatgagcgccaaagcgcacctcaacaatgttgtcaacgcggccaaggtcatcaaggacggttccaccgacgacatggtcaaggcgctgtccgacgtgagccacatccagaaagaggcggccgccgccaagcaggatgtcagcggcggtctgtggacgctggcggagaagatgcccgtggtcggcggtgacgtgaagacggcgcgcaccgccatcggtaccatcgatgacttcgcgcagaccacgctgccccagctgggcaaggtcgtcaccacactgaccggtgccagtctctccagtggcgatgggcagctcgacatggagccgatcatcgccgcggcgcagcagcttgccacggtcgaccagtccgtgcaatcgcaggccaggacgatccaggatcttcccgacgccaaactcggcgtggtgaacaacgcgctgcagaacggcaagacgcagatggccgccctggcgcaggtgaccgaaaacctgagcggcatgctcaacatgctgccgaacttcctcggtgcgaacggcgcccgcaactacgtgctgctggcccagacgaattccgagatccgcggcaccggcggcctgatcggttcggccggttccttcagcgcggacaatggcaagatcgcggtgggggagttccacgcggatgccgagttcccctccaacgccgcgttggatgacgtcaaccaggacggtgacggcacgctgtacagcggactgtacttcggtcaatgcgtccataatctttcgtccacgccggacttcccgcgcgtcgcgtccatggcccagaagttctggcaggcggctccgttcggcggatcgtccgacggcgtgatgtcgctcgaccccgtcgcgctgcaggcgatgatcggcgccaccggcgacgtgaccctgtccgacgggcgcgtgctcaacgggtcgaacaccgccgaattcctgctcaacggcgcctacaaggaactggcgccctccgctcaggaccagtacttcagcgagaccgccgcccaggtggtcgcccacctgttcagcgacatgaacacgcagaagctcatgaccgtcgccaagactatgctccggatgaccgagcagcggcacctgtacttctggtcgttccacgaggaggatcaggcggtgctgcgcagcgccggcgtcaccggcgagatcaccaacgacgcgaagaacccggtggccggcgtctacctcaacgagatgcaggcctcgaagatggactggtacatccagcgcaagtcgacggtgaagaggaccggcgacaacacctaccacgttacgtattcgttcaccaacaccctgcagccgggcgaggccggatccctgccggaatacatcacggcgaacgccaagggaggcgtggcggtgaaccgcgtggtcatctacacgccggccggaggcgaggtcagcaatgtgtcggcgtcgaacggcagttccttcgcgcaggtgcaggccaaggaccatatgacctacatggacgacatctccctggcgcctcaggacacggtgaccatcgaatacgacgtgaccaccgcggccagctcggccaacctcaaactggatcagacgccgaccatcggcgaccccgcgatcacgtacgagtactgatcggtattgatctgtgggtgtgatcttgggattgtgtgcccttatgaaagcgcgccgccgactcctctcggaaccggtgacgcgctttctgtaatgcctgattagaaccttgtgggggtgcggacgaaaagttggatacttgagaggcttctgatgtttttgtgggttagattgtgggttgtggtagtcggatgtcgaatccgctgcatcggagcatgatcagggcgatgaggttggtgacgcggtggaagccgtaggccatgcggatggtggccttgatcctgttgtcgaacgcctcgagcctggcgctggagcagcccggttcgatggtgcgtgggatgtcggggcggcgtctcctgattttttttggaaagctcgacgatctcggggatgcggctatgcgaggcccggaacacccagcggttcagctctcccccggcccggtcgagggagagcccgagcaggcgcagcggttcctcgagccgccatgaacggtagagctggcccttggggtccgtgcgtcggaccacggtcggatacgtgtggcccttgcggtatccacgccgatcgccgccaggccgtcgaacggcgagggcatcgcggccctgaggcggtccgcgacccggcggacgatgtctccggccgtcctccacgcgacgtgcaggaagccgctgaccgtcttccggttcgcgacgctcatcagccatgtgcactccgactcggagtcgcgcgtgaaccggctgcccggctcggcccacggcaccatcgtgaccacggccccacaccgggggcggtccactcgcggcatgtcggcgaccggttcgacctccagcagccgaaatcctgatgacgctaacgacgacggccgccgccacggtcgtaaccgcggcgcttcctgccgcagcgggagcatcggagcatgcccccgcgtggacgcacgcggatctcgagcacgggtccggaacgcagcggcgaatccgtgatccgcacatcctcgaccaccgtgcctttgacgttgagaagctgtttgaatatgccgttcatcaggcgcctgccgccgggtagtacgtttttcttggtcgatgaacatcccacccaaaaaaacgccccccaacgactcaacgacgaaccgccacccacgaaaacagcaatagggcccaaaaaatcggacgttatcttattgctacggtacataacgcacgcatattcgcgagggaatgctcactggaatatatgagggaatgctcacaacacttgagaagggacgttgttatgcaaatcatgtatgtatgcaccggcaatcaatgccgttccgtgatggccgaatactacacccgagccaagcttgccgaccgaggaattggcttgcagaacgacaatatcaccgtgcgcagcgcgggtactctgcactatcccccgcatcccgctgatccgatggttatcgatttgctgaagaacgacggcattgacgcgaattcccattcttccacccctctcaccaccgatatcagccggcaagccgacctgattctgtgttttgagcgtgagcaaatatccgatttgcttgagcagaatccactggctattcgcaaagtatttctgttcaatgacttcgtgaacgcttgcaaacatatgcatgctgagggtccgattgccggcgataccgccgcagacaagcttatcgaaatcatggattgcgtacctatgctgcggccgtttttgcctacggcactcgaaaccgaagaccctcatcgtcaatcacgcgaggtgtttgaacgcgtgtatgcggaaatcaagcacggcgtcgatattatgctcggtgctgtggcctgaatgcgatatcggcgaatagagccagcaaaaagaccgtcagttattgcgatgttgaaattgcatatttctatattcaatacggctgatattgcgggttcttgtttcctcttttcttggtattggttaaatcagtgctattcggggagcgcaatacgtaggtcaaatgttcttcaattatgcaatcatgcatgcatatggtttgtataatgcgaaattagctggttacaattagtggcgtaaataaaaacacgttaccaatgcaataaggagagcaattatggcttcattgcttcagggattcgaagaggttcagctggtcaagccggtgggcaagaccgttctgaccgtcaccgattccgccattcgtttcaacaaagccaccgctgaagtgctcggattcccggcgtacgtcaaggtgctgattaacgacaagaccaagcagatcgccgtaaccccgaccaccgccaaggccgacaacgccattaagttcagcaagcccgaaggcaagcaggctgcttcggtaagcgtcaaggaagccacgctcattgaagcagtgaaggcatacttcactctgcctgaggctccggaaggcgaaatcgcctaccagtccgtcaacggtaccgcctaccccgaaagcaagaccgtgatcttcgacgtggccaacgccaccgctggcaccatgaagcgccgcggccgcaaaaaggccgcctgattcgacacatcgaactggatgcattcttgccggtagggccaaggggacgtcaaccgtgaaggttggcgtccttttgtttgcacagtccatgctcggtatttcatcgtcagacaaggcgtgatataacctgagaacaacggattttcagggaggacagtggttcggatgcctgcatacgcacatgaccagtacgaacgcggacggcatgttatggccgagaccgagacggacaagtcatctgctgcatccagcgtcgaaaagggcagcagcggaaagccacactccatcatcacgtatggcattaacatcgcgatcacgacggcgaatcccgacgagaacattttggatcgccggctcaagcgggccgccgtggatttcgccgaaatcatcgccgcaaaccaattggcagcagtacagtagacgatacatgtgcagcagcttctgcacacgcacaccaccatggtgcgcgtctcaagtagccctgcgattatcaatctctccggtttcatcaccctcagcacgtggaaggccattagcatcaagacgaccttcaccggcgcaaaatgcttcgtcaacaacgcggccctcttcatccacagcatggagcagcaaaagagaacggcagcccgcgcctaccagccagccaacgccaaggccagcactaatctgcaagcgattgccgacctgcgcgacctgaccaaccgtggccgcgtcaccgtcgacatcgacgccgaacccacacgctccagcctcccccagcgcaaagcccacaagcatatacagctgcattaaactatgagtcatagtgaagacgaggggccggaacccgtcaagggttccggctattccgctgacgaatcagcggcctcgcctgaggctcagaccaagcaacaccagtgtggcgatgatgatagccgtcgaccatccctgtccaacttggttggccagagcgatcaacaggcccgtcatcaggccttcccggtattgccggtcagatctcggacggttgtcatggtcattgccttccatgagaacctcctctttagttgtaaccagtcactatgcctgctggcacaatgacaccgtgccaagacgccacgctagtagttccttggtttggtctgtccagcgtacgggggaaggttcgatggatgctggtatgctgtgttctagcagaaaggtcgcgctagcttcggggcaatcttctaggcggcgccactgactttcgcctcgttggacctgactgccgaggtttcctcaacctcagttgtaatcagaaaggtctctggctggtgaattcagtcggagaccttttactttttcaattccaaccgccttcatcaagggactcacccaagctgatttatccgagcgcaccgggctaagccgcccttggatcaaccaattcgaacagggcaaaatcgagaacgccagcatcggccgtatcctgacattgtgcaacgcccttggaatcactctcacagtttcctacggcacccccgaggagacaaacgaaacagcccccagtaacgcacaactttcactatcgatgccgggccatacgctcatgtcaagagctatgcgattctggaaccggtcaacggaacgccccggctggcaccactctatgacaatccctgttcgcctacgacacgcaacacaaagcacacgcatcctgcaatggttcactgatgccgagtaatggtcatagatgacctgcgcatataacacaagcgttccgcacgtcctcagggggcccatgatagaggggtgttcctatgtttttgtcaatctttgtgtggggtgtcgtgttggtgtgtggggtgttcctatgttttttgtcaactccttggggagttgacgtgtcgggattccggttggctgtcgtgggcgcgcttcgccctgccggtggcgtccggcgtcctttcccgtgtggcccggttcaggctacgagggctggttcctggtagagggttccgtttttgagcatgctgtagatcacgtcgcagcgccgacgcgcgaggcagatgatggcggcgttgtggtgtttgccctgttcgcgtttgcgcttgtaataggccacggagggcgggtgtttggtggatgcgacgaacgcggtctgccacagcgcgttcttgaggcgtttgttgccccgcctggagggccgttcgcctttgatgctggtgccggattggccggtgacgggcgatatgcccgcgtaggcggccagatgggcggacgatttgaagttggcgatgtcgccgccgatgccgagcaggatgttgcttgcggtcctgacgcctatcccgggcatcgacgtcaggaccgtgagaagagggtggtcctccaggagcttctcgacctggcggtcgacctcgcgccgccggtccctgatcgtcttgatgtcgtgggcgatggaggggatgatggtctcggccatgagggtgccgggcacggtgacggtctgctcgccgatggccttgaacatgtcgtcgatgatgcggccggcgcgaagcccgttggacttggcccagtccttcacgtcctcgatcccggcccgtttcatgcccgcggggccgccgtaccgttcgaggagcgcgagcgtcgcgtcgcgggtggcgcgttcccctttcaggacgcgttcgaacgcgggatgagcagcattcgtgctagggtgtgcagaagaatgaaagaacaagggcattgttcctctgaaggttgaggggaatcacgtcctctgaaggttgaagggaatcacggaggaagaatttagacatcatgtcgaaagatagaggtacagcattcgtatcatccacgcaaaataatggtactggcaccaggtcaatgcctcatgtgaggatcagcgccagccgagcgtcggcatcgttctctgcaccggtggatacggcagccatcacgccgacattctttgacggtacttatttctcttctgctccggacggtagctctactcacaacgacaatatgggcactcactatctcaccggctattccattccgaaatggcgctacatttacaacaccacactggtggcactcgacctgttgacgaccattgcggcctcaggaatcgtgttcttgttccgtccttccgcctacgcatacgtgcgaggcataggtcctggagaatacggcatattcagcttcctggcgctggcttgcgcctcttggctcatcagtctatatgctgcacgcacttacgaacggcataccatgggtgaaggttacgccctgtatgccaagctactcaacgcagcgttcattgactttatcatgctatgcacgttgagctacctcttccatctcagttttccccggtcattaaacatcttcgttcctctagtttcactagtactggtcatcatcgagcgttgggcgatgcgctgtgccttgcaccgcaaccgtatgaagggcgaattcaactatcccacggtagtaatcggttctccagaaggaatccatgacgcgctcgaacaattgcgccaatgtccaagtgttggctatgcaccggttgctgtgtgcccggttgtttcggccaaaaaagaggatgatgccgatcaggctcagcatctggtgtcggtaccattcacccccgctaatgatagcgaagctcggttgaaggtattgccacttaattcccatctgcctcagacagccaagcgtatgaaagcacgcactgtgctagtggccgacgtactgacccgcgattccgaaaccatgcgtacgttgtcgctcgcggtggagtccatgggcattgagttggcaatgactgcgtccgtggccgatctaagcggcgcagatctgcacttccgcaataatccgagtatgccggtggtcactgctagactcacgcagtattcagccattactcgcattctcaagcgtatttgcgatatcgtgctttccgccatcgccattattctgagctcgcccatcatgctgtgggtggcgtataaagtcaaacgagaagacggcggcccggtgttctattcacaaacacgcattggcatttacggcaagccgtttaccatgtataagttccgttccatgcgtaccgatgccgacaagatcaaggccaaattggctaaggaacgtggcattgaggatcgcttcgttttcaaactcaaggatgatccgcgcgtgaccaagatcggtcattttattcgcaagacgtctctggatgagttcccgcagttctttaacgtgttcaagggcgatatgagtctggtcgggcctcgcccgccgctgcctgaggaagtcgcacgatatggcatgctgtattccacacgactgttggtgaagcctggtattactgggccttggcagatttccggacgcagcgatttgactcagaaacagccggaatatgcggatgtgtcatatattcaggactggtccattaccggagatattgcgattctgttgaagacagtagtcgctgtgtttaagggaactgggtcatactgagttttcttgagtcttcgccagtttgtgtagtgaggggcggggtcggtgtcgttgacgggttcttcctgtgtgcgggtatgaaaggggcgttctcctgttaggtttgtttccgccaaaaacacaaacagaaaaacagagggaacgcctttgcccaccatatcagccggcgtgccgcgcatcgagaaggacccacatggcggagacgtcgtcatagtcccggtccgaccgtacgcgaaggacatggaccggtgcaccaggtgcgagaagcatgtcaggccgtacgaccggctaggcgtgcgccggtggcgtcacctcgacatcgggtgcgccaggctcatgctggagtacgcgccgccgcacgtgacatgcgctgatcacggcgtgaccgtcgcgatgatgccgtgggccagacgcaagagcgcgtacacgcgcgatttcgaacagcagacggcgcttctgaacgtgcacgagcccagaagcgcggtgagccggctgatgcgcatggactggaagagcgtgggcccggtatgcagacgggtcgccgacgacctgcgagcggagcaggggccgggcctgttcgacgggccgcgttccatcggcgtggacgagaccagctacaggaagggccacaagtacatgaccgtggtcgtcgaccacgaccggggcgcgtcatctggatgcatcagggtcacggacagaaggtgttcgacgagcttgtcgaattgtttgtgtatgggacttatttgaggcttctgctgttttcgtgggttagatcgtgggttgtggtagtcggatgtcgagtccaccgcatcggagcatgatcagggcgatgaggttgtcgacgtggtggaagccgtaggccatgcggatggtgaccttgatcctgttgttgaaggcctcgagcctggcgttggagtagcccagctggatcgtgcgcaggatgtccggccggcggcgtcggatcttcttcgccggttcgacgatctcgggtatgcgtgaatgcgaggcccggaacacccagtgcctcaactcgcccctggcctgttcgagcgggtgcttgagcagggtcctcaatagttccttgagttgccatgaacggtagagctggcccttggggcctgtgttccgcaggttcccgaacgcctcggactgtctgtcggtcaggtcgccggggttcttcaggaccgcgtatttgacgccgcgcatgcgcttcgtggtcttctcgtcgccgtcgcggcgcgcctggttccacaggcgtttcctgaccttgtcgagcgcgtcggtcatccagctgacgatgtggaagccgtccaatacgcgttcggcgttcgggcgccaccggccgacgcacgggtcgatccagcgggccccgtcgccggtgacgaccctgatggaggcgtgctgttcgggcgtcaacgccttgaagaacaggtcgaacacgtccccgccgaccccgtcgtgcgcccagatgacccggtgccgctcgtggtcgacgaccacggtcaggtacgtgtggcccttgcgatggctggtctcgtccacgccgatcgcggtgagtccgtcgaacggcgacggcatcgacgccttgacgcgttccgcgacccgacgggcgacggcgccggcggtcctccacgacacatgaaggaaaccgctgaccgtcttccggttcgcgaccgtcatcagccacgcgcactccgcctcgaaattgtgttttagcaagttggcgtccgctttgtgagcggtgtttttccgcagtgtaggcagcgggttttccgcagggtgtgcggtatcggccgctgcctgtctgcgttgtgttggttatttggtcatgagggcgtgttcgcttcggtaggagcggccctcgaatctgatgagccgtccgtggtggacggtgcggtcgatgagggcggcggccatgttcttgtcgccgagcacgcgtccccatccgctgaattcgatgttggtggtgtagatgatgctccttgtctcgtaggaatcggaaatgatctggaagaggagcctgctgccctcctcgtctatgggcaggtagccgaactcgtcgatgatgagaagtcgggccttgccgatgctcgcgagttcccggtcgagccggttctcctgctgggcgcggcgcagacgcatgagcagtccggtcgcggtgaagaagcgcaccgggacgccccgctcgcaggcgagccgtccgatcgcgatggccaggtggctcttgccggtgccgacgggcccgtagagcacgaggtcctcgcatccggcgacgaagtcgaggttctcgagctgcgcgcgcccccagtcggcgggcatcttcaggttggtccagtcatagccgtcgagggtcttgtcggcggggaagccggcctgtttgagcaggcgcaggcgtttggatcgctcgcgcgagtcgagttcggccgtgaaccatcgttcgatgaagtcgagctggttgggcgtggcctcggcgagcgtgccggcgagcacgctgcgtgtcagggtcaggctgcggctcatcttcaggatgcgttcgcttttctcggtcgtggacgcgcgcctgcgtcgggtctccgggatcaccggatcgggtctgacgctcaccgttcttcccctccgtcgtccgtgccggtgatgaaccggtcgtagccgctcaggtcgggctcctcgatcccgccggggtattcccactcgccgtcgcgcatgcgcaacgcgataggggtgagcgagtccgcgtgcaggcccatgtccctgttcgagcgcaggatctcgccgcacgcctgcatcgcgggatcgaacccggccgcccggcacgcgtccccgatcgctttgaggctctccctcaacgtcttttcgtccatggaatcaagccacgcgcgtatatcgtcgggcacgtccgggcggatcgagctttcccgccacgcgcggggtttgaccgcgagccggggaagcacgagcgcgggatcctccacattgcgcgaccgtccgtactgtctgggatactccgcgaggagctcgccggtggcgggcgatgcgagcgtgaccgtgtcccaccggatcgcggccaataccctggaacgcgccgaatcggggccggcgaggtaccggttcgagtcgatgtcgaccagcccgtacttgtcggccgtccggctttcccagcgaaccgggtcgaactgtatttcgtcaagtcggtgtttcgtgtttagtcatgtatttttttcgggtttaggttttctaggcaatttccaatctaacgggtgttgcactttcatttagacaacggggataagttcacagagccgatatttgataagctggtgaatagcaatcccaataaagtggcatattgggctatggattcgttgagcagcaaagaggatgtaaaagctgctatgcaaagcattgacgatcttaagcaacaaatccgctcattcgtcaatcttgagcaccttaaagtgccgatgattgtttatttgggtggatctgctcatattgctgacgtttttgctaacctcaataaaggtggtgtccctctgaccaagtatgaagtgtttggcgctgcttgggttaatgccgccattcggctacgaggggctgaggaatctccgttgcaagatcagctgttgcagtatgtgaaaaattactatcttgatatgcgcaagcaagctgaatttgatgtagatgatttttctgaagatgaactgacccagaatcgcacggtcacgttgccggaatttggtacagcgttgggccagtatgttgtagatcatttgtcggctcttgtccctgagacaaccagtgccgctccagagattggcttcgggcttcttggagtggccatgaacttggacaatcgtaagttgagttcactcaataagtatattcagaaaattagagacgaactggaagatattctccagaagaccgaacgcatatgcaataatttgcagagtatgtttgagaccttattgcgtcgatttaaatctactggcaatgattatgaaaacggcctatcttcgacgtttaagacgttatcttatttcgcggcattgtgggatttagatccatcttcggaagaatacacaacagcgctatctaatattaaggctgcatatgtgtatgatgctatcacatcagcatggtcatctcatggtgatcagaggttaatggaatactgtaattcttctcgtgactatggcacgcgtatttcggaagaacaatttgatcaggcctttgatcagtggatcgcagatcagactccaggaataaactttggtaaagatattaaatgtctgataacaattcatgcgaacttaagctatctttctgcgtccgtgccaaacggagagacttttgagttggagcatatcattgctcggaagcgtattgacgcggcggattcttcgaggcctcgacatattttgggtaattcgttaggtaattgcatgtatttgccacgaggtattaacaatccgaagaaggataaaaccttgtatgagattaacgaccataaccgttattctcaacttataaaggagtcgcagtattttagtgaggacgagatgcagaaagccatgcaggctctgactgcatccgattacgagtcagtgaatggtttactgcgtgagcgttcgcgacaagtagcccatacattggttcgtgcgctacttaaagattctgtttgattataactgtttaaaagttgttccgagggatcgggactagatcaaaggagcctcgccatgattctcgtcactaccaccccgtccgtcgacggatacaccatcaccaactaccagggcatcgtcttcggcgaagtggtgtccggtgtgaacatgttcaaggatcttggcgcgggcctgcgtaacatgttcggcggccgcagccagggctatgaggaagagctgatgcgcgcccgtaacgaggccattgccgaaatgcaacaacgcgcggaggcgatgggtgcgcacgccgtggtcggcgtggacatcgactacgaggtgctcggcgccgacaacggtatgctgatggttaccgcgtccggcaccgccgtgcagatcgcgcgtacggcctgaaaatactcatgaattgagggcgtgcgggtggtctgctgggctgcccgcacggttcgcaaacctacagcgcgcaaacaatcagataaatcgccacgacgtggcaggcgtacccgatgaccgtgcctaggtgaaacacctcgtggaactcgaaccagcctggaatcggattcggcttgcgcagcgcaaagcacacagcgccggcgatatacgcggcacctccgcacgcgataagaatggtcgcagccgggcccactgcgggagccgtccatagttgcggaataagtgtcaccggcgccaatcccagcacaacatacacagtggtgaacacccagttcggggtgcgcagccagacgatatgcagtatcgtgccgatcgccgcggtcacccaaatcaccgtgagatatggccggcgaatcgccgggctgagtgcgaacagcacaggtgtgttagtgccggcgatgatgaggaagatgttcgaataatcgatgccgcacagtacgcgagtcaccttcgcgctgcgccacggcacgacgtgcagcagcgcgctgttgccgaacagcagcatggccgaggcaccgtacactgcgcaggccgctttgaccgagccggccggcgcgatgcagatgagtacgatggacgccgcgatgcacagcggcagggtggcgaggtgaagccatccgcgcagtcgcggcttgcgattgccgaatgcatccacggggacgatctggcgcttgatcgccttcagtgcggccttggcttggcggtagcgcgattgcgcggccctgtatcgggccgatgcacggtccagtgcggtggggttggcgcttgcgctggatttttgactcgcggttgcggaaggcgcaactgttgcggcggaagccatggttcgtccagatggcgtgctgatggaaacgctcatactgatcacctcgctatggccggcgacgctctcccgaccactaacctacgctaccgtaacctagtataggcccgcgcaataatcaaggttgatttcgtaatgcttacagttcttccgtggtgtggtattcggtggtgcggttgcggaatacatcgccgagtctgtgaactcgtattatgcgtgtctgctgggtccgacttgtgtcggttcctgatttcggattgctgcgaatgatgctcccgacgccgccccgccagttgccggattcgtacggctcggccgttcggccgagctggtcgtcggtgactccagatacttcgttggtttcgtctcggttcatgatgttatgtaatgctagtttatggcggatggaaagttgaggaaagttaaatctgcttcatgggcttctctctgatctgtatttgtcccggttcatatgtcaatcgtttgacctgtcgaccggggcagaatccgctgtcccggtcggcgatttcggcttgttttcgtgaaccgggacactccggtttcctcaactcatatcgtctggcagacggaatcggcggaataaggccgattctggaattggcacgttgtcccggttttcgcataaatcgattgacatttataccggggcaacaaaaattgtcccggtttgcaaagatcgcccgaaatcgcgaaccgggacagcggattctggcctggcttgaacgtcaaacgattgatgcaggtaccgggacattttccgccacgaaagttgggccataagtctcaagtcctaagccctcctcaaggccatcgcaacttgaaaaacggcgcttgcccggacaaagcaaaagggctggaaccttccggttccagccctttagttgctggtgcgagtggggggagttgaacccccacgagcatacactcactgccacctgaagacagcgcgtctaccattccgccacactcgcagacaatcgactaacttacacccggctgggtaatcatgcaatcttcggcgtgtcgcatgtgcggcagggatatatcgctcgtgggtcttctgcgggtgccgtgatctttgacggtggcgacactcccctcagtcacttcgtggcagcacaagccgcaacgaaggagaaaaactcacaaccctggccggcgctcgccgttgccgtagaagtgggccagcgcttcgtcgcggaactcatcaaagtatccgtcgtcgatcgaggcgcggatgtcgtctagcagcttcacgaagaaatgctcgttgtggatcgtggccaacgtaaacccgttgaactcgcgggcgcgcagcaggtggtcgacgtacgcgcgcgaataatgctggcatgtgtagcagtcgcatccctcctccagcggtccgaaatcgaacttatgctgggcgcgcttgatgttgtaccggccggcgcgcgtgtaaatcgcgccgtttcgggcgcagcgtgcgggggccacgcagtcgaaggtgtcgccgccgttctccacgcaggcgaaaatgtcgtccacagaggcgatacccagcacgtggcgtgggcggttttccggcatcgcgtcgcagatccatgcacaggtgtcgccgatgatgcgcttctcgatcgcgccgccgatgcccacgccgtcgaagtccagagaggcgatttgcgaggccgcacgtcggcgcagatcctcgtaattcgcgccctgcaccacgccatacaacgcctgatacggcttcccgactcgatcagccgtcagccgctggtgctcgtccacgcatcggcgggcccagcggaaggtgcgctccaccgagtcctcctggtaggagcgggtgttcatcagcgtggtgagttcgtcgaacgcgaacatgatgtctgcgccgattttgtgctggatgcccatcgaaatctcagcggagaaacgatgtgcgtcaccattcagaggcgacttgaatgtcacgccgtcctcgtccacccaggccatgcgctccttgcccttggcgatgatgtcgtccgacttcatgccggtcacgtccattgccagcgtcttcttgaagccgacgcccagcgacatcacttggaaaccgccagaatcggtgaacgtgggcccatcccagttcatgaaacgcgccaagccgccggccgcgtccagcacgtcctcgcccgggcgctcgaacaggtggaaggcgttggccagcaggcactgtgcgcctagatccttcatctgctcgggcaacacggccttcatcgcggcttgcgtgcccaccggcacaaaggcaggcgtgcgaatatcgccgtggggcgtgtgaatgatgccggtgcggccgtatcgggcaccgtctcgcccaagcccgctggccgtggatggcaggcgggtgatcgtttcgaaatggaaggcgctgcggtcgccgggctgtccgggctgtgcgcccaacggatgttcaagaaggctgatcgtcatatgttcactttaggcagaagggccagaaaagggccggaaattgtgaagaactcggtttcgaggggcggatttcgccgctcccgaacgtctacttccgcttcaaggggctcccggtcaagtaggccggctgcaaaaatggcggaatggcgttaaatgagggcccttgatactcggaattgaccgcgcgaacagccccttgaagtgcaagtagatgttcccgaaacaggaaatcagcccctcgaagccgagatgcccataagactctgcgatgattacgcatagactttcaatcaacgttcagaaaacctccagattgactgcctttactactgaggtagcacacgagaagtggcaatgggcaagtgcccgaatagccgccgaacagacgtgataggaatttaggaaaaggagcagcaatggctgacgaatttaacccgcagggcgtcgaccagaccccgcggaataacgaaaaccccaatagtactgccgataccggcaacgccgagccgaagaacccgtttgtgggtggcgactcggttgatgccggcaacgccagcgattccagcgagcagcaagccccggtttcctcggccgccctcgctgccgatcagcagcctacgcaagccgctaccgacactgccgccaccgagcccatcccggactacgcctccgccaagggcgagagcacggtggtctcctcctcgccggcttctccggcagcaccggccgcaggccagacctcggccacaactccgctgtatcgtccggccccggaatatggcgcttatggtccgaccccgactcgggcacagggccagcagggcggccaggccggcagcaatgcccagcccacgcagcaattcccgttcggtcagcctgcacagcaaaccctacagggccagcagggcaaccgcaatccctactacaccaataacccgcagccgcagggcaacggcaatccgttcaatccgcccacgcagccgcagcagaacaacggcaacccgtttgccagccagtccggtcagaatggccggaatggccagcagccccagcagggcggtctgttcggtttcggcgctcccggtaccggtacgccgaacggtcaaggcccgacccagccgggacagcccggtcagcccggccccgccaagcagggcatgtccaagacggcgagcaacatcctcatcgccgtggtcgccgccgttctggctgcggccctctgcctgggcctcggttacggcgccctcaccagcggcctgatcaccttgccgaccagcaattcgctgtccaacgtcagctcgaataagtccggctccgggtccgccaccgccaagagcggcgaagcccccgactggcagaccgtcgccagcgatgtctccggctccgtggtctccatccagaccgcgttgagcaacggcaccgccaagggctccggcgccatcatcgacaccgaaggccacatcatcaccaacaaccacgtgatctccggcgcccagcagattcaggtgacgcttgccaacggcaacatgtattccgccacgctcgtcggcaccgacaccaccaccgatcttgcggtcatcaagctcgacaacccgccgagcgacctcaaggccgtgaaattcgccgattccgacaagctcgccgtcggcgagaacgtgatggccatcggcaacccgctcggctacgacgacaccgccaccaccggcatcgtctccgccctgaaccgcccggtgaccgtgaccgacgataacaacaacgagatcgtcaccaacgccgtccagatcgacgcggccatcaaccccggcaactccggcggcccgaccttcaacgcggccggccaggtgatcggcatcaactcctcgatcgcctccaccgccacctcctccgactccgccggctccatcggcatcggcttcgccatcccgtccaacctcgtcaagcgtgtggccgacgaaatcatcaaggacggcaaggtcaagcacgttgccctcggcgtggtcatcaagtccgacacggttgaagccgacggcgtgacccgcggcggcgcgaccatcaccaagtccagcgccaccggcagcgcggtcgtctccggcggcccggccgacaaggccggcctcaaggagggcgacaccatcgtggccttcaacggcaacgcggtgaacaacaactactcgctgcttggttacgttcgtgccgcggctttgggagacaaggtgacgctgaccatcgtgcgcgacggcaagaccatgaatgtggacgtgacgctcgatcaggaggagtcgtcggtgaacggttcgtccggctccgattccaacggcaacagccagaataaccagaacaaccagaacggcaatggccagaacggttacggtaatggcaatggcaacagcgatggcggcaccggtgacggcggcggcttctccgacccgttcggcctgtggtaaagccgactcgacaacgtcacacggtgttgagcggtaaccgctgaacaccgtgtcggacaagcaaaggcccgtgacagtgagcaaactcctgccacgggcctttcgtatgcgcgattgtgcctcgcacccatgccgccaacgtagtttcgatatccggcatgtcgcgcaacgctcgttgatagggtaggccaagcactgagttcgggcgacgtcccgaacacagcgcataattcaatacaaaactgaatacatttctttacgccgtgtatcggaaggtctcgcgggagccgagcaaagcgaagccccaggcaaagccgccggtgggttaacaaggcgtgaccgtagcgccgattgcgcgggccacgcttaccgtaccgcaatcgactccgtatacgagcgtaaggagcaatgatgagcagactcatcagattcttcaccaaaattctcgacatctgcaagcttgtgccgatgcttccggtcgtcgtcatcgccgcaattccgttggctttactaggcgattggcgtccgtggggcaatgcgatggcgattccggtactcggcaatccgggtttcggccagtggctggttatcgcactggtgctggttattgtgattgacactgtgcgcggcatgattgacgatttgcgtcatgggcaggttggagtcgatgtgctggccgtggtcgcgatcctctccaccgtggccgtcgccgaatactgggcaagttgggcggtgacgctgatgatcacgtccggcgaggccattgaggaatacgctcaagccaaggccgagcgcagtctgaccgcgctgatggaggccgcgccgcaaaccgcgcacgtcgtcaacctgcctggcgtggggcgtgggtttgctgccgataagggcgattcgtccgatggcttccggcgcgtgggctcggcatcggctgccgccgccgcgcaccgcttcgacacggtgccggtcgagcaggtgcagctgggcgacgtactcatggtgttgccgggcgaaactgtgccggttgacggcgagctgctgtccggcacggccacgctcgacctgagcaatatcaacggtgagccggtgccgcgtgaagtgttcgccggcgcccgcgtgatgtccggcgcggtgaacggctcgactgcattgaccatgcgtgccacccaggtggccgccgattcgcagtaccagcgcatcctcgagctcgtggcctccgcgcaggagtcgcgcccggccgtggtaaaaaccgccgaccgcttggctgtgccctttaccgtgctctcgctggtgattgccggcgtcgcatgggcggtgtccggggtgccgacgcgattcgcccaggtgctggtgctggccacgccctgcccgctgctcatcgccgcaccggtggcatacatcgccggaaccggacgcctcgccgcagccggcgtgcttatcaaagcgcaggacgtgctggaaaatctcggccgcgtcacgcaggtgtttttcgacaaaaccggtacgctcaccgtcaagcagccgcaggtggtgcgcgtcgagatgttgcccggcgctgcaacccgtctcaacgaagaccatgtgctgatgatggccggcgcggtggaaagctactcggtgcacatcctgtccaaaggtatcgccaaggccggcgcggaggcgctggccggactgcgccagcggttcgaggatggccagcgcctgtgcccagagccggaggccagctggcctggccatggccgggagtatccggtcgtcaagaacatcaatgaagacgccggcaagggcgtttccggcgaggtgaacggacacgcggtgcgcgttggccggctgtctttcgcggctgctggggaggatggattcctggcggtcggcgaggctgcccccctcagcccgcgaagcggccagctccccctaagagggggagctcagcaaaaagatgacctgcgcactcgctttggcctgctgcagccggatgagatggcgtcctacgtgtccgttgacggccggctgatcgcgcgcattgtgctgcgcgatgtgccgcgtgccaacgccaaggcagtgctcgccaaactgcatgagttgggcgtcaccgagctcgccatgcttaccggtgacaagcgggcttccgccaatatcattgccagcgaagtcggcattgacgaggttcacgccgaactgttcccggaggataaggtagccgcagtcagggccgctacaggagccggcaaaaccgtcacgatgatggttggtgacggtgtgaatgatgccccggtgctcgctgttgccgatatcggcgtggccatgaccgatggcacgtccaccgccgcttccgaaagcgctcaggtggtcattatgaatgacaatatcgccgccgtgccgcgcgccatcgccattgcacgccgcaccaagcgcgtgatgcttcaagccgtaatcgcgggccttgtgcttgccaccatcggcatgattgccgccgcgttcaaccttatcccggtcgtcgtcggtgccttcctccaggaggccatcgacgtggtgagcatcctctgggccctcactgccctaattgatcgggactgattaagaatatgaggcttctgctgtttttgtaggtcagttgactgaccgggatggtcgtatgtcgagtccaccgcatcgaaacataatcggggcgatacggttggtgacgtggcggaaacggaaatcccacccacgaaagcagcaatagcatcggagttattcattaggtcgatttgacgtttattaggtcggtccttggtcggagcggcccttgaaaccccgccgttccaagggatggcttcagcaccctccgacctaatgaacgaagaaatgacctaatgaatgcaatcgaggtcgtaaagagccgttggaggtgacgtcttcagtgtcatcaagggattcgccggttgtgcagtattgttattgctctgcggcggctctttaccgtcggccttctagccaatcgaggggtggaggtgacgcggattccttgtgagacataactatgctcaacccgactggttacgtactgttgctcacacggtatgccgagaacattgccaattaaagtaaggtgccgggcgaaccggtcatggtaggtttgcccggatttgatttcgatcatcaggcgatgattcggatcggtgaaatccaacaaatccacctcgaccttgctggcatcgcggtagaagaataattgtggctcctgattggcgttcaaatgctgtttcatggtttccgcaatgatgaggttttcaaatatatcgccgaacttgggatgcgcaaccagtgcttcgaccgtccgaatgcccaagagatggcacagcaagccagtgtcataaaaatagagtttcggcgttttgaccacctgtttgcgtgcgttcgtgtagaacggtatgagatggaatgcgatgtaacttgattccagaatcgacatccatgcctttacggttcgcggacttacaccaagttcattggcgatgttggtgtagtttatgagtgctccggaactgagtgcgcaaagagtcaagaatcggcggaattcagccaaattgcgtacatcaagatattcggaaacatcacgttcgatataagtgtcgatgtagttcgagaagaacagattgagcggcattctcgtgtcgtaaatgcgtggataaccgccttgcagcataaacgtatccggagtaagggcctgatccgccttgcatgcttcttggaatgagaacggcaataacttgaccaatagggaaacccataatctgacattagcagtgctcgtaggtttcccaaacgcacaaactatggcctaatacacagaattcccaccactcgccctctgttgcaacggaaggctttgcgttaggctagagcgcgtgactgaatctgtgaatactgaactccgcattgctgtaatcggcgctggtccggccggcgtctactcatccgatatcttcctgcgccagctcaagaagctgggcgaagagctcggcctcggcaccgaagcgcgcatcgacctgttcgagaagctgcccgtgcccttcggcctggtgcgttacggtgtggccccggaccacccgtccatcaagttcatcgcctccgcgcttgagaagacgctcgataacccgaacatccacctctactgcgacgtggaattcggcaaggacgtgactcttgacgacctgctggcccgttacgacgccgtgctgttcgccaccggcgcggtcaaggacaagccgctgaacctgcccggcgccgaccttgaaggcgtgtacggcgccgccaagttcgtcgaatggtacgacggttaccccaccggtgcccgcgaatggccgcttacggccgagaacgtcgccgtgatcggcggcggcaacgtggccatggacgtggcccgcgaactcatgcgcaacgccgacgacctcaaggccaagaccgacattccggacaacgtgtacgagggcatcggccagaacaaggccaaggtgctccacctgttcatccgccgtggcgtggcccaggccaagttcagcgtgcaggaactgcgcgagatggagaagctgcccggcgtgcagctcatcatcaacgaggacgacttcgatctggacgacgagaccatcgaggtggccggcaaggacaagctcacccgccagatggtcgaggagctgttcgccgtccgcgagatggccgaagacatggaagatgacggcgacgtcgacttcgaaggcaacccggccgaccgcaagtactacgtgcacttcaactccgcccccaccgagatcctcggcgaggacggcaaggtcaaggccatccgcgtggagcgcaccgaaaccggtgccgacggcaagatgcaccgcaccggcgagttcaccgactacccggtcgaggccgtctaccacgccatcggctacaagcccgccgaagctcccggtatcacctacgacgagcacggcgcccacctggccaacgccaacggcgacggccgcatcaccaccgaggccgacggcggcaaagtgcgcgaccgcctgtacgccaccggttgggccaagcgcggcccggtgggcctgatcggctccaccaagtccgatgcgctcgccatcgtgaccaacatgctcgaggatctggccaaggccgctgaaggtggccgtgtggcagccgaccgcgaccccgaatccatcgaccgactgctggccgagcgcggcattcgcccgatcgacttcgccggctggaagaaggtcgacgccttcgagcgcgccgagggtgccaaggaaggccgcgagcacaagaaggtcatcgagcccgaccagatgcgcgagctcgcccacgcctgacggcccgcccacgcccgtccggcattcgtccggcattcgtccggcattcgtccacccggccgcgccccgtgcggacgcggccgggctcggggccggacgggccgggcgaatatgggacatttctcgcggcgcatatccagcaatcattcagcatgcgattttagtgtgtgcattatggatgccaaagtacgggtgcacggccatttcaacggcctgaagacaacgctgctgtttgccctgatgtgggccatcatcatgctgatttggtgggccacgggcggcagtcggcaaaccctgagcatctatatcgtcatcggcctgattaccacgttcggcacctactggttctccgacaaactcgccatcgcctccatgggtgcgcgggaagtcagcgaacaggaagccccggaaatctaccagatcgtgcgtgaactgagcgccaaggccggcaagccgatgccgcgcatctacatcgcccccaccatgagcccgaacgccttcgccaccggacgcaacgaacggcacgcggctgtctgctgcacccaaggcatcctgcagattctcaacgcccgtgaactgcgtggtgtgctgggccacgaacttatgcacgtgtacaaccacgacatcctgacttccgccatcgcctctgccatggccactgtcatctcctaccttggctattcgctgatgtatttcggtggcggctcgcgagacgaccgcgatagttccggtggcctcggcctgatcggcgcattgctgagcgtgattctcgcgccgattgccgcgtctttgatccagatggccatctcccgcacccgcgaatacgacgccgatgaagacggcagcttgctcaccggcgatcccgaggccctggcttccgcgctgaacaagatttcctacggcgcacagaccgcgccgatgcgcaaaaccgccggcacccagtccgtctccgcaatgatgatcgccaacccgttctccgcggtcggtttctcgcgcttgttctccacgcacccgccgaccgatgagcgcatagcgcgtctcatgcagatggccaacgaaatgaacggcacgccgatcgctccgcccacctactccacgcgcgtcggcaggtgacgtgctaggataactattcgtgcctcgtttggctgagcatgctcgtcacgtgaggtgcagcagccgtaaggcatgcggacatagttcatcggtagaatgaaagcttcccaagctttagaggcgggttcgactcccgttgtccgctccattgattttcaatgattttcattatttccgggaaagtgtcgcgcacgatcgcaaaactacgcgctatttgagcgctttgcccgcggaacccagctgccggcaagcctcgaccacgcgggcggacatggaatcctcagccttacggccccaagaacgcggatcgtagaacttcttctcgcccacttcgccgtcgatcttcagcaccttgtcgtagttctcgaacacgtggtcggcgattggacgggtgaaggcgtactgggtatcggtgtcgatgttcatcttgatcacgccgtagcttacagcttcggcgatttcttccgggcgtgaaccggagccgccgtggaacaccagctcaaacggcttgccgttggggaaatcgactatgccggccgcgctaggcaactcgccttcggccaccgcgcgcgccacacgcgcctgaatgtcgccgagtagcgacggacgcagcttgaccacgccgggcttgtaggcaccatgcacattgccgaatgtgaaagcggccatgtaccggccacgttcgcccaaacccagtcggcgggcgacttcgaggccatcttccggagtggaatacagcttttcattgatttcggcggagtgaccgtcttcctcaccgccgaccgcgccgatttcgatttcgagcacggtgtgcgccttctgcgacttgtcgagcagttcctcggcgatgtccagattttccttgagcggcacggtggagccatcccacatatgcgactggaatgtaggctcctggcctcgtgccacctgatcggcctcatgcgcgagcagaggacgcacccactcatccagatactgcttggcgcagtggtcggtgtgcagggcgatggtgatgttcgggtatttcgcagccacttcatgtgcgaaagccgccagtgccagcgagccggtaacgcgatcattgacccctatgccggagacgtaagccgcgcctcccacggaaatctggatgatgccgtcggactcggcgtctgcgaagcccttcaatgcggcattcagcgtctgtgagctggttacgttgatggctggataggcgtaaccgcctcggcgggcggcatcgagcatttcggcatagcgttccggtgttgcgatcgtcatggcttcattatcgcgcgaggcatgcccgctaggccccgttcttcaacctgtgcgcttgtgcgattggtcacagcgccgcctcgtacgagtagaaattcgtcacccattccgggtcgtcgcacccccagcctcgccctgcgtgagacgaaacttcgcagggtagagggtgtaaggtagtctgtttccggcggaatcgtgcgaatgcggaggtgcatcatgcctggaattgttcttatcggtgctcagtggggcgacgagggtaaaggcaaggctaccgatctgatcggcaccaaggtcgattacgtcgcgcgcttcaacggcggcaacaacgcgggccatagcgtggtggtcggcgacgagtcgtacgccctgcacctgctgccctccggcatcatcaacccgaacctcaccccggtgatcggcaacggcgtggtcgtggacccggaagtgctcttcgaggagattgacggcctggaatcccgcggcatcgattgctcccacctcaaggtgagcgaggccgcgcacatcatcgcgccctaccaccgcacactcgacaaggtgactgaacgcttccttggcaagcacaagatcggcaccaccggccgtggcatcggcccggcctacgcggacaagatcaaccgtgtcggcatccgcgtgcatgacctgttcaacgccgaccatctgcacgacaaggtggaggccagcctgcaccagaagaaccagatgctggtcaagctctacaaccgtcgtccgatcgacgtggaccggaccaccgaggagctgctgaagctcggcgaacgcctcaagccgtacgtggccaacaccggcctgattctcaacaaggcgcttgacgaaggcaagaccgtactgtttgaaggcgctcaggccaccatgcttgacgtggaccacggcacctacccgttcgtcacctcttccaacccgaccgccggcggcgcctgcaccggcaccggcgtgggccccaccaagatcacccgcgtaatcggcgtctccaaggcctacgtcacccgcgtgggcgaaggcccattccccaccgaactgctggacgagtccggcgaatggctgcgtcagcagggccacgagttcggcgtgaccaccggccgcccgcgtcgctgtggttggttcgatgcagtcgtcaaccgttacgcctcccaggtcaacggcctgaccgacatcgtgctcaccaagctcgacgtgctcaccggcctgaaggagattccgatctgcgtggcctacgacgtggacggcgaacgtcacgacgatatgccgaccgatcaggccgctttcgccgccgccaagccgatttacgagaccatgcccggctgggacgaagacatctccgactgccactccttcgacgagctgcccgccacctgccaggcctacgtcaagcgtttggaagagctgagcggctgccgtatctccgcgatcggcaccggtccgcagcgcgatcatgtcatccagatcaattcgctggtcgactgaccgtctgcaacgaatttcccggcttgactggtaacgacgcggcacatgatatccgccggctgattccgcgattcgaccacttgaagtggaagatggcggcggccggcatagtcattggtctggtttcaggattgctggttgtcgtataccgtctcggcatcgaatacggcacggatgcgtcccgttggatatatgcgcggattcgcgagaccccgtggctgattgcgccgtgggcggttgccgcggtggcggccgcgctggcgatcgcgtggatggtcggcaaggagccgatggctggtggcagcggcatcccgcagaccaatggcgtggtgatatgcggcttgaagatgcgttggcagacgattctgccagtccgtttcgtcggtggactgttgggcgcgttgtttggtctgtcgctcggccgtgaggggccgtccattcagattggtgcgtcgggcgcgcagtgtgtatcccaccgtttgcgcggccgccgccgtgaggacatgcaggagcattatctggtcaccgccggtgccgcggccggcttgtccgccgcgttcagcgcgccgctgtccggcatgatgttcgctttggaaggggtgcatcggagtttttcccctgcgattctgatgggcgccaccgccgcatcgctgaccgccgatttcgtctcaaaatactgtttcggtctgcgtccggttttggatttcggtgatatcggtcagctgtcgttggaagagtatgtgtggctgattccgttgggattggtggccggtttggttggttcgctgatgaaccgctcgttgcttggcttccagacgctgtacggcaaactgccggcatggagccgcccgatgattgcgattgcgatcgcgttgcctgtcggcatctggttgcccgatgtgctcggcggcggctcgaatctgattgataccgccgaacatgcgcgcgtcggcttgggaatgctgtgtctgctgttcgtggcgaagatgctgttcacatccacgagtttcggctcaggcgcgcctggcggtattttcatgccgattcttgcggtcggttcgttggccggcggcatctgcggtgaagtgttgcatcgattcggtgatctgccatccgacgcagtggcggtgtttgcggtgtgcgtgatgacgggcacgctcgccgcgtccgtgaaaacgccgatcacgtcgattctgttggctgtggagatgtctggaacgttgacgcacatgctgccggtcgcggccgtcgctttcatcgcgctgttggtgtccgatttgctgcgcaccaaaccgatttatggggagttgctggagcggtacgtgcgcgcgcaaggcatgcagatggcgatcgcaagccatgtgggcagcggcattatggaactgccattggaaatgggagcgattgcggacggcaagcgggtgcgtgacgtgcgttggccgtctgggtgcctgatcatcggcctgcgtcgcggcgaaagcgagatcgtgccgcgcggtgatacacggctgcgtgccggcgactatctggtggtgctgttcagtggcgaggaggagcgcgaggtgcgacctgcgatgcggcggctgtgtgatgcccggcttgactgagcctggctgaattcggctggactctggatgtccgaatctgcggaatcggacatccagagtgcatacgttggcgctccgtgtaaactcatatgcgttaggaaggcggcagccgcggcccagctcgttgttgcacggcctatgggcggaacaacgctgtccgcgggaggccagtacagggggagcgcaatggaatcgcaagaacaatcgccgggagacgtggtgactgcgggtgaggactcgcatcccatcacgcaggcaatcgacgctgttgaggtgacgcatgctggtgcaaccgcgcccgccgctaacaccatgaatccgcctacgattcccctggcaccgatgaaacgtatgcaggcgcggttcaatccgctcgccgacggactgatgtatgttgtggtgttcgtcggtggatttgttggagtcggctgtcggcatgcgttggatatgctcctgccgtcggtcagcggggcgccattcgttgtgggcacgtttgtgtcgaatatggtcgcctgcttcctgttcgcgatgctgaccgaattcatggcgaccgcttcgtggctgcgtcgccgggtgcggcaggttgtcagccgtggtgttgggctcggcttgctcggtgggctttcgacgatgtccggcgtgatgctggaaacgatggaaggtctgcacgagcggcatatcgccagtgcgcttggctatcttgcgggaaattttgcaggcggtttgctcactgccgccgccggcgtggttctgatgcaggcactgctgtcacggagtactcgaaagcgggttcggggtgcgttttcagctgtttccgtgtccgattctgccgaatcggacacgcagggcgtacgccatgtgaaagtggccgacgtggcgcgttctgccgcgcaggccgcaatggaagccgcgcaggcggcgcagcaggccgcgcagacggcccagcagattgcacagacgggacaggttccgcgagtcgaaacgccaaccgtgccgccgactgccatccagcctatgcagacaggccacgttccgcagattcctccgctggtcgttcctcagctgacacagtcatcgcagccgttgttgcgcgagccggatacttcagacttggggcagctgcccgagccgattcagcagtcgcaaccaatccagcagccccagcagcagtcgcagccaatccagcagccggccaacccgcttccacccagcttcgagcccaaaccgatcactgcggagatttcgcttgtcgccgacccgactaccggggaggtgcgctgatgatgtggatgatctgtctgttcggcggtctgggagccatggcccgttacgtgctcgacgtgtcaattcaacgaggctggaaccgcgagaatcgaagaacgaaccgcaacttcccgctatccacgctcgtcatcaacggcgtcgcctcgctatgcgcgggcatcgccatgatgtcctactattcgcaatcggtggatatggacacggtcatgatgttcgttgtcggatttctcggtggtttctcaacattctccacggcgctcaacgaagtggtttcattgattcgccagcgtcgttttacgctggctctgggctatggaatagcaaccgtcgcggtgcctctcatttgcgtggccgccggtttcggcattgcgctgcttgccaatccggcgtaattttcacgttacacggacggtcgctgagtaacgtgaaagaaatctgagcgccaccgccatcaaggccgccagtccggatgcaacgctggtgattgcattcgaccagaccaagccgctgctgaaggccttcgcctccgcgggagtcgacactaagaagctgtatttcgttgccggactgtcgaacaggttcgagagaatgtaaatgaatgtaatatttcgtggtaagcacgtgagcatacaacgatagaacagtgatgacggggaaggtgcgatcatggtcggcatgcgcgatgtggcgaagaaggccggggtgtctctgagcaccgtctcgctggtggtgaacggcaacgggtacgtgtctgatgacatgcgcgaacgtgtgcgcaaagccatgcaagccctcaattatgtgccgaacgagcttgcccgcaatctgtatcatgattgcacgaatctggtcggcgtcatcgtgcctaccatccgccacccgttctttgcgacgtttaccgcacatctgcagcatgcgctcgccgcgcaaggattacgcactatgctgtgctctaccgcagatgaggcggatggcgaaatccagtatgtcgacatgttgcgtcggcacatgatggacggcatcgtcatgtgtgcgcacacttcgcatcccggcgattattggacgtcgattcatcgcccgatcgtcgcgttcgaccgtgtgcttggagacggtatttcgtcaatcggatccgaccacgagcagggtgggcgattgattgcgcagatgctgatccgcaatggtgccaaacatgtggtgatgattggcggtccgcgagatcaattcttcgatttggctgcgcgcggagaagtcgaggaaggaccgttcgatttgggaaagaccacgttcccgacggtgcgctactacctcacgttggaacaggaattgacctccgcaggcgtgaaatacgagtatgttgaagctggcgaagtgatggattttgccggctatcatcgtgcggtcagcaatgcgctcgacaaggtgacgaccgacggcgtcgatgccgtggtcagttccgatattggtgcatcgttctgcgtgcgcgaagcgttgggccgtggaatttccattcctgacgagctgcagatcgttgcctacgatggtacgtatttgactgatttggccggcatgaagctgaccgcggtcgcgcaggatttctcggcgatcgcacagtcggcggccgaccatatcgtgcaggcgattgccaatgaggaagtggccgcggctaacgcttcacgcaagaacatccccaagccgttcgagccgaacgtgcttattcccatgacactggtgccaggcgataccacgcgttgatactgtgcgtcttcatgcgtgtgcccggtgtggatcgcatcgatttcagcggcgtccacaaccggcgaacgtccgtcgatagtcgtgctcatcattcgacttgtgcacatgtgtccgattctgccgaatcggacgtatgagttccgaaaaatgtgttctgtgtgtccgattctggagaatcggtcatgtgtgatgtgaattgggatgtttggatgtccgtttctgcagaatcatctttgctctgtactcgttgattcgcaaatacggcgcatggctcgtcataccggccatgctcggcggcgcggccttcctggcggactcggtgctgacgccggccgtgtcgatctcgtccgccgtcgaaggcctgaagacgctgccggcgttggagcatctgttcaccgagaacaaggatctgacgatgatgatcaccgcggtgatcatcgtgatcctgttcgccgtgcagtcgcgcggcaccgaatcgatcggcaaggtcttcggctcggtggtgatggtctggttcgcgttcctggcgatcgtcggcgtggtagccatcggcaacgactggtccgtgctcgccgcactcaacccgtactacggcatcaagttcctgttcagtccgaataacgccaccggtctggcgctgatgggcaccgtgttcctttcgaccaccggcgccgaggcgctgtactcggatatgggccacgtgggccgcggcaacatctacttcacctggccgttcatcaaggtggcgctggtgctcaactacttcggccagggcgcgtggatgctgcgcaaccagaacaaccccgaactggccgacgccgaggggatcaacccgttcttccagatgatggatccgaacgtgcgctatgtggccgtcgtgctgtcggtcaccgccggcatcatcgcctcccaggcgctgattacgggcgcgttcaccatggtctccgaggccaccggcctcaactggatgccgcatctgcaggtctgttaccctgcccgtacccgcggccagctgtacattccggtcgtcaacgtggtgctgtgcgtggccacgctggccgtgctgctgctgttccgcgattcggaacatatctcggcggcctacggcttggcactgaccatcacgatgatcaccaccacgatcctgctgggcatctacctgtggcaccgcagcaacaagttcggcgccgttgtgttcaccatcgtgttcctggcgatccaggtcctgttcttcgccgcctcgatggccaagttcctgcacggcggctggttcacgctgctgctcacgctggcgatcctcatgatcatgtacacgtggaacgagggcaccaagctggagcgctcgcagcgtcggcacatgatgccgaaggacttcctccccgcgctggacaagctgcacggcgatagccgcatccaccggttcgcggacaacatcgtctacctgaccagcgatccggacctgaagcgtctcgatacggacatcttcttctcgatcttcgccgaccaccccaagcgcgcccgcgcatggtgggcggtggccgtcgagaccaccgacgagccgttcacccgtgagtattcggtcgagagcttcggtaccgactacctgttccgtgtgcgcatccgcctcggcttcaagatctcgcagtccatcccggcctacctgcatcagatcatgcacgatctggagaagaccggcgagctgccgaaccagcagtcgatctacccgaagcttgacgccgatcccggcatcggcaccatccgctacgtggtgatccacaaggcgctgatgcccgagtcgaaggtctccggccgtggcgccctctcgctgcagatcaagtacgcgatccgccgcgtggccggttccccggtcaagtggttcggcctggcgccgtacaacccgctggtcgaggtgcagccgctgttcgtgtccacgcgccgcccgccgcgcctgacccgcgtggccagccaggcgcccaagcgcgagggctgagccggcaggccgaacagccggtgcgagccgggtggcctaatggcatgtcagggggccgcgaaccgtcatcgtacggttcgcggcctttgcatatgcgaatgatgcagagtgggcggtactgcttgtgaatgtagcgggtggacgggtgacgtggttgatgccttttgccgtatgttcacggtggctatgcgtcggatgggactgtaattcgacttcttgggatcttttttgctgcagtggtgcgccaaaaggtctcagccgtctctgcgccacgccttccggcagtcagtacaaggttgtactacactggtggctgtcacacggatgtccccggtcgcccgcgcctccgcggtacatcgttgtatggatacgtgtcacgtatgcagagtgcatgcagatatgtagaaaggaatcccatgccccagcaggaccatctgaccgcacgtctcgtcgtcgatgacgattttgaggtcgctccggtcaacaatcgtctgttcggttcgttcgtcgagcaccttggccgttgcgtgtacaccggcatctacgagcccgaccacccgaccgccgacgagcacggcttccgcaaggacgtcatcgacctggtcaaggaactcggcgccaccaccatccgctacccgggcggcaacttcgtgtccggctaccgctgggaggacggcatcggccccaagcaggaacgtccccgtcgactcgatctggcctggcattccaccgaaaccaacgaattcggcctgcacgagatggccgaatggcttgaggccaccggcggcaacgagctgatggaggccgtcaacctgggcacgcgcggcctgcaggaggccctggacctgctggagtacgcgaacgtgcccggcggcaccgagctgtcggaacgtcgccgcgccaacggcgccgacaagccgttcgatatccgcatgtggtgcctgggcaacgagatggacggcccgtggcagctcggccacaagtccgccgaggactacggcatgctcgccgcctccgtggccgccggcatgcgccagatcgatccggacgtggaactggtggtgtgcggctcctccgcccatggcatgccgaccttcggcaagtgggagcagaccgttcttgagaagacctacgagaacgtgaacttcgtctcctgccacgcctactaccagccgttcttcaaggaggacggcacgcgcgacatggccagcttcctggcctccggcgtggatatggacggcttcatcaaggacgtggccgccaccatcgacgccaccaaggcccatctgaagagcgcgcacgacgtgtacatctcgttcgatgaatggaatgtctggtaccagggtgaggagccgagcaagacccccgagggcatcggcaactggccggtggccccgcgtctgctggaggacatctacaccgccgccgacgccgtggtgttcggcgatctgatgatcacgctgctcaagaacgccgaccgcgtgcgcgccgccagcctggcgcagctggtcaatgtcatcgccccgatcatgacggagccgggcggcccggcctggcgccagaccacgttccacccgttctccgtgaccgcgcgcctggccaagggcggcaccgtgctggagccgaagctgtccgccggcaccgtggatacgccgcgctatggcgaggtcgacggcgtgaacgccgtggccgtgcgctgcgccgacggctcgctcgccgtgtttgcggtgaaccgttcgctcgaggcgaccgccgagttcgagatcaggctgcaggacggcgcgcagccggcatccgtcgaggcgcagacgctgcacgacgacgatctgttcgccgcgaatacgctctacgaccagaaccgtgtgaccccgcacgccaacgggtcggccatgtacgatgccgagtccggcgtggtccgcgtctccctgccgccggtgagttggaccgccctgcacatcaagtgacgcgatgggccgcgcggtccgttccggagaaggacggatcgcacggcccttgcttcccgggccgggcggaagggaccggaccggccggggaaaacgcgttatgctggaatcagacgggcgttccgcctgaaccgtgcggaacatgcccgatggtgcgacgagaggggtgctgtggcgaaacgggtgaccatcaccgacgtggcgcgcgagacgggcgtctccatcaaaacggtgtcgaatgtgctgaacaacaccggcagtatgcgcccggagacgcgccagcgtgtccaggatgccatcgaacgcctcggataccgcgttaacgtgtccgcccgcgccatgaaaaccggcggcacgaagctcatcggactggccatcaccgatttctgccagccgttcatgccctatctcgccgacagcatcgtggcggcggcacgttcccgcgggtacgcggtgatcaccgatacctacaacagcgccggcggcttggcgcaggcgatcccggagacgaagaagctggccgcggacggctggattttcttcatgggctcgccgatcacggatcgcacgatactgcaccagccgtatccgttggtgattgtgggcgattacgatacgcagggactggccgattgggtcacgatgccgaacgtggaggccgtacgcaccgcggtgggggcgctgctggattcgggatgccgtaggatcgcgttgatcggcggcaccgcggagaacgcatgcccggatgccgaccgcgagtcgcggcccgaaaccaccagcacgatgcgtacccgcggctatgtgttggcccatgaggagcgtggcctgcaggtcgattggcggctggtccgtaacgcggattgggtgcagtccggcggccgcgatgcggtggcggggctgttggacgatccggatgcgccgcgtccggatgcggtcatgtgcctgaacgacgcgctcgccatcggggtgattcatgagctgcagcggcgcggcgtgcgcgtgccgcaggatatgcaggtcattgggttcgacaacgtgccggatgccgagtactgcatgcccggattgacgacgatcgacccgcatgtggatgattacgcgcgacatgccgtggatatgctgatcgcgcgcatcgaggggtcggcggatccgttccgcacgtatgtgacctcctacgatctggtgcgtcgtgcctcgacgtgttgacggcccggcgttcgcctggacatgggtctgtgacgggctgctgtcgcctctcccgtggcgtattccgggagaggcgacatgcgggctaggatcggagcagcacctccgtcagcgcttgacggacggcgctcggcatatgcgaatcggagcaatcttccatgtccggcccgctgacgtgctcgagtgaatccatcgtggccaatgcgtcgatgccgttctccgctatggcggcataagcctgttccttggtcagatatcgcatttcggcatgccgaaggatgtcgaagacgtcttccatgcggggatcggcggccatcgtcgtgtcgccgatggtgacacgtatctcgctgcgggtggatacgtcggcgaccgttacctgcaatgtgagggtttcggcatcataccggcgatccgaatcgacggatgcgccgtcggcctgtacggatatgtcgctgtcggtaatgcctcggaacaggaaatcccatgttctccgggccggcagagcgtgaacgtctccctgggctggcgataccgtgagtgcggatgtggcgccgtccttgcgccatcgataggtgatcgcggtggtcgccggggtgatctgccgagagtaatgtcccgaatcctccatcagcgtgaagtcgccgtccgctccggggaagacgatgatctccagatgctgcgggttgtcgacggagttgatggaatccccctcggacaggggctgcatcggcacgatgccgccggccttcgcgaacacgggaattccgtcgagcggacgccagacggtcatgcgccgtccgttgggcgaagacgcgctataccggcgcccggtgaagaagtcgaaccagtcgccctgcggcagccatacgtcggccttgccccgtcgggaggatttatccatcggttccgtgatgggcgcggccagcagttcggtgccgaacatgtattcgttgggaacgtggtatgcggcgtcgatgtcgggcgatccccaatacatgggctccaccaggggaaggcctgtccgggatgcgcgccagttcatggtgtggaggtacggaatcatgcgatggcgcaggcggggcgcatcgtccatgatcgcacggagggggtgcggatgtttttttggacggtcaggcggccagtccaagacttctgcggtattgcacggggctcatccagtccagtgacttcttgatcctggtttcattgtagtgggtcaggtaggcggccaggcgttcgcggaactcctcgtagcccacgcccctccagtcccgcccgtagaataactcgttcttgagcctgccgaagaacccctcggcggccgcgttgtccgggctgcatcccttggcgctcatcgaccggatcagcccgtgctcctcgcagatgcggatccattcgtcccaccggtagtggcagccgcggtcggaatggatgattggatgttccccgtccctgagcgtggcgaccgcgtcaaggagcatccggttcgccatgtcggcgttcggggagcgcgacaaggtccaggagaccaccatcccgtcgaagcagtcgaccaccggggaaagccagcacttgtacccgtccatggtgaactgggtgacgtccgtgacccacagcatgttcggcgcgtcggcgtggaagtcccgctccacgaggttcgccggggcctcgccgatctcgccggcgtaggagctccaccgcttcggccgcttcaggtacacgggccgcatggccccctcgcgcatgatccgcctgacgaccttctccgagacgacgatcgggtcggactcgtcaaggcgcagcatgcggtggatggtccggtatccccatgcgcgcccaccctgctcgaacaggccggcgacgcgggcccgcagcacggcgtacctgtcgcccgcggcgatcgcgccgcgctcgtaatagtaggtgctgcgtttcagccccacggccttcagacaggccgccaggccgaattcacccctgatcgcgtcgacgacccgcgtcctctccctgttcgtcagcatggacgggtcgaggcgcgggtcgtcggcttttaaaacatcgatcgtctcccgcatcaccgcgttctccagccgcaggacctccacctgccggcgcagctcctccacgtcatcgccggccgcgggcatcggttcggccggcatcggcgcgtttctcctgtccatcagtcccagtatcccctcgctccggtagcggcgcatccactggtacacgctcgtcggcgtgcaacccgcgtcgcgcgccacgcgggcgaggggctcgccctcgagcgcgcgtctggccgcattcgtcttgcattccagcgtatacgaacgcctgcacgcgcccgtgatctcgtcggcctccgcgtccagcatcgcgttcaacagctgttcgaccttctccgacaccaaccggtccagcttcgtctcgagcatgttctcgtcgacctgtagaatctgattcggcatggttccgtcgccttcctaaataggttgatttggtttggcgactgaaatcgtacccggacgacggaccatgtctctcaactcaagcctcaaccaaaatgcgcaacaaaccgggcgttatcaatcggacacattggagtcggacaggctaagctgcatagaacaccgcatctaatcggttcgacacgcgcatttcactgcgcgactggacattgacgtccctttcgaggtaatatcgaaccggttcgatacatacgtgagtatgcaaatacgtaaacaacaaacaggcagatgcgcacgcaaattgcacccgcgcccatgagccaagggaggtcccatgaaaaacaaagtgcaactcatcacatacgccgatcgtctcggcgatggcactcttagctcgatgaccgacatcctgcgcacccgcttcgacggcgtgtatgacggcgtgcatatcctgccgttcttcactccgttcgatggtgcggatgcaggcttcgacccgatcgaccataccaaagtcgacgaacgtctcggcagctgggacgacgtcgccgaactctccaagacccacaacatcatggtcgacgccatcgtcaaccacatgagttgggaatccaagcagttccaagatgtgcttgaaaaaggtgaggaatccgagtattacccgatgtttctgaccatgagctccgtgttcccgaacggcgccaccgaagaggacctggccggcatctaccgtccgcgtccgggcctgccgttcacccactacaagttcgccggcaagacgcgcttggtctgggtgagcttcaccccgcagcaggtggacatcgacactgattccgccaagggctgggaatacctcatgtcgattttcgaccagatggccgcctctcacgtcagctacatccgcctcgacgccgtcggctatggcgccaaggaagccagcaccagctgcttcatgactccgaagacgttcaagctcatctcccgcctacgcgaggaaggcgtcaagcgaggcctcgaaattctcattgaggtgcatagctactacaagaagcaggttgaaatcgcctccaaggtggaccgcgtctacgatttcgccctgccgccgctgcttctgcactcgctgttcaccggtcacgtcgaacccgtggcccactggaccgagatccgcccgaacaacgccgtcaccgtgctcgatacgcacgatggcatcggcgtgatcgacatcggctccgaccagctcgaccgctccctcaagggcctcgtgcccgacgaggacgtcgacaacctggtcaacaccatccatgccaacacccacggcgaatcccaggccgccaccggtgccgccgcgtccaacctcgacctctaccaggtcaactccacgtactactcggccctcggctgcaacgaccagcactacttggccgcccgcgccgtgcagttcttcctgccgggcgtgccgcaggtctactacgtgggcgcgctcgccggccgcaacgacatggaactgctgcgccgcaccaacaacggccgcgacatcaaccgccactactactccaccgccgaaatcgatgaaaacctcgaacgcccggtggtcaaggccctgaacgccctggccaagttccgcaacgaactgcctgcattcgatggcgagtccagctacgaggtcgatggcgacacgtccatcaccttccgctggaccgccgccgacggcacgtccacggccgccctcaccttcgagcccggacgcggcctcggcacagacaacaccaccccggttgccagccttgcctggagcgatgccgccggcgaccacgaaacccacgatctgctcgccaacccgccgattgccgatatcgactaaccgttggcccataaacgtcactccgctgtgcgcgctccaagtagtgcgcccggcgtaagctgggttcatggaaagcaaaccgcccgcagtgcactgaagccagtgcgctcgggcggttttgcgtatgcggggttgaaggtcgtgctcctgcgggcgcggcccaagcatcccgccggaatcgacgagacgagcagcagaacagagaaagagcagcatcatgttggaaccgtatgtgcgtccgggtattgatgatcgcccggatttggacaaggtcctaagtcccgaagacaaagccgccgtggccagactggccatcaagaatcgccgccgcccgcccgaagcctctgcggaccagcctgaggctcaggctgtgcgattggcttccgccagttcttcggcagccgctgctgcagccgccagtgtggacactcccgcgccggatatgtcgtccgcctacctcgacatgcgcgatcccatggtcgccgtcaatggccaacgccctaccgcaggtcaggtctcccgactcaactggggtttcttcgctgcttcaattctggtcggcgcaccttgggtggcgttgaacaccattgccatgcccaacgcgattgcgcgtacgttcggctatgacactgctgttgccggtcatatcgccatcaatccggccactggccgcccgttgcccgtcgccaccgaattggcgatgcccctggccgtgttggtgattgtcggcgtagtggcctccatgtttgcgatgccgctgatttcagtgttgtccgaccgcacacgcacgccattgggccgtcgtaccccgtggatggttggcggaggtctgctgtgcgcgctgatcacgctgattctggggcagaatatcggcatcattgtgctttgtattttctgggtgttcctacagttcgcctatgcgatgctttccgtgccgttgaccagcgccatcagcgaacgggtgcccgacaagttccgccctcgcatcgaacgctggcatggcatcggtgtgatgctcggccaagcgcttggcgtgtgcatgggtgcgcttggtgtgatgttcaattcgtttgcgccgtttagttacaccgccgtgctatttgcagtgtccggtattgccaccgtattgattctgcccaaggagccttctagcgctgagcagccgaaccagctttttgaccgcagtcaggtacttgaccaattgcgcccgccggcccacgctcccgagttctcccgggtgttcgccgcccgtacgtgcatgatggccggtgttgggctgaccggtgtgtttctgtggtatctcgtacgtttctgggtttatggcaaggccgtggtacttacgtccgcgccgctgaccattccggccggattcctcattgccggtatggctgtggccacattgatcggtgccgcgctcgcctcctgggccgccgggccgatttccgagcgaatcgaggaaaagaacattcccgtggcccgtgtggtggccggtgcctgcctgctgtatgccgctggtttggcgctcgcatggggccttggcgtctggtccaccggcactgcccgtgaaaacggcatgctgctgtttgcgttgatttccggattcgcctttggcgtctatgattcgctcggacttgaactggtgatggactctttgcccgacccgcgccgagccggccacgacctcggcatttatgcgctcgccaactcggccggtctggcgctcgccgccatcatcggcgcgctactggtgaacgccttcgagcatagcttcggctattacctgctcttcccgtccgccatcgtcatggtgctgctggccggaatcgtcaccctcaccaccaaatctgccgaataataaaccggttcgagtacactggtcagcagtgatccagtccagtactcgcaggggagcaaaaccatggtcggcatgcgcgacgtagccaaagcggcaggggtgtccttaagcaccgtttcgttggtggtcaacaacaccggctacgtctcggccgatatgcgtgccaaagtcgagtccgcgatgcgccagctcaactacattcccaacgagctggcccgcaacctctaccgaaaccgcaccaacaccatcggcgtgatcatgccgaccatcgcccacccgttcttctccacactcaccgcgcatctgcagcgcgagttcgccgcgcgcgacctcaaaaccctgctctgctccaccgccgatacagacaagggcgagagcgagtacatcgacatgctccagcggcacatgatggacggcatcatcatggcggcccacaccgagcatccggccgactactggacctccatccatcggccaattgtcgctttcgaccgcacgctcggtgagggtgtgccggtcgtccggtctgatcatgaacagggaggccgtctgattgctcgccagctcatcgattccggagcgcgccacgtggtgctcgtcggcggcccgcgctcccagttcgctgcggccaccacgttccccacgattcgctaccatctcaccgtcgagcgtctgctggccgatgccggcattgcctgcgattacgtggaagccggcgccgtggccgacatcgccgcccacgaagccaccgcatgcgccattttcgaacagtatcctgatgtcgacgccatcgtcggctccgatgtggtggcatccgtggcattgcaggaagcctcacgacggggtatcgaggtgcctgctgatctgcaagtcatcgcctatgacggcactctcatggccgaaaccgccggcaaacgcctgaccgcgattcgacaggacttcccggccatcgccgccgcgctcgccgtccgcatggactcacagatcgccgccgacggtggccccgcctctccggccaagaacgatagcgcttcggacgttgacacccaacccactcccgaagaagtcatccccgtagccctcatccccggcgaaaccacccggtgactcctatcttggctcccctctctgaggctgagctgtgaagcaaacagtccggtggactgtttgtaggcgaaggcgagccgggaggcgagcaggcagactgcgggcggtagcccgtctgtaattgcggccgagctggcggcgtaggcgactgaggggagccgagtcacggccgcccacagtcacccatctcacatgactcctacgtcacaatgtccacaatgtgaacccttgctggattggcaagacatacaaacctatgtttacattccagttcaggtcgaacggcctgaggaaataccgaaaggaggccacgcgatgactggattcaatgcttctgcgtttgtatccgcacgaattattagcccgtcttcgctggcggactaattcggcactgatgcttgaagccccgtcaacgaaggcagggccaatcaagctgacacaatcggcacggccctgcatgatgcggggctttttttgttgcgctcacaaggcttacggcagaatcccgcagacggaaacggtagcggacagtacacggcaacaacacagcgacagaacaacaacctccctgtggggcgaaataatcgcccgccgatgagagtgaacgagagcaaaacaggagtaacaatgactgcagcagtcgaagagactggcttagggcaggcggcaggtaaagccgctaccttggtacgcgattcggtcaagaccgtgatcgccgcgtcgatggtcggtaccgccatcgaattctatgacttctacgcctacggcaccgccgcggcaaactacttcccgcacatcttcttctccgcgaaggacaaccccaccgtcgcactgctgatgagcttgctgaccttcgccgtcgccttcatcgcccgcccgctgggctcgctgatcttcggccacttcggcgatcgcatgggccgcaagaccacgctggtcgtcagcctgatgaccatgggtgtcggcaccttcctgattggctgcctgcccacctacgatcaggtcggcgttggtgcagtcgccatcctctgcctgctgcgtttcatccagggcatcggcctgggcggcgaatggtccggcgcggcactggtcgccaccgagaacgcgcctgaagacaagcgcgcactgtacggctccttcccggagctcggcgccccgatcggcttcttcctgtccaacggcacctacttcgtgctcgaatccttcaacaatcaggacgcgatgctggcttggggctggcgtgtgccgttcctgctgtccgccatcctggtgatcgtcggtctcgtggtccgcgttcacatggaggagaccccgatcttccgtatggctcaggagcagaagaaggttgtcaagtccccgctgaccgaggtcttccgcaagtcttggcgtcaggtgctgcaggccaccttccttgtggctgtgacctacacgctgttctacacgctcgccacctggtccctcgcttggggcaccaaggagcagggcgaaggcggcggcaaccttggcttcaccaaccaggaatacctgctcatgctcatgatctccatctgcgtgttcgccctgttcatcgtgctgtcctgcctgtacgcggacaagatcggccgccgtcgcgtgctgaccttctcctcctgcgcacttgtggtgttcgccgtactcttcccgttcctgctggacggtggtctggtcggccagaagaacttcttcgccaacatggtgttcctgtgcgtcggctttgccctgatgggcatcgccttcggcccgatcggcgccttcctgcctgagctgttcgacgccaacgtgcgttactccggctccggcatcggctacaacctggccgccatcgtcggcgcggctttcgtgccgaccatcgccacttggctgagctcccactggggcgtccactccgtgggcctctaccttgccgtgatggccgtgtgctgcctcgtctccgtgctcacctgcaaggagactaaggacgttgactttaccaagtgacgatgttcacaacgtgaaaacccctaattccactaagtgaacccctacagggcttttccgatgcgacgggactaaacctgcatatcggaaaagcccacaaggaaagccacaacagaatatcgctcagcgaaaccccgcagaacgcaagaaaaattcaaccccataaataaacaaataaataaaaggagcgccaaaaatggcagcaactatctggtacgagaaggacgccgatctgtccgtgttcgatggcaagaaggtggctatcctgggctacggttctcagggtcacgcccacgcgctgaacctgcgtgactccggtgtcgacgtggtcgtcggcctgcgtcctacctccaagtccgtggagttcgccaaggagcagggccttgaggtcaaaccggttggtgaggccgtcgctgaggctgacgttgtgatgattcttctgcctgaccagtaccaggcagccgtctacaagaaggacgttgagccgaacctgaagccgggcgccgcgctggccttcgcccacggcttcaacatccactacggctacatcaagccgtccgaggatcacccggtgttcatggtcgctccgaagggcccgggccacatcgttcgtcgtgagtacgccgctggccgtggcgtcccggtcgtcgttgccgttgagcaggacccggacggcaagacctggccgctgtgcctggcttacgccaaggctctgggcgctctgcgtgcgggtgccatcaagaccaccttcaccgaggagaccgagaccgatctgttcggtgagcaggacgtcctcatgggtggcatcaaccacctgtgcgacctcggtttcgacgtgctgaccgaggctggctaccagccggagatcgcctacttcgaggtgttccacgagctgaagatgctggtcgacctggctaacgagggtggtctgaacaaggctcgctggtcctgctccgacaccgctcagtacggcgactacacctccacggtcatcaccgaggagaccaagaagcgcatgcagtaccagctcaagcgcattcaggacggctccttcgccaaggagttcatggatgatcaggctgctggcgccccgaagttcaagaagctgcaggaagagtactctcacccgcatctcgagaccgtcggcccgaagctgcgcgccatgttctcctggaacaacgccgaggccaaggacaaggacgaggccgagtccttcaacggcaagatcgctcgtacccaggttcagtgattgccgcccctgaaggggatttaagctagcaaaccgccgttcccgcccatacgggagcggcggttttgtgttgttgcgcgcagcgaatcattctcaataacaactatgcgctgatttcttgcaggcaaacgaacaccgaatatgcaagatcgttgatatctcagcctttccccatatgtgggattgtgcgattctgttcaaaagggtgcagagttgttatcgagaatcgttctctgcacacggctgtccatactccaatagtgacctagctcacgttgtggactccagcggggctgcgacggcgttctcggtaggattgaactcggtttgaaggacacaatcctcgcaaaacaggacttatctgcacaccgtagatacccccggcgcccagcggcgccacaacccactactgaaaaggagtgccaataatggcagcacagatctggtatgagaacgacggtgatctctctgttctcgaaggcaagaaggtcgcaatcatcggctacggttcccagggccacgcccacgcgctgaaccttcgcgattccggtgtcgacgtggtcgtcggcctgcgtccgacctccaagtcggtcgacttcgccaaggagcagggcctcgaggtcaagtccgtggccgaggcttccgccgaggccgacgtgatcatgattctggcccccgaccagtaccagcgcaccatctgggccaacgacatcgagcccaacatcaagccgggtgctgctgttgcgttcgctcatggcttcaacattcattacggctacatcaagccgtctgaggatcacccggtgttcatggttgccccgaagggcccgggccacatcgttcgtcgtgagtacgccgctggccgtggcgtgccggtcgtcgtggccgtcgagcaggatccgcgtggcgacggttgggctctgaccctggcctacgccaaggccctcggtgccctgcgcgccggtgccatcaagaccaccttcaaggaagagaccgagaccgatctcttcggcgagcagaacgtgctcatgggtggcgtgaacaagctcgtcgagatgggcttcgaagtcctgaccgacgccggctaccagccggaaatcgcctacttcgaggtctgccacgagctcaagatgctcgtcgacctgatgaacgagggcggtctgaacaaggctcgttggtcctgctctgacaccgctcagtacggcgactacgtcaacaccgtcatcaacgaggactgccgcaagcgcatggaataccacctgcagcgcatccaggacggctccttcgccaaggagttcatcgacgatcaggatgccggcgccccgcacttcaaggagctgcaggagaagtactccaacgagcgcatcgagaccgtcggcccgaagctgcgcgccatgttctcctggaacaaggatggcgtcaaggatgccgacgaggccaactccttcaccggcaagatcgcccgcgctcaggttcagtgagcccctgtagctcccgctggcgcataagcgcctgaggggagtacccagcacgtaccaaaaggccgccgctccgattcattcggaacggcggccttctagtatggtcccaccatatagtcaaacctccaccacgtagtaaaatccccacgacgtagcaaactacccaccacgtggtgacgcaaaacggctttattccgcggaatacaaaattacgctgacatcgtggtagaagattcatcgcgtggtgggcagttcatcgcgtggtgggatagacagttgatatacgccggctatcaaatcaatgatgtcttgctgtgttccccgtatgccgagctgctttatcggaagcgtttcatgggatattttcccaagaaaatcagcgagatcatggtaggcctcgtcgttgagagacacgcgatcctctggagcaagtagttgagccaaacggaatacatcatatttatgcttcttgagatcttttccgtctacgtgctcgccatgttgttctcgggcgttgagatccaaccatgctttcgccttgaaaggaatgagatatttctcgttaagcacgctgatgccttgtattgattcgcggccttgctgcagtagccgatagtagctgtcgttcagcatgatggctgacaggctggaaacgtcgtttgcaatatgcaatggcgtcaggaacgagttcggcacaatagggaagtcagggtgacgtgaaaatagctcgatcatagtgggatacccgtacgtactggggtgcatgaaacggtacaggtgaggctgtgcggagttcttcgtgatagaggtgtatccgccatcgcgaatgaaagaccacaatcgttgtgcaaactcgcgaagatgtccctcggcaatcagcaccatgtcaatatctttggtggctcggaagtccagttcgttgtcggtcatgatgatgtcacaagcggtgccgccgatgattacgtaagaatcttcgtagccggcaaaggccgttctgatgagctgcaggccttgtgtcatattgtcgctcctgagaaagtattgcggatggattcttgtatggcgtcttccaaacgttcgtcggcaatctcgccaagagtcagggccgtggaaatggggtcggcaaggtagtcttcctgcgtatattgagcaagtaggcggggatcgtacctccacagctccagaatatatgcattatctggcaccttttccaaagcggggtcgataatgcatagttccttgttgtgctgcttgagccaatgacgttcaacggcatagattcgcagttttggggtggccagttgcgtcctgtgcgaaagagcaaattcgccggccggaatcagctcgtcggcaatcatctggcgattgcgattcgtgacggtatatttgctgaatattggtgacttcaggagatgccaagatgatttcagtaaatcaagtcggctggtctgccttgaagtcagtagttcgacgctattgctgcggccttgcttggtgcggtgcacgaatgccagctgttctaacagcgtcacggcaacgctgacctgagcttcggtaaactgaagcgctcgggcaatatctgattggactttgctctcgttggagtagagcaaatacagccagaccagctgtgttgcgggggagaagggtcgcacctcgatatcctgtgcgttctccagcggccgtgaggagatgcgctgggtgaacaccatgcccagtgaagggatatacagttgggtaccgggcacgatgaaaggaacgtgattctgaatcagggcttttcgctggtatgcagaaagccggggaaactgaaagacaatgggcagatccgtccgctgctcaagcctgctggcgtcggcggtgacgcgtgtgatgctgaatgggtgagcctctccgctcgcgattagcatgctcgtgttgtcgatggtgagtttgctgaatgtccgtccgttggtcagaaatagcggcagtgaggcagtgccattccaagaagtgatttggcagggcagaccaagtgtctcgcgaatgtaatgctcggcatccatgtcgacctcaatccttaacgaaaatctgtaagattcacatctcttgttaagtatatagaatattattaagtatttcggggttggcatgtcgcgaatggaaagaaagggcagtcatccccgaaatggagacagcttagccgggaaaaaggacgacgccagcatccggagaagatggatgactggcgtcgggtaagctcgcaaaagctctactgaacaacccacgcagaagtgtcggtggggagctggccttcgggggtcagcgggccggacgccagcaccacggagccatcgggcagcgcgatcggagcattgccgaagttggtgattgaggtgaacacccgcccgccaaccgccgcgcgggtgtacgccaccacatcgtcgcccatatccacctgctcggcggtggtgtcgcgcgtggcggtcagcgactcctgacgaatcgccaacgccgcatgatacaacgtgtacatcgaatccgggtcggcctgctccacgtccaccgcgtaatccttgaaccacagcggctgcggcaggtgcgggtcggcggccggcgtcacgccatcggcgcgaaccgcaggggagaagccgaaggaagcgcccgtgccgaactggccggcggcgcacagcggcacatggttctcgccggtgccatcgtcggccggagccggacggctgaaatcggccagagcgggctcgtcggaagcggtccaaggcagaggcacgcggcaaccgtcacggcccttatccatcgtggcctgagcggtgtggaaagcggtcggatcctccagtcgatcccacggaatatcggccacctcaaacagacccagctcctcgccctgataaatataggcggcgccgggcagaccaagctccatcagcgcggcggcacgggcacggcgggtgccgagctcgcggtcttcgggatatgtggtgccgttgcgcagcagccagtcgtgcggcagctggtggtagggcgcgcccttgacctgcggcagaccgtagcgggaggggctgcgcggcacgtcgtgattgttcatgacccacgtggtggtggagccgccggtttcggccgccgccttaagacccgcggcgatggccttgcggaactcgtcggcataccagttggcctgcgcgaagtcgaagttgaaggactggcccagctcgtccatcgaagcgtacaggtgctggtgctcaggcaccacccacgcctcggccacggcaaagcgcggcgggttgtattcgttgaacaccttgcgccactcgcggtagatgtcgtgcacctcacgacggtcgaacagcgggtggctgaagtcatgattcagcacgccgaccacgctgtattcgcggccgagctcttccaacggcttggattcgagatccttggccaggccgtgcgccacgtcgatgcggaagccgtcggtgccgtggtcggaccagaaacgtagggtcttcttgaactcctcgtggatgtccggattcttccagttgacgtccggctgcgccttatcgaacaggtgcagataccactggccgtcggccacgcgcgcccaggccgggccgccgaagaaggattgccagtcgttgggcggcagttcgccgtgctcgccgcggccgtcgcggaagatgtagcggtcgcgcgccggggagccgggctcggcggcgagggcctcttggaagaacacgtgcttgtcggcggtgtggttgggcacgatgtccacgatcactttgatgccggcctcgtgcgcggcctcggccatcgcgtcgaagtcgtccatggtgcctaggcgcgggtcgacgttgcggtagtcgatcacgtcgtagccgccgtccgccagatccgaggggtagaacggggagagccagatcgcgtcgacgccgaggttcttcaggtaatccatcttctcggtgacgccggcgatgtcgccgagtccgtcgccgttgacgtccttgaagctgcgcgggtagatctggtagacgacggcctgcttccaccagtcgtcattgaggttgttggcggtcatgccgattccttcctgttccgggtgcgttgtggttgggttgttccggttgtgctcgaactgctgtgtgaaggcccaaccgttgtattgatgatgacaacgatatcatgtgaattacgcatgcaaaagtcgatttatcggcgttttgcgatggtaacgtagtcacgcctgcgcggacgctgctgttgcggcaggcggcgcggtggtttcgcgcagtattagcggagtgtccggccgtacgaatgccggttcgattgacttgcccgcaatggcatccaataccatgtgcccggcggccacgcccattgcgaacgggtcctgatgcagtgtggtcagtcccacggcggcggacagggtggaatcgtcgaagccgatgatggagatgtcctgaggtacccgccgcccgtattgacgcaggcgatacagcacgggtgcggccatttcatcatcctcaaaacagaaggcggtgatgctgggggaggcgttcagtacggcgttcaatgccgcgttgctttcgccaagaccgcgttgaatgctcaggggcgttagctcgatccccggatgggcggcagcggcatcaatgacgccctgcaaacgagcctcggcactgtagcgcatgttggtttcggtcggggcgctgccgacgaacgcgatatgccggtggccgagtgcaatcaggtgctcgatggccgaacgtgtggcggcgtaatcgtcaatgctcacgcctgcgtcgaacccatcggtggagggaatgttgatgccgacaatcggcacgtgcatatgcttcagtcgctccacttcagccggctcaatgtcgaaggagctgacaatcaccgcatccgcattgcgtcgcacgggcaaatccgcaaagaagtcatggcgctcggcggcgttgcgcatggggtagggcacagtgtcgtagccggaggggcgcagcgccgagtcaaggccggcgaagatgtttgcattgaaccaggtggtgatggtctcgctggccagcagcgcaatgcggaacgactggccggacttcagtgcggcggccgagcgagagacggagtagtcgagcttttcggccgcggtcatcactcggtctcgagtctctggaagcactagatccggcttggcgaaggttcgggacaccgtggatacggaaacgccggcctcgcgggccactgcctgaatgcttgccttggtcatatgccgtcgctcctttaccgtcgcgaacaatcattgtcatgacaacgataacatgcccataacaagtcgccgtcttcggctatctcgattacgaggggctgatttagggtgtcccggacatctacttccgtttcaaggggctccttgccggtgaaaccacaagtgcaaacgactttgtgccaacgtcattccgccgttctcgcgctgggtctacttgggcaccagccccttgaagcggaagtggatgtccgggaaaggccaaatcagcccctcgaagccgatttagaccaatttcccattgcggaatcgatcaccgcttctctcggcgcatcacggcggctagggactgcacgcgtggcaggtcgaagacctcgtcggtatgtaccacgtggcctgagctgtccgccagcggcacgcgccagttcgaatactctctggaagtgcccggctgattctgggagcggcattcgcccacgccgtccaccagcgctgcctgcagcagcagcgacggcgtatcggtgagcatggcgtgcatcgcttccacgatttcctgcacatggccttccacatcatccgccacggtctgcgagatatagccgttctccaccagacggttcatcatggccgtgcgctcggccatcgccgaggcggcgaatgcctccaccggctcgctcaggagatgcagctcctcgcgcagcttgacgtgtgcgaagttcaggtagccggcggtgggtggcagatcgtgcgtggtcaccgaggccaatgcctgtttgcgatagtccttgggtgcgcggtacgggtcgccggcgttcggcgaatcgtccacgcggttgaaccattccacgtcagtgccgagcacgccgtgatcggccagaatgcggcgcacgtaatccggtacggtgcccagatcctcgccaaccaccatgcctccggcgcgcgtggcctcgatggccagtactcccaacatcgcctcgtggttgtacgtcacgtatgcgccgttgcgggcaccgagcccctgcggaatccaccacaggcggaacaagcccagcacatggtcgatgcgcaccgcgcccgcgtgctcgtacatcgaatgcaccatctcgcggtacacctggtagccggtggcctccaggtagcgcgggttgaacggtggctggccccaatcctggccctgctggttatagaagtccggcgggcagccgaccgtgacgccacctgaggcgaagcgttccggattggcccaggcatccgcgccgagcccgtgcacgcccacggccatgtcctgcatcagccccagcgtcatgccgtggtccagcgcctcctgctgcgcggcgttcacctgctcggcagcgatccactgcagccagcggttgaactcgaacaggtcgtggtgctcctcgacgagctggcgcacggccgggtcgtcgatggtcttctcgaagaaccaacggttctcgccccacggcgcgccccatacctcgaagcacaggcaccatgtggcgaaggaatcgaggtccgggccggcggtggtcttgaaatgctcgaattcgagctcgcgcttgttgttgcggcccgcttcgaagatcaggcgcagcgccgggcgcttggcctcccacgccgcgttgatgtccatcggggtcgattcgtcgttgcgcgcggccaccgaatcatgcagcgcatccacctgcgcgcgcacgtcggccggcagtgtggcatattcggggatatcctgcggccggatgtacgtcacgttgaggaatcggcgcgattccggtagatacggcgatggctcaagcggcggaatcggcgcgccggcgtgaatcggattgatgagcatgaagtcggccttggacttctcggcggcatctgccaaaagacgcttcagatcgccgtaatcgccgatgccccacgattcgcgggaccgcacggaatacatctgcgtcatccagccccaccgctggtgctcggcgaccgcctccggcacgggaatgcgcgcgggggcggcgatgatggccgccttgccctcgcgcccgtcaaccgtgacggtcagcgtgtggtaacccatcggcaggtcgggtgcgatggtcaagtccggcttgccggaattgaggttcggcagcagggcaaagtggccaaacgcggtgccgtcctccagttcgatggaggcggtgatgtccgcgtccgacgagcagttcagggtgatgccggtcggtttgccggtggtggcgacgatggtggaggggagcaaacgtttgctgttttccacctcaagttgggtcatggagcgtacgatggcctcgtcgctggatgcgtccacgtcgagggccttgagtacggcgaccaaggccgcgtcgctgatttcggtgtaggtgccgagctggtcgatgaatgaggtggcaagtccgcaggctttggcgagcttgatgagcgggcgggcgagtcgttccgtgctttccgcgcgctgcggggcaccggaagcggcgtcgttggtggtgtctgcgatggtgccggtgctggtcgctgcgtcgttgctgtacgcgtcggtcatgatgactccttgcttgcaaattgggtactgctagtcgtttgcattgctgttcgagggccgctctgcgttgaggttccggcaatctgacagaccaatgttcgagctgttctgtctttaccgtaactcatattgacaacgattgcaatacattcggtgagttggacgaggctagaggtgttggtgtttgtcgtgatggcccgttgactatccccagtcgactttgccgacagcctcgccggcggaggtgaggtcgaacgggtttaaccaaacacgacgaacgattgcggggagagcgtcagctgcccgccgctcacggccggttcaccaagactgagcagcacgtcggcgtcggaagagagctcgtccggcaggtattccgtgaggaatgaggcgattgaggcacctgaatcggcgttgaaataactggaatcgccttcgtgctccataggcgtgtcggtattgcgcagcaacaggttgtagccgttcgggtggccgtcccggcgccagtcgaggtagaggtccatgtcgaagccggcctgcatcgattcgttcggatggcctggacgccatcggcggaccgacctgggtggattccgataaggcggccgtatgggtgaccaactgggacaccgagcgcaacggctcctcgctcaccacccgtgacggcaccagctacctgctcgccaacgccttcatgctcgcctacgattacggccagccgcacatcttctccggctactactacgccggcgtcgacgacggcgctcccggcgccacccgcacctccgtgccggacatgacctgtccgaccgacggcatcgaaaccgccggcacctggcactgcgcgcaacgctggaccgccatccgcggcatgatcggcttccgcaacgccgtggccggcaccttcaccggcaccgtggccaagggctcggccgtcgccctatacgccggcgcgacgcccgcaaactgggccggcacccggaaatacgatccgtccgatcccgcctggttcaccggcgaaacaccgcataagggcgatgacaccgccgccaagtccgccgattccgcagcgtccgccaagtcaggcgacgccaagtccggaaaggcaacgtccgatgccatccgccgcgccgcaacgctcgccgccatcctcctgcccgtcatcgtcggcgtcacgttcatggcgatagctcgcaggaacggcaaagcccagtccgacaacagcggcccgaataacgactgattcggccccgctcagccgcgcacccgcggcgcggcggtggagtcgcgtaccagcagttgcacggggaagatctcgtgcggctggtccagggtgcgcccctcgataaggtccagggccttgcgcgcggcggcgacggccatgtcgtacggcttctggcgcacggtggtcagccccacctcgcccgagaacgtgctgttgtcgaatccggtgacggacaggtcggtcggaatcgccatgccgcattggcgcaggcggaagaacagcggaatcgccagcgaatcctgatggaagcacagggcagtcggggcgtcgtcgcgcgcgagcagcgcggtgagggcggcgtcgaccggatcgtcgccggcctgcatgtccatcgtctggccggtcacgccgtccagttcgctgcacgcctccaggaatccggtgacgcggttgtgcgagctgaagcccatcgttgcatcgaacgtctcgtacaaatacaacaggttgcggtggccgagcgtggtcagatggcgcacgatcagccggatgccggccttgtcgtcgatgcccacggaggcggtgaacccctgcgaggccgtgttgatgccgatgagcgggatccgcgtggtgttgagtcgcctgatttcggccggggtgatggcgaacgacgagacgatgaccgcgtccgcgttgccgcgcaccggcagttcgtcgaagaactcctcgcgcgcgcccgcgtcgccgatcggttggatgaccagatcgtagccggccgatcgcagcacttcgttgaggccttcgatgatgcgcgaggtgaaccagtcgagcttgctgctgcccaccagcagcgccacgcggtgggagcggcccgatttgaggatgccggccatgcgggataccgagaagtcgagttgttgggcggcctccatcaccttggcgcgcgttttggcggagaccatgtcagggcgggagaacgcgcgggagaccgtggcggtggagacgcctgcttgcctggcgacgtcctcgatgctggctttcatggcccctcccggtttttcaaagttgacggtgtgacaaacttctcttcattgtaaatcattgcagtacgttttacgacagtcatagtgcaatgggttgcgatattgcgacacgccgaaaatatagaccaatatggtctcaatagctttggaatgtaacaggttgcaaatgtaacggtttgcatggctgagaaagccgggttgccgaactagttcgacgcccgtatactgaaccgtgttcacttagagcttgcgaggaagtaagggagataatgaagatcaagaaatctctcgccgcgctgactgcaaccgtgagcattatggcacttgcaaccggttgcagttcgagcggttcgtcaggcgtcgtcgacacccaggccgacaagggcctggccgtcatgggcgacaccatcacctacgaccccaaccacttggtcaacgacggccagcccatcgaactgggctactggtcctggggcgacgaaagcactgacccggtgatctccatgctccacgagtacgagaagatccacccgaacgtcaccttcaagatctcgcaggtggcttggagcgactactgggtcaagaccccgctctcgctcaagggcaacaagaacgcccccgtgctgttcaacgtccacaactccgaggatgccctgctccgcccgcacgccgtccgcctcgacggcgccagcgactggcgcatcttccaccaggtggtgctgccgatgagccgcaattccatcgccgcgctcgccatcttcaccttcctgtggaactgggaggactacctctggccgttcctcatgatcaccgatgacgacaagcagctgttgtcggtgggcctcaagatgttctccggccagtacggcaccgattacggcggactgttcgccgccacctccgtgaccatcatcccggtggtcatcgtctacctggtgttccagaagcagttcatcgccggcatcgccaccggctctggcaagtaaacccggccggtttcggccgaatccgaaccgcgccgcagtctcccaccagtcccggggagccgcggccgcatcactcgtatcatcgtgaataaccgtacagaaggggtaaccatggcacagtcaccacaactcaagcagtcgtctccgacctcgcccgatccgcaggacttccgcctcgacgccacgccggccatgcgcgccgacaatgtggtgtccggcgagcactggcgcatcggactcatcaccgattcgctcgtgcgattcgaatggtccgattccggcgtattcgagaaccgcccgacccagaccgtcctgaaccgcgatttcggtagcccagtcgaacgccgcgtcaccgagcgtgacggccgcgtcatcatcgacaccgcggccctgaccatcgtctacgaccagcagccgttcagcaaggaaggcctgagcgtggtcgtcaaaggcgtggccgacacccagttcaacacctggcattacggcgacgcccagcgcggcaacctcaaaggcaccgcccgcacgctggacgaggcggacggcgccatcgagcttgacaacggcgtgatctcgcgcgatggctgggccgtcatcgacgattccgccgccaacatcatcatcgaaaccgacacggtgaacggcaaggcgaacccgttcggcacctgggtatccccgcgcgccaccgccgaaacggacttgtacttcttcggctatggccaccgctacatcgaggccgtacgcgacttctatcgcctgaccggccccacgccgctcctgccgcgcttcgccatgggcaactggtggagccgctactaccggtacacgcaggacggctatctggccctgatggaccgcttcaagcgcgagggcatcccgttcaccacctccgtgatcgacatggactggcatcgcgtggacgacgtggacccgaagtacggttccggctggaccggctactcgtggaatcgcgaactgttccccgacccgccggccttcctcgccgacctgcaccggcgcggcctgcgcaccacactgaacgtccacccgcgcgacggcgtgcgcgcgttcgaggacgcctaccccgaagtcgccaagcgcgtcggcatcgacccggccaccgaggagaacgtggaattcgacctcaccaacccggacttcgtggacgcctatttcgacatgcaccaccgcatggaggccgaaggtgtcgacttctggtggctggactggcagcagggcggcgtgacccgccagaagggtctcgacccgctgtggatgctcaaccacatgcactacctcgactcagggcgcggtggcaactggccgctcaccttctcccggtacgccggccccggctcccaccgctacccggtcggcttctccggagacacgatcgtgacctgggaatcgctcgccttccagccgcagttcaccgccaccgcttccaacatcgggtatggctggtggagccacgacatcggcggccacatgttcggctaccgcaacgaagagctggaggcccgctggtaccagctcggcgcgttcagcccgatcaaccgactgcattcgtccaactcgccgttctccggcaaggagccgtggaacttcaaccgtgacgtgagcgccgcgatggtggacgcgctgcgtctgcgccacgcgatgatgccgtacttgtacaccatgaactaccgtgccgccgaagccggccgtccgctggtcgagccgatgtactggcagaacccggatacgccggacgcctacgaggtgccggatgagttccgcttcggcaccgagctcgtggtcgcgccgatcgtctccccggacgatgccgccgcctgccgcggccgcgccgacgcctggctgccgcagggggagtggttcgacttcttcgacggccgccgatacgtctcatccgacgccgctggccgccgactggaggtctggcgctcgctcgaccgcacgccggtgttcgccaaggccggcgcgattgtgccgttgcaggacgtcgcggaatccggcgaagcgatcaactctatcgccaacccgcaggccctgcgcgtgctggtgttccctggtgccgacggctcgttcgtcatgcgcgaggatcgcggcacgtggggcgcccccagcgccgacaccgcgatagcgttcacgtggggcggggccgatgcgtcgcccagcgccttcaccgtcgcgccggttaccggcgatacgtccgccgtacccgagttgcgcgactggacggtcgtgttccgcggcgtcgcgccggttgacgcggccagcggcgtgcgtgcatggtccggcgaggctccggtcgaggcgacggtggcgtacgacgaggcgaccatgagcctgaccgtgtccgtcaccggcatcagctcggctgccagtctgcgcatcgagattcccggcggtctgcgcatcgccgacaatccggtcgaatcggacgcgatggacctactgctgcacgcccagatgctctaccgcaccaaggagctcgcgctgcaggcggtccacaagctcggcatcggcgcgatcggcgccctgcgcaccatgaaccgtggtccgcgctacgccaacgatttctggatcaccgacatgcccgatgcggtggccggcgcgctcgaagaaattttgctgcgcagctgagcccggttgcagttttctgcaacatccgggtgcgccccggtatgcggcgataagttcggcatggttgccgaagggcgtggcataccgggtgcagtgcgtgggatggccttcgcgattgcactcatcgtgcggtcagtggaaaggaacttttcatgcacaaggtgaaacagcacaagggcgtcgcggtggccgccgcggtctgcgcggtcgcgatggcggcctcgctcgcgacccacgccggcgcggccggggaccggcgttattgactggctggcgttatcgagtgattggcggtatcaattagccggcgttattgatgagccggtgttgtcgattagccagcgttatcgaccggcactgaagcatgcagtacccactgcctgcgtttctcccgcacatcccaatccccgtgcgcatgcagcacacgctcccgatagtacgcaagcccggaatgccgccccctcaaacgtcgcgtcaccttgacgcggacggtccgtcacatcaatggtgacgcggtcctgagcggcggaaaccagcaccacgtaacgctgcgtcgaatcggcatacctggcgatattgccaaacaattcccgcagaaaatcggcgacaaacactgtgtctgagttattcagcgcatcgatgcccccagcgacaataacgtcgccgacacaccccatgcgccgcaatcgcgcgccgccgctggcaagtctgatggcaaggctgatggcgcgccccagtcaccccttgcagttttctgtataagtggattttggctccaaacgcaccactccgtcatcgccgtcagtcactcccacaaaaaacttgagccaaacatactcaactttttgtgttgaaattgggaatagaacttgccaaatggaagttgagtgatgtaggctcaagtttggaaggtccaagagacgaccaatcggaacttgggcaaagaacgtaagaacaaacgagtaattaaggagcacacattatggcacgtgcagttggtatcgatctgggaaccacgaattcctgcatcgcaactcttgaaggtggcgagcccaccgttatcgtcaacgctgaaggcgcgcgcaccacgccgtctgtggtggccttctccaagtccggcgagatcctcgtcggcgaagtggccaagcgtcaggccgtgaccaacgttgaccgcactatttcttccgtcaagcgccacatgggctccgactggaccgtcgacatcgacggcaagaagtggaccccgcaggagatttccgcgcagatcctgatgaagctgaagagggatgctgaggcctacctcggcgagcccgtcaccgacgccgtcatcacctgcccggcatacttcaacgatgcccagcgtcaggccaccaaggacgccggcaagatcgccggcctgaacgtcctgcgtatcatcaacgagccgaccgcagccgctctggcctacggccttgagaagggcaaggaagacgagcgcatcctggtcttcgacctcggcggcggcaccttcgatgtctccctgctggagattggcaaggatgacgacggcttctccaccattcaggttcaggccaccaacggcgacaaccacctcggtggtgacgactgggatcagaagatcatcgattggctggtttccgaagtcaagaacaagtacggcgtcgacctgtccaaggacaagatcgcgctgcagcgtctgaaggaagccgctgagcaggcgaagaaggagctctcctcctccacctccaccagcatctccatgcagtacctggccatgacccctgacggcaccccggtgcacctggatgagactctgacccgtgcgcacttcgaggaaatgacctccgacctgctgggtcgctgccgcacgccgttcaacaacgtgctgcacgacgccggcatctccgtgagcgacatcgaccacgtggtgctcgtcggtggttccactcgtatgcccgccgtcaaggaactcgtcaaggagctcaccggtggtaaggaagcgaaccagtccgtgaacccggatgaggttgtggctgtcggtgccgccgtgcagtccggcgtcatcaagggcgaccgtaaggacgtcctgcttatcgacgtgaccccgctgtccctcggtatcgagaccaagggtggcatcatgaccaagctcatcgatcgcaacaccgccatcccgaccaagcgctccgaggtcttctccaccgctgaagacaaccagccgtccgtgctgattcaggtctaccagggtgagcgtgagttcgctcgcgacaacaagccgctgggcaccttcgagctgaccggcatcgctccggctccgcgtggcgtcccgcagatcgaggtcaccttcgacatcgacgccaacggcatcgtgcacgtgtccgctaaggacaagggcaccggcaaggagcagtccatgaccatcaccggtggttccggcctgccgaaggacgagatcgaccgcatggtcaaggaagccgaagctcatgaggctgaggacaagaagcgcaaggaagacgccgagacccgcaaccaggccgaggccttcgcctactccaccgagaagctcgtcaacgacaacaaggacaagctctccgacgacatcgtcaaggaagtcaccgacaaggtcaacgctctgaaggaagccctgaagggtgacgacaccgagaaggtcaagaccgctcagaccgagctgatgaccgccgcccagaagatcggccaggtcctctacgcccagcagggtgccgagggtgctgccgctggtgctgacggtgccggcgcttccgctggctccgcctccggttccgacgacgacaccgtcgaggccgaggtcgtggacgacgatgacgacaaggacaacaagtgatgtccgagttcaacaaggacgactacctgaacgacctgccggatccctcagatgctgaggctgccgctcaggcctcttcaggggctgacgcctccgccgagtccggctctgcgcaggattcggctgcccaggctccttccaatgaaggagccgacgcggctcctgccgcagctgagggagagaagactggcgaaggccagtccgattccgcagacaccctcaccccgctcggcaaggccaagaaggaagccgcagactacctcgaagccctgcaacgcgaacgtgcggagttcatcaactaccgcaatcgcacgcagaaggagcaggagcgcttccgccagcacggcatcatcgacgtgctgaccgcgctgctgcccgccctcgacgatatcgaccgcattcgcgaacacagcgagatggacgactcgttcaaggccgtcgccaccaagattgacaaggccttcgagaagttcggtgtcgagaagttcggcgaaaagggcgaggacttcgaccccaccaagcatgacgcgatcctgcacaagccggacgcggatgccgaaaaggaaacggttgacaccgtggtcgaggccggctaccgcatcggcgatcgcgtaatccgcgccgcccgagtagtagtagcctccccgcaaaactgacggtcagctcgctgcaatgagttgatatttaccttggctcccctctctgaggggagccaatcataaagacttttctagaaaggagacatgaatggctgaaaacgaatggctcagcaaagacttctacaaagtccttggtgtctccaaggacgcttcggacgacgacatcaagaaggcgtaccgcaagctcgcccgcaaataccatcctgacgtcaacaagaccaaggaagccgaggagaagttcaaggacatctccgaagcctatgacgtgctgagcaagaaggaagatcgccagaagtacgacgcgattcgtcagttcggcatgggcggtgcccgcttcgccggcggttccggcggcttcgatgcttccggtttctccgacatctttggttccatgttcggccagggtgccggcggcaatggctcgcgcatccgcttctccacttcgggcggcggccccaacaacatcaacgacatcttctcgatgttcggcggtgctgcaggtcagggcggccagccgtatggcggctacggccaatcgccgtacggcaatgccgacggctatggctatgaggaggccccgcgccccgaaaacggcgaggaccgcaactccaagatcagcctgaccctgcgtcaggcggtcaagggcgctaccgtgtccctgtccgtggacggcaagaagttcaaggcccacgtgcctgcgggcgtcaaggacggacagaaaatcaagctggccggcaagggcaagctaggcatcaacggcggcaaggccggtgacctgtacctgcacgtcaccgtcaagcccgatgccacattctcgatgcgcggccatgatatcgtcatggacctgcccgtcaccgtgggccaggccgtggccggtggcaaggtcgaggccaaggatatcgacggcaatcccgttaccttcaaggtgccggcaggctccagctccggcgcggaagtcaagctcactggacttggcgtccagcgcagcaaccagccgggcgatctgatcggccgtgtgcagatcatggtccccgccaagccgggtctggccgtcaagcacgccgccaaagaattcgacgaaaaagccggcgactatctcagcctgtaatcaggaggtgaacaatggcgcggttagccaaccagatgaagcagttatacgcgatgtgcgcaaccgcgctcgtgatgggcagggccgatctcgacggagccgatgacgtcggcttcgacatcgaactgcccatcttcaccgtcggccagaccgccgagttggccaacattcacccccagaccctccgtcagtacgaccgcctcggtttggttcgtccgcagcgcaccgatggcggcgcacgccgctactgcctgcgcgacattgcccgcctgacccgagctcagcgcctgagccaggatgagggcatcaacctttccggtatcgcgcgcattttggtcctcgaagaagagaatcgccaactgcgccgcgaagtcaaacgcatgcaaaccggcgaccaggagagcgttttcgccgcaggccgtgacggcaatatcgtggaggtacaacgctccaaccgcgcccgcctctggcgcaacgccatccgccgcgaaacccgcgaactgcccggccgcgatactgccgccgatatcgctgccggcgccaccggcgactccaactacactcccgccgactccaagtccatggtcctgtggggttggtgagtctggccgcattgcttcgattccttctccattcgtaaaactgtttgttatctcacatcgggcagctgccgaaaagcacgaatcttcttgacggagatgtcaaggtttgttacggtgacgtgcgaaaaccgattcgtaaggggtgctttaggctgagacggtatgtgccgaacccttcgaacctgtgagctaacactcgcgtagggaatgcgacggttgaactcctctgttcggctcggcatcccatatgcgcgttgagagagaggaagcgtatgtcaatacgcaaggagctgaccgcccagaacgtactgctgggtttccagcatgtgcttgtttccaacgtctggcttgatccggtgtttgtggccggagcaatcggcttacctattgccctgtcgtcgaacatgattaacgccatcttcatcgtctctggtctggttactttggttcaggccactcggctggttcgcctgccggtggtgcaggggccgtcagccgcgtttgacgcgttgatgatcgcggcaggtacggccggcatgctgggggcggcgagttcgtccattctcatcgcttcgcttgtgttcctgttgctgtgcctgaccggtgtgatagagcggatgcggttcctgttctctccgatgatttcgggcgtggtcatctttatggtcggtgtctcgctgtctggattcacgctgagcgagtttctaggcggggctcccggcgacaagacgttcgccgatccgcacatcctgaccgtgtcgattctgaccacggcgattgtgcttgtcctgtcgttgctcggcaagggcctgctcaagtcgttctcattcctcatcgcgctcgtcgtcggcaccgtggtcgccgcagcatttggcatggtggacttctctcctgtggcatccaagggatggctgggcctgccgaccttcctgccctacggtccgttcacatttgactggaagatcttcatcccgttcttcatcgcctacatggttgccgtcatggaagctctcggcgtctatcaggcggcttctgagattcagggcacgcccctcgaacgcaagcaggtgcgctacggtcttgccggcgaggcggccggttcagccatttcctcgctgattggtggattcaccaccaccgcctacccgcaaaatgtcggcctgctcaacctgaccggcgaaggcaagttgcgcacgcgcacgcctgtgatcatcgccgctgtgctgttgctgattctgggcttcgtgccaaaggcgggcgcgttgctgtccgtcattccctcggcagtcgtcggaggcattttcctgccggctgcggccagcctaatcgtgaccggcctgcgcgccctgcgcaaggtcgctgatgacgagcgccgtcaaacggtcatcggcatgtctctgttgctcggcatcgccctgcccaaggcgctctccggcctgaccggcggcgcaagcgtgttccttggcaacaacatcatggtcggtgtattcagcgccatcattctcaatgcgcttttcgtcgctcttccggatttggtggcgaaacatcgtgcgccggcgtccgtggatgttccagcagccgatccggcggatgggactggcgctgcggcgtacgatgaacgataatgctggttgatattggatattgacaggagcgatgcaatgactgatgtgatggatgacgcgcgtcgtatcaagcgcgggattctggattttatccatacctatggctgtgagcaggccccggaagaggcgtttggtgcgttggcgcgcgacgtgttcatctatcagtacacgtatgatctgccgtaccgtcgttactgcgcggctaaacgcgtcacccccgcaacgctcaaggattggcgggagattccgccgatgccggtggacgggttcaagcaccttgacctttcgaccataccgaccgagcagtgcagagccgtattcatgacgagcggaaccacgcatggcggcaagatgcgtgggcgcaacttccaccccgatcttgaggtgtgggatgaatcaatgattgtgccgttccgtcatttcatcatgccggatcgagagcgtatccgcatcgccgtgatttcgccggcatgggacatgaaccagaactcctccctgtcgcgctaccttaccaaggccgtggagtgctgcggcagcgaaggcagcggtgtgttcttcgacgagcatggactcaagttcgatgaaatcatcgccttccttaaccgtgcggtgtctgacggtgaaccggtgatgctgatgggtgtctcgtcgtcctatctgtatctgctcgattacctgcatgagcatgatctgacgttcgcgctggcccccgatagccggttgttcgacactggcggcttcaagagcactaagcgcgacatcaccgaagaccagatgcttgatgagctggaacagacactgggggtgccgcgccaccactgtgtcaacatgtatggcatgaccgagttgagctcgcagatctatgaccaaaatattctgtcgtggtatacggatggcaccagcaactatctcaaggcgaaccccgcctgggtgcgcacggtcttcctcgatccggaaacgctgactcccgtcaaggatggtgagaccggtgtgatagcccattacgaccttgccaattggaattcatgcatcggtattctgaccgaggatctcggccatcggaccccggacggattcctgctgcagggcagggcgaagggagccgaggctcgtgggtgctcaatcgcggtagacgaggtcatcagtgccaaccgttgatgaatccgtgagtcaggccattgatgtcttccacctgccctcgggagtggatgtttcggattacgaaatctatgaggtcgccacatcggatggggtgaagcgtttgcgctatccgcgactggatggctcaaaggtgacttcccttgccaagcagcttgtcgatgttcgcaaccacacgcttgccgcgatgagtgtcaacgatattctcgacatcgtggccgacgcggcccaactatgggccgatccggattttgagctgcggcgtcaggctgaactgctgattcccgcaatcaccggatatgagcctgacatggtgcggattgagctcaaacggtatatgcgccagttcaggcgtcgtgaactgctccggttccttgactccgaaatcggtcagccgtctatgctcgacgaattccggccgaacaaggcggggggatactctaaatatgtgggcccagcgctcacctatcaggtgttctccagcaatgtgccggggattcccgtgtggagcatggcgatgaccctgctggtcaaaggcgcgattcttggcaaatcttcattttccgagccggtgatgcctgcgttctttgctcgcagcattgcgatggtcaattccgacctcgctgatgccattgcggtggttccatggaagggcggctcgcagcagctcgaggattcagccatcgatgcggccgatgccgtgattgtttacggttcttcgcagactaccaaattgattgcgggcaaagtcgccggatccaagccctgtctaggttacggagcaaaagtcgggttggcgttcattggccgagaggctttgcgtcctgatacctatgccgataccgtgcatcgtgtggctgttgacatcgccacatatgaccagcaaagctgcctggctccgcagaccgtgttcgtggagactgatggagccctcacccctcgtgaagtggctcagctgctcggtggcgagcttgagaatcagcagcgcaaatatccgcgctccgtattgagtgacgccgagaacgtggccattcagcgggcgcgcaccgacgctgagatgagagccttgatgggcgggaaggccgcggtgttcgccagtggccatagcacggcatggtcggtgctgtatcgagaacttgacggtagcggtgccgacgaggatgttgcttcgctgatgtcgccgttgaaccgcaccgtcaacgtggtggcggtgccagatttgttggacgctgccagaagactgacttcctgccgtggctggctgcagagctgcggtgtcgctgtggattcaaccagactgtttggtcttgcggatacattggccgaggtcggtgtgaatcgcatctgtccgctcggtgagatggatcgggcgaaatccggctggcatcatgatgggggcttcaacctcatcgatctgttgcgcgcggtggatgtcgaacgcggcagcgacgcgtacagcgattcgttcgatatggatatggaataggcctgtgctgttgcgggcagcagaggctggtagcagggcgaaaggcaagggtaatgacagagcaaagcgatatggcacggcgtccaatggtgaatctggatggcagaacagcgatcatcaccggttccggcaagggcataggagcggctgtggcgaaatgcctggcatcgcacggagccgctgtcgtcatcaattacgtacatgacgccgccagcgcgcagcgcaccgttgaagacatccactcgctgggaggcttggctatagctgtacaggcggatgtttgcgatgaatcgcaatcttccaagctagtgggtaccgctgtcgactcattcggcggcgtggacatcttagtgaataatgctttcggacgcttctcctttgacccgcgtcgccgttccacttttgctggaggcgattgggatgagtttagcgcacagatcgagggatgcctgcatggtgcatatctgatgtgctcacatgtggtgccgctgatgcgagcccagacctccgggcgtatcatcaacatctccagcaatctggtcgattcgcccatcgtgccctaccattcgtatatcactgccaaaggcggcttggtcggcatgacccgctctctggcccaggagctgggcggcttcggcattaccgttaatgccattgccgcaggtttgacggccggaaccgcatccagcgcagccaccaccgaggatgttcgtgaacgaatcattgccatgacgcctcttggccgccttgcccgtcccgatgacatcgccggaggggtcgcgttgttggcgtccgacatggccggcttcattaccggacaatgtctgcacgtcgatggtgggctgaccatgcgctgaggcgcaggggcggtgtgctgacgcgctatggttgtcgcatccgattggtgcaatggaatgcagcaagagtaaaggcgccaattggcgtgcgggcatgtggacggaggtaactatgctgctcaaagccgtgttctgggatttggacggtactctcatcgattctgagccgctctggcatgacggtgagattgagatcgcgcacaacaatggcggcgagtggaacgaggacctcggttgggagtgctccggcactccggtaccacacgtggcagaggtcatgattgcgcatggctgcacattgagcgttcccgaaatcgacaagcagctcaaggattatgtgttcaaggcggaggtcgaacgtctgccgtggattcctggtgtattggacgtgctgcactcgctcaaggagaccggcattccgtccatgctggtcaccacgtcgccgcgccgtatggcggagaacatcatgaagcagtccgagggactgttcgccggctacgtctgtggcgacgatccgtacgaacacaagccgaaccccgcgccctatctggccgcagccgacaagcttggcatcgcccgtgaagacatggccaagtgcgtggtgctcgaggattcctcggttggacttcaggccggtgcggcatcgggcgcgactctgatagcgcagactggctggattcgcacggatacttccggcctgggccagttcgcgtccatcgaatcgtatgacggtatcgatgcggccgcgctggacggtttcgtgcgccagcgtttgggggagtagaaataggccgattgtatcggcattgcattccggtgtgtcgcaagtatttgcaatgtttatatcaaccatttgatgtctgttttgacaaactcctgaaacgttatagaattgttgccaacgaagaaatctgaaacgttctagaaaaaccggcgcacagcagcgtcggttgactggttttccgctccggcaaagcatgcccgagtgttttctatggccagtttctgaaatgttacagaaaaagaagatgaggtccaagggaggtcatcatgacggcaattcaggaagccgttcccgccgcagcgggggcagcgcaaagccgtgggggagaggtgagcaacgcggctgcggcagccggcaaacgtgttcgtgcccgcaagcacagcggcgcatcgcagaactcatggcaaagcaagctgcgcccctacctgttcatcgccccgctggtcattctctccggcgtcttcatctactactgcatcggcttcaccgtggccacatccttcaccgactgggacggcatctccagtgagatggacttcatcggactggagaactacaccaagctgctcgctcccggctccgtgttctggacggccttgatgaataacatcatcttcatggtcgtcaccgtggtcatccaggccgggctcggactgctgctcgcggtgatcctcaaggagcgcctgcgcggttccagcttcttcaaggcgatcttcttcatgcccatcgccatggccccggtcatcatcgccgccatcttccgcatcatcatggatccgaacgtcggtgccatcaacgaggccctgcgcttcctgcacttggacttcctggcccaaagctggcttggcgatccgcacatcgccctctactcgatctgtgccatcaacatctttgaatggatgggcttctcgatgatcatctactacgccggtctgatgtctatctccgatgacatctacgaagccgccaagatcgacggctgcggattctggaacaccctcttccgcatcaccattccgaacctgtccggcaccaccaacacgcttatcctgcttggcatcgtcggctcgctgaagaccttcgatatcgtcatccagaccacaggcggcggccctggtcgttccaccgaattcctgaacacctacctgtacaaggccggcgtgcagcagttcaacggcggtctgtccgcggccatcggcgtgatggtcctcatcatcgccgtgatgctctccctgattcaacttgccttcaacaagcgtgccaacaactaacgagaggacgtcatcatgaagcgtaaaaccagtgcgacggtcatcatgtacaccgtcctcgtattcttcttcgtcatctggattttcccgatttacacggcaatcaccaagtccctgcaggcaggcggctggaacagctacctgtccgtgatcaacaataaggacgtgcactacttccgcgtggtgttcaacagctttttcatctccgtggtcaccgccgtgatcgtggtggtcatcacctcgctcgccggctacgcctttgccaagatgaagttcaccggttcccaggtgatctacgtgctgctgctcgcctgcatggccgtgccgattgcctccgtgaccatgccgctgttcttcaccatcaagacattcggcctgaccaacacctacctcggcatgatcatcccgttggtggcgttcaacgccctgcagatgctgttgctctggcgcaactacttcaacggcgtgccagacgaaatcatcgaagccgcccgcgtggacggctgcggttccctgcgtatctgggctcgtatcttgatgcctatctccaccccgatgatcgccaccaccggcgtgctgaccttcgtctactcctggaacgaatacctgattccgttgctgctcatccgcgacgaatccaagtatccggtcacgctggcctccacctacttcatggagacccgcagccagacgccggagatggtggcccaggaatacgccgccctgattctgatgacgattccgtccatcatcgtctacctgatcagccagaagtggctgcagtccggcatcaccgccggcgccgtcaagagctgaggtgacccaaaatgaccgcaaccatcagcaacggtgtatccgccagctacagccctgcggaagacgagctcggcgcagctgaccccaccgccttgcttgccgaatctggcgatttgaagccgctggccgaacgcacttatacgaatccggttccatatgcggacggtaagtcccataccgcgcccgacccgttcgtgctcaaataccgcgacctctactactgctatgccaccgacgagcacggcattctggtctccacctcaccggacatggtgcactggacctcacatggattctgctacaccgaagccggacgcagaaacttctgggccccatcggtgattctcatcaacggcgtctttcacatgtacttctcgaatatgccggccgaggagaccgacacccacacggaaatcatgcgtgtggccgtgagcgaggatccgctcggcccgttcgaaaagaaagcggagctgttcaacaccttcgccatcgactcccaagtggtctatggcgatgacggccagttgtacttgctttacgccgacaatcaggtcaccggcctgagcgatgaccggcccggaacctccgtgatgatcgatcgccttgtgaccccgtattcgcgtgagaacaaaccgcgcccgctcatcgtgcccaccatggacgaggagatctttgcccgcaaccgtttcggcgatggccgcgactggcacaccgtagaaggcgccacatacttcgcctaccgtgaccgcgcgttcatcacctactcggccaacgcctacgagcatgaggactacttcgtcggatactcgtacgcacagctgccgaataagcaggccgacgcccacatcgatcagctcgattggacgaaacagctcaacgagaaccgcttcgatccgctgcttatccgcagcccaaaggttgaaggcacgggccacaactccatagtcaaagcgcccaatgccgttgatgactggattgtctaccacggccgtaacgccgatgacgagctgtatgtgggcgccgaacagcgcgtaatgcgcatcgacccgctgtactacgccgaaggagggctcgacaccccaggacctaccgccgccgctcaaagcgcaccgctgtatggcactgtgcatgatgattttgcggatggcctgaacgccggatggtcggttatttccggcgcggcccacaccgaatccgatgtggacggtcacgcgcttgttgccgacgaatccagtgtattcatcgctgtgtcgggcaaatcgtccgcaacccaagtgattgacgtctgggccaaagctcccgtcaccccactgggcgcacgattcggtgtcgtggtgcggtaccaggatgccaacaacctcaccaaactcgaggtggatgctggccgtcaggtaattagcgtggtcgatgtgatcggcggcgttgcctccgaacgcgtgaccaatgccgacctccatgacttcgattcccatgcctggcatgagtaccggcttgagcgccgctactgcaggctggagatccgcattgatggccgtttcgccgcgtcctgcaccatcagtgataagcccggtcgggcgggattgttctcgttgcgaacgggggccgcgttcagcgcatatgcggccactgaacatgtgaatctgtggggtgccggattgcgggatctcggtcgagaattgcatgctgaccgccgactcgtcatcgacggcggcgtgaggtccagcggcgtgtgcccggtaacactcgaactggcatacccgctggtcagcaaccgtttcgtccttgatttcgctgggcagacgagccgtgggcaggcgctgttgtctcttggcgaataccgtttgtccggcacggcatcatccgtggagttcatgcgcaacggcaagtctctgccttccaccccggagccggccaggctgcgtgtctttgaagacaacgtccgccgtgaccgttcgggccgagccgtgctcaccatccgtatcgaagctctgaacggcacgatgcgactgcacctacgtggcaaaacctggcaggtgccgtttgcggacaatgcggcccgtgcccgtatcactcttgatcgcgcatccctgaccggatacgagaggacatcgctggaatccagcatcgaggaaaggagtgcgtccggcaattgagccaacatcagccgcacatatcgggtgtggctggcttcgccatccaattccgatgatcttccacaacgaagtgaaccaataagagaaacaaggaaaataaggagaacaatcatgttgaacatgaagaaggcgatcgccgcagtgggcgctctcgctatgtctgcaggtctgcttgccggatgcggttcgggcagcggcggctccgatgagggagtcggtaccaaggacagcccggttgagctgaccttctggacctggcagcctaccgatgcccagtggaagtcgatttacgccgccttccagaagaagtacccgaatatcaagatcaactggtggcgtacttctgaaatggccgactaccagaagaagctgcagacctcgatggccggcggcgaaggcccggatgtgttcggtgtgcaggccggttccactgtggaacagtacggccgtttcgccgacgatatgaaggagctggccgacaagtacatgcccggctgggattccaaggtggccgagggcgccgtggcgcagaccaccaacaaggatggcaagatggtggccatgccgaccatcacctccggctccgaatacatcctgtacaacaagacgctgcttgacgagcagggcatcaaggtgcccaccacctacgacgagctcgtggctgccaacaaggaactcaaggccaagggtctgatgccgctggccctcggcgccaaggatggctggcacctcgacgatatcttcgtgtggctgtccaaccagtacggcgaaggtgacgtgtacaaggccgccgaaggcaaggccaagttcactgatgagaccttcgtcaagaccatgaaggcttggaagcagatgatcggtgatggtctgttccaggatggtgcagttggtactgcgacctacccggatgctcgcgacaactacttctacgcccgcaagtccgctttcttcccgaccggctcctggcacgtttccgccgtgctgccgaacgatgagaccaagggcacggccgttgagaaggacgagctaggcatgatggaattcccgcaggtgggagacaaggctaccggcccgaccactggtgtggacttcggcctgagcgtgaacaaggactccaagaagaaggaggccgccatgaagttcatcgagttcatgaccaccggcgaaggccagcaggagtggatcaacacgctgcagggtgctccggtcgacaaggacatgaaggtcgaagtgccgtctgacgccacggaatccgccaaggccagcatcgatttggtgaccaagggccaggcctcttccaagcttgagcgcaagctcacctcccaagaactcaacgacgagatcggtgtgcagatgcagaacatctacaccggcgacgccaccgttgactccgcgctgaaggccattcagcaggtcaacgaatccatcgaaaggtgagcctatagataggaatatcgcatagtttctactcctcgagtgggcccgtccggtacgaattctcgttgtctggcgggccttctttgttggtttgccgaagtggccctgatttattaccgccggcggagtctgttgacggttgcagcgggagtcgtgggcggcgtgtcggacccgtccctgctagcggggctgtcggcaaggccgactgggggtgattctgcggacgcctaagcgaaacggcctgcgggggcgatatcccacatggtttatgctggaaacacacatctgaaacgttcgacaaccaatatggcgacgtggatggtgccatgccgagtggttgatggactgaatataagggggcgctatggttgcgagttcgcgcaaggcgacgctgcacgatgtggcgaaacgtgcgcacgtgtccgtggcatcagtgtccaattacctcaacgattacccctatatgaagccggccacgcgcgaacgtatccagcaggccattgacgagctgggctatgtgaccaaccagcaggctcgcaatttgcgttccggccgcacaggactcatctcattgtctctgccggatttgaaccagatttacttttccgaactggccgaagagatgatcacgcgggcacgggaatatggataccgcatcatcatcgaatcgaccggaaacgaccgccagcgcgagatcgagagcgcacatgccatggccagcaatatgaccgacggacttattttgagccccacggccatgcgggcggaggatgtggccgagctcgagggcgactacccgctggtagtgctgggcgagcgtatcttcaacgcacctgcgccgcacgtggtgatgcccaatgaattgggtgcccaagccgctaccacgcatctgctggaggccggatgccgcaccgtcgccgtggtgggcggaacgttggacgaatccgtgccgtcctctcgttcgatgcgaaccaaggggtatctcagcgcctttgcggaacgtggagtgacgcctgatctgaacctgatccgcgagtgcggcgaatggaccagtgccgagggcgctcaggcggtacgtgagatgtatgcgcagggcattcgaccggatggcatttttgcgctgaatgatttgctggcgatgggtgttatcagtcagctgcgggaaatgcgcgtgcgagtgccggaaagcgtgcgtgtggtgggcttcgatgatatcgatgaggctaagtacacgattccctcgctgaccactgtggatccgcagcgcgcgcgtattgctgagattgccatcacgtcgattcttgatcaggtcaagacgggggctcgggcgccgaggcggcgtattgatgtggagtattcgttgcgttaccgcgcttcctcgccgcaggtgtagcagttgtgttggccggctggtagggtatttgacggtttgcatatgactgtctggttcattgggctggcagctcaatacaagatttaggactcataggaaacacatgggcttcgttaatttcatcatcgaactgctgaaggatccgcgtgccgcgattgccggttggattgccatgggcgtggcgccgaccctcggattcatcttcctcatcgtattcatcgaaacgggcgtggtgttcttcccgttcctgcccggtgattcgctgttgttcgcggccggcgtgttcgcagccccggatgctgcgaccggcaaggccgcgctgccgctgttctggttgctgccggtggtttggtgcgcgccgattatcggcgaccagtgcaactacttcatcggtcatttctttggccgccgtattatccaatccggcaaggtgaaggcgctgactcctgagcgactggccaaaaccgagggcatgattgaaaagtggggcccgctggctgtgttcctgggccgcttcttcccgttcattcgtacgttcatgccgttcatttccggtatttccggtatgcgttggagccgtttcacgccgttctcagtgctcggcggcctgtgctggtccacgttgttcacgctgctgggctacttcttcggcaacattccggccgtgcaggatcacttcgaactggtgatcgtgctgattctgctggtttcgctcgccccgaccatcatcggtctgctcaaggccaagttcggcaagaagaagccggccaaggtgaccgatgctcagttggacgtcatggaagacggcatcaagaacctcgataagtaagcaaggaatgtagattaccgcataaggaatcgtcgtgaaaatgaaggccctgactgtgcatatgaggtcagggccttttctgcatgagatgggcgtgaaacagcagcgtggttatccacatttgtcgtggacgacatgccggggtgtggataactcagcaagctagaaccacaatggtcgattcgtgttgagcattgaactcggacacgtttcaatcggcttatgaatagcaacaccacaccccgcgtggcgcgtaggatcacctcgccagcggtagcacctccgggcattccgctgcccacggacgatgcgccgattccagcgcatcgctactacactccgccgcccaggccgttggcctcatgcgaacggcagagatcgggcgaggctccggcgctcgccctaactacagacaccagcttccataacattgtgacgatgacgtcaggtcatggaggcgtggggctgagtgtcatggcttccatgcttgcatggacattggcgagacgtgaacacagctgtgctctcatagacgctgatttcgtggccggatgccttgacctgctgctcggtgtggaacgagagccgggtttacgattcagccaagtcgacgcacccctcggccgcatcgagggcgatgcgatgaaccatgagctgatgatgtgggagggtgtgcgagtacttccctatgacccttggagcgcgcgccagcctgactggtgggaagttcaagcggccattcgagccttggcggaaacgaacgacgttgtcatcgtagatgccggtcagggtggactcattgagaccgtacccgatctgcgcagtggcatgcaggtgattgccgcggaattgtcggtgatggggctggccagagccaagtcgcaccggtccagactggattcatggggctgtgaagcgccacatatcgtcggcgtggaaccacgtggcgctccacgtgggagaggccacgtgggtattggtgaggcgcaggactatttgactgccacggtattggggcctgtcaaaccaagtgtcaatctgtgtggagacgtactggaaggcctcggcatcagatcggtgaccaaaggcagccgcaaagccgtgagcttgcttgccgatcttgtcgagcaggccattcgcccggtttcgggagcttcttgcaaggaccggtgatgcggtatggctgccgtaatcactcgggctgatgagcccggcgcagtgcccagaactgtgttcttcggtctattgaatgatgtggcatccgacccgcaggttaccgatctggcggtgacctgtgatggccgcgtttgggcggaccgcggcaacggcatgcgagaaacagtattgcgtgtgccgtttcgctcgccgcaagtagttcgagaatacgccgtccaactgtgcgcgcagcttgggcgcagactggatgatgcctgcccgatagcggacgccgccagtccagacggcatccgcgtgcatgcggtgattgccccattggtgccacaaggtgccgcaatctccatacggttccctgacaggaccatggcatcgttgcgacatctgagccaattaggtgtattcccggctgcttggctgccgatgttcgtgggactggtgcgcagacatgccacagtgctgattaccggcggaacaggcgtgggcaagaccaccttgctcaaggcgctgctggcgcaatgcgatgtgaacgagcgcatcgtcaccgtagaggaagttcgtgaactgggagaactggggcgtggcgatcatgtgtcgttggtaacgcgcgaggcgaatgtggagggcgtcggagccataagtctgacggacttggtcaaagcgacgttgcgaatgcgccccgaccgcgtggtgctgggcgaatgccgtggcgcggaaatcgtcgacctattgcgcgcgttcaattctggtcatcacggtggcatgaccactgtgcatgcggacggcgtgaaccgagtaccgtccaggctgatttcgcttggattactcgccggagtcagtccacaggcgttggccatgctggcggcaggcgctttcgacgcggtggtgcatttggagcgagtgaacggacagcggcgtatcacgcagatcggcgaactgcgtgtagcacatggtgaactggcaggaacaccgctggcggtatggaatggctgccatcctcctcggtatgccgccgaatgggggcacttcattgaacgatggggcatcgttcccgggccgagtggtggtgggtgatgatgtggtgtgctgttctggtggcgctcgccgtgctgatatggccggggaacaagtccgggaggctgtatcggctggcttaccgcgggcgtgcggtcgattccgcagccataaacgaacctcgatatgccggctcacctcgcgtgggcgttgcgcaggtgattacgtccgccatcgcgcgattgcgaggtggcggcacattggttgaagcattcgaggaacaatccagcagacgcttcgccactcagcgcattactgtggaacggctcataacggtgttcgaacagcggcgtctgcccgacgaatcaccagcgcaggtacttgaagctgcacgcggggtcaccgccgcagcggttttgagcgatgagctcggttgccaagcagtgccatgtctggaagcggtattgactgcttaccggcagatgaggctgatgcagaacctgcgatcgcaagcatgtgccgttcctaaagccactgtggggctgctgagcgcgcttccggccgtcactgtggcattgggcgagcttctgggagctagaccattggcgttcttgcttggatcgccacgcggtgtggtctgcttggtattagggggatgttgttatgctgccggcttggcatggatgcgggcattgttgaaaggcagcggattatgagtacggtgtgggtacacgccgcggcaggctgtgcggcgatcgctagttggctgtataaggctccgtcttgtcatgacagccgcttgccgggcgaggaaccggccgtagcgcatgattgcgggtcgtcatggaccatactcatattgcgtatgtcgcaggtgtccttgcgtcagggctcctcgattccccgggcgcttgacatggtgggcaaagccgtcggcggcgactgcggcgctcgcatgagcgaggtcgggagatccctgaccagaggggttccctgggctgatgcgtggcatgccgctatggctgttcagcatgagggtgcgccagctgatagttcatccggaaaacgtaccagcagaacgcaacgagatcttggcctgctgcaatcggctttggaatcgtcatggacgcatggcgatatgcctggcgtgcgcctcgaatccgccattgaacagctggaccgtgacgagcgtgccgccatcgaacggaatgccgcgaagctgtcggtaaagctactgatgcctacagggctatgttttctgccggcattcgtgctggtaggagtcattccggcgattgcgtccttcatgatgtgaatataggcgtgaactgagtgcgcttagggtgaatcttgttgtatcgctcggtattgcacttggctgcgtttggttatccacattggtggtggacgacacgtcggggtgtggataactcggcaagctagaaccacataccccgtttttcctggtgcatgaagcgttgatagtccacagtggtatgcaccccgcgtcaacccggcgcgggggccaaccactcacacacgcatggggaaggtgcgaagccactgcgcagcttcccctccttaccgaaaggaacgccaatgaatacccctatccccgtcatcgtcgacgggcaggccggcatctttgcgcacagcaaggctcgtgtggccacgctgaacgccaaggcgaaagaacggctatgcctcatggacgcacgcatccgcaccctcatggctgagcccgaagaaggcgcggccactgcggaatacgcagtcgtactcgttgcggctacaggctttgcggcggtgctggtcgccatcctgaagtcggatgccatcaagacgttgctgaccaacatcatcaaacaggctctgaaagtcgggtgacagccatgaagaccatgacatgccggtggcggctcgccagactgccgccagacctatgcacggggtcggccaccgccgaattcgcgatcgtattgcccagcgttatcgccatcgccgggctgatattggcaataggacgtgtggtcatcgtttccatggactgtcaaagtgccgcggcagcggctgcacgcgagtttgtggttaccggtgacgaatcatcctcgcgcagcatagctgcggacgttgccgggggagagcctcgcgtcatcattgcccacgacggccaatcgacgagtgtgatggtcgaatgttcggtattgcctggtccgctggatgtcactccaacgcgggttaccggcaacgctacggcgataagccaataactggtcggctggctgggcggccgcaacagaaaggaactgcggtgcagggaatgcgttatgaggagggatcgggcacgatggccggagccatgctggttatggtggtgggcattgcgctcgcggtggcggcaagtgtgggcaacctcatgatctgccagaaccgagcgcgttccctcgccgaccttatcgcctttgacgccgcgtatgcgctgtggcatgcggatatcggtgatccatgtgcgctcgccgccaacatggctgaagcgaatggtgtagttttgggctcctgctccgtgcgggatgaagacgtgttggtaaccatcaaggtggaaaccatggtcctggtggcatcatccgtggagcggatggctcgggccggaccggtgagttgtacggaaggagacaattatcacaataatggaccgtaaagcaccgatactctggcgggcttctgggcctttggctaaggtgagagcatgagcgagagtgaacgcaacgagcgccgtcgcgtggtggccatggtgggcaaccccacttccgataaaggccgtggcgctaaggtggacgcgcaggtattgggtctgctggaggaagccggccgtgcccataacttcgacgtcatcgacatcaccggcacgagtttcgacgattccctgaaccaggcgcgtgaacgcgcgcacgagtacgactatctcgtagtggtcggtggcgacggcatgatcgcacttggagcgaacgccgtgggctgcagtggcaagccgttgggcatcgtggccacggggtcgggcaacgatttcgcacgaggactgaagctgccggtcaaccgtatcgaaaccgcagtggaaggtatcgtcggtgctatcgtgcgcggatcacacatcgatgtggacatgggacgcgtgacctctttggacggcggctatgccgtggatccctccactggcgaggagtacgagtaccaggagagcaagtccgccgagcatccgattgaccggtactatgcgggcatgctgtcctgtggtcttgacgcgagcatcaacgaccgtgcgaatcattcgcatctgccgaccggcaccatgcgctactttgcggcggtgctggtggagctgacgcatatgaagcgttatggttaccacatcaaagccacattggcggacgggaccacggatgaacgagacatcatcacaccattgctgacgattgcgaattcgaggcatatcggtggcggcattgaggtctcgccgtactcctgcttctccgatggattgttggacctggtgtggatggaccacgtgccgaacttcggcgaatgcgcggtggccatttcgaatgcctataacggcaagctacttgcttcaaaggtgttcggctggaaacgtatccgtgaaatcgaagtcacgcgggcaacggaaggagacgagccgccggtgctgatggcggacggcgaatatatcgggcatttgccatttagggtagtggccgaggactgcgcgttgcgcgtgctagtgccgccggccgtagccgcccgtgaggtggattcccgacaggaagtgctcaacgccattgcccgagatggtcgcgatcccgtgaccggccagttcgcgtgacccgattatattggctcccctcattaggctgagccgtaaagcaaacagcccagtgggctgtttgtaggcgagggttcgacgatagtcgaaccagaagaaagtcagccgtaggctgtccgcaattgcggacgagctggccgcgaagcggactgaggggagtgcgggagagcggtaccagagccaatggccgtcagacctcagacgacatagctttcgatatgcagcgtctgcgccatgacctctttgatggttcggtcgctgatgttcggatgcgagcgaatcagcgagataagccccacaatcagtgtgaagaacgtctcatggacgttggtgattggcaggccatgcatctgctcgaaatcacgtacggtggtctgggcaatgtagtcggcaatacggtccgccgcgcggtcaatgaacttgatatacagttcggcgttgccgtcttggatcatacggtttgagaaggggctctcgtcggcgatcagggagcggagcacatgcacgatgtcgtctaatgccttgttcacgttgcctgtttcgcgcgcttggttccactgcttcaacgtggtgaggatttcgtcgatgacgttatcgagtactgcgtcagctacggcttccttgtcttcgaagtagtggtagaacagcgaacgcgtcataccgacttcgcttgcgatgtcggaaacggtgattttggagaagcctttttccagacacaccttgcgcgcggcttgcacgatggcgtcgcgccgggcatcgccgcgggtggggcgtttctcgtcgagggtatcgctcatgggtgcctcctgaccacaaccgttattgacactatgttaatacaaagaaagcggttaataacaataaaaatgcggtaaccgttgtcaggtgaatgtcgttggaatataaagagttttccgattcggcaactatgagcccggtttatcttgactttttatcggttaattctgagggcaaaggtaggttagtagctatggcacttgcactgtatcgtcgctatcgtccggacaccttcgaaggggtcatcggccaggaccaagtcacggtcccgctgatgcgcgccttggacgagggcaagctcacacatgcctatctgttctcagggccgcgaggctgcggcaaaaccagctccgcgcgtatcctggcccgttgcgtcaactgtgccaaagggccgacttcccacccctgcggcgaatgcgaaagctgcaaggacctggccaccggcggtccgggttccatcgacgtggtcgaaatcgatgcggcctcgcacaacggtgtggatgatgctcgagaattgcgagaacgcgctggtttcgcccctgcgcgcgaccgctataagattttcattctcgatgaggcccacatggtcacgcagcagggcttcaatgcgctgcttaaaatcgttgaagagccgcctgaacatgtgatgttcatcttcgccaccaccgaaccagacaaggtgatcggcaccatccgttcgcgcacccaccactatccgttccgtctggtgccgcaggaagtcatgggtccctacctggagacgatctgcgacaaggaaggcatcaagcccgagcccggtgtgctgaaactggcgatgcgcgccggtggcggctccatgcgagataccctgtccgtgcttgaccagctgatggttggttcggtcgaaggcgttatcacccatgatgccgctgtagccctgctcggcttcacgccggaggcactgatcggtgaggccgtggatgcggtaatcgatcacaacggcgaagccctgtacggcgttatccagaaagtcgtggtcggcggattcgatccgagacgattcgtcgaagacctactggctcgtgtgcgtgatctgctggtgcttacgttggccggggaccgtgcggaatccgtgctgtccgacacggctgaggccgaggatatggacgatctgcaccgccaagccaaggcgctgggactgggcgcactgaccgcaatggcagacatcatcaacactacgttgggtgccatgaccggagccatttctccgcgtatgcgcttggaactgctggccgcgcgattgttggccggcagtgaatcaggctttgcaacagccgctcccgcgccagcttcttctggtatgccgcctgcgtctgcttcttcgacttcgactacgtcagccgcttccggtacgggtgccagtggttttgccggcgcatcgcggggcgggtttgccggagcctcacatggcggattctccggtgctgcacgcaaccagcaagcagccgcgcctcagagcaccgcttcccatgaatctgttggaggcaacggcccggtcagcgaccgacctgcggactctccgtctgtgcaacctgctgtagcaactgctgctgccggtgccgggtggggcgctcccgccgcgtcgccggccgtcccggctcaaccggtgacctcgcctgcggcatcggataatcggtccatcgacgagaagtgggatgcagccgtcgccgctttgccggaaaccattcgtgaatatgtgtcacgagacaaggtgccgaccgtaaaattcggtcccaaccgtaagggtctgccttgcctgtcgatgacgttcgacaagtcgctgagccagcacgctttcgccttggccgtggataacagcggtaagaaggcggcggccgtggtgatggatgccgtgcgcaacgagttcggcgccaatgcggttattgcaccttctgcggtcgcggcgaatggcgagcgagtcgaatccgtcaaacgtatgagcccggagcaattggccaaggtcaagcagcagattgccatggccaaggctggattggccgcgtcgagtttgggcgcgggcctgggcattcatatggggagcgagccgaaagctccgaagccgactgcaacaggccgagccgaggatacggacgacagccatcgagccggccaatccagtgcatccacggcggcgaagaactggagtgacgatgacccttgggccaagccggccgtaagcaacgcttcgccgcaatctgcagacgggttcgcacctaacgagcccgctgctacgcctgcgcccgaagagcatcacaagaagcatgttgcggttccggacatcagtgacggtgttgatccgtgggccgctccggctgctcctgttgcacccactgcgtccgttgcgtccgctggacccactggacagtccactgggcagccagccaccgcatcttccgctacggcagttgccggcgcgagcgacgatccatggaatcagacgcagtctcaggccgcggtctcaccggcgtcgcaaccggccgaagccgacccgtggaaccagccatatcagcagtctcctcacgatgatccgtggaatcaaccgcaggggaaccatgctcaggcggctccgcagccaggagacgacccgtggaatcagcctcagtcccagactccggcttcttcggttcctcagacagtgtcgggcaatatgtcgggcgatgacccgtggaaccagccccaatcggttccgcagccggctgccggcgatgacccgtggaatcaaccgcaggcagttccacaatcggctccgcaggccaccccgcacggtgacccgtggaatcaaccgcaacccgcacagccgaccccgaatgccgacccgtggaatagccagccccagccccagccgaaaccacaaccgcaagtcgcggccgaggatgacgaatactcgatgagcgaccagtcgctcggcgaggcgacggccatgaatctcgacgatctgaaaaagctattcgaggtcaaaaaagtcgagcaattcgcggcagatgatccgaagaaccccaagaacatccagcctgccaagaagcactcggatgaataatgaggacgaataacgaggaatacccatggcacttgcttatgacggcgcaatacaacgactgatcgacgctttcgggcggctgcccggcatcgggccgaagggcgcgcagcgtatcgccttctacatgctgtccgcgcccgaagatgaagcgcgcgatttggccgaggccatcgaagaggtcaaggccaagatccgcttctgtgatatttgcggcaacgtgtgcgaatccagcccctgcccggtatgcgccgacccgagacgcgaccgttcggtgatctgcgtggtcgaagagcccaaggatgtgatgagcatcgagcgcacgcgcgaataccacggcctataccatgtgctcggcggcgcaatcaacccaatggccaacgttggccctgccgacctgcgtattcccggtctgctcaaacgcttagaaggcgatgaggtcaaggaagtgattatggcgctcgacccgaatattgaaggcgaggccaccaccagctacttgacccagctattgcgacccgtaggtgtcaaggtcacccgacttgccagcggcctgccggtgggctccgacttggagtatgccgacgaaatcacgctgggcagggcactggccggtcggcgcgaggcctaagccagcgtatcattggcgctttcgcccttgcggcgcatccacggccagaatgcgccgtggcggatgatgcgcgcggccttgtggcgtcgtgccaaccagataatgaacagtcctgccgccagtatgcctagaccaacaccaagggcgatattgcgcgcgtcaagcacgtcattcggctcgggagccggcatcggaatcgccacgcggtgcccggagataagcagtcggtgcgtgttcacgccgtatggcgtacaggtcatcaaggtggcacggtcctcacccggcacaatcttgagcttcgacgtgtcatccggcaaaatcaccgaaatgcggtccactttgtagcccaaagtttcgcccatgacttcgatgtagaagaagtcgccctctttcacctcgtccaaacgggtgaacatcagcgcttcaaccaacccgcggtgcccggtaatgaccgaatgggtggatttacctcccaccggcagcgacgtgccgtacaagtggccggcaccagaagccagtgcttcctcggaagtgccgtgataaatcggcagattgatggactgcttgggcaccttgattgtgcccatcacgccgttgccggtattaagcagtgactggtattccttgtctttctttgaggcggaatcctcgccgctggcttgggatcctccttgagcggcggcgaacggatcgacggcttcacccaagataggctggccggattcagcgagcttcttgttgtatgcgcgggccgccgtgagcttgtcttccgcctgcgggtaaggccagccagctacttctttggccgtggtggctgtggtggcggccaagttgcggtcggactcgaattgcaacgctagcgggaagcaggccacggcgattgcggcgatcagcagcacaatggtgatgatgcgcatcgcccacaggttgcgttgcaggcgtcggcgctcggccacgagatcgctgatatcgatgacttcgtcaaatggtgttggaacgaatgctgcgggctcgggccgcgctgaggaaacgttgtcatttgcagatgcgtcatccggcatggccgcgttgttttcccacattttctgtgaggcacgcttactcgtcgaacgtcgatgcagcaatgccatagtcgcctgttccttcgcttgatctgctcatgatttgcttatacaagacggccgggtccgtcttagtcgtgcatggcataggtgctgtcgcaaatggcaacaccgcacgcgccacactgcgaaacgttactccgcaccaagcctttcatgcaacatgccgacggggccatataggggcaatgtagggggcataagaagtctgaaaatgcgatacgaacaacgttgctacggctgtcagtgatgcggcttacttcggacaagccgttgagatgcaaggggatgcaaaggattgcaaagtatggcaacatgataagtcgcagcgtcggcgatatttggcagagctttcaaataggggggtatgaatgcataaagagggaatatgttacctcgataaaagaggcgctattgctgttttcgtggatgtcggttcgtcgtcgagccgttggtttcgtaggcgtgaggggcgttcccgcgtattctgttttccgaccaaagaaatgaatcacgaagaacgcccgagcaaaagctcattcgccggattgccgaacgtcaaaggcgcggttgcagaggatgcgcggatcacggattcgccgctgcgttccgaattggctagtgtgatcagagaaaagatggcactgtctgggcatctctctttttaggtcaaggaaaagggtctggcgataggcggtgatgacgcccatcgtgttggtggcactgttgctgcaaaaaggaaaagtctagttcgtaatctagtgtccaacttccctaataggaatggtccaacttccacaacgaaaatagtccaacttccacaattagaatggtccaacttccgcaatagagtgatttataggttgatgtttcgacggtttgcgggagggcacatatggcagtggagagctcggagattcaacgtggcgagtaccttcctcgagtggctgatgggttgctgactcaggcattgcagtcttctggtgccgttcagattaaaggtccaaaatggtgtggcaagactgcaacggcagaaaggcagtcggcgagtcaggtcttcatgcaggacccggatcgcagtgctacgctgttggccttggctgatacaaagccttctctcatcctgcgaggtgaggagccgagactcattgatgaatggcagatggccccgcaattgtgggacgcggtgcgtttcgccatcgatcgagggcgcggtcgtggccgattcatcctaactggatcggcgactcctcaacaggaaccagctcattccggagtgggaagaattgcccgattaaccatgcgtaccatgtccttatttgaatcgcaggaatcgacgggcgttgtttcgttgggagagttgttcgatggcaaccatgatgtttcgggtttctccgatttcgatattgaaaacaccgcgtttgtgctatgccgcggtggctggcctgaagcagtagtcgaatctcgagtaaatgttgccttgcgcatggccgcggattatgtcgaagaactacttgattctgacatcaatcgtatggatggtataaagcgcaataaaacttggatgcgtctgattatgcgctcgtatgcgcgcaatatttcttctcaggcgtcgcaatccactatcgcggcggatatgcagggtgaaccgccttcggaaggtacactctccgattatttagatgcattgtcgcgagcttgcgtaactgaagatcttccagcttggaaccctcgtttacgttctaagactgcagtgagaacgagcccaaccagacacttcagcgacccgtcgatagcttgtgcggtactgcacgcgaccccggagaaactccttaatgatttcgagacctttggcttgctgtttgagtccatgtgtattcgcgatctgcgtgtgtatgctgatgcgcttggcggagatgtgttccattatcgggataagacgggattggaatctgatgcggtcattggcctgcatgatggacgatgggctctcattgaggtcaagctcggagaaaagcaggttgatattgcggcggcccatttgaaaaagttggctgacagaattgatcaagatcacgaaggccgtccgtcattcttgatggtgctgaccgctacggctgccgcttatcgccgggatgatggggtattggtagtgccgttggccacgcttgctccgtgagctcgtatcgtgcgtttgacccatcgttcccaacacaaaaggaaaaggcccgggctgcgggaccgggccttgaaaaggagagaggaagaagaaggtattcagttatggggtctgcggaaacctcgccggtttgctttcgtttgccggtaattgatagttaaccgctcgaatctcaaaggatggatgcggctgcctcaaagaaccaccggtgaaaacttgaatatttgctgaacaacgtaggccatgcccgtgtccacatgtcggcgcggggtcgcggggtgaacgcggcaacctttataatcgttgcgtttgcgtagaatattgagcaaactccccctaagagaagaacaaaggacagcagtggctctcatcgtgcagaagtacggcggttcgtcggtcgccgataccgaatcgatcaaacgtgtggccaagcgcgttgttgagacggaaaagaagggcaacaaggtggccgtggtggtctccgccatgggcgacaccaccgatgaccttatcgatcaggcgctgagcatcgactccaacccgcccgagcgcgagatggacatgctgatgaccgcaggcgagcgaatttccatgagcctgctggccatggccattcacgccgaaggcagccgtgcccactccttcaccggtcagcaggccggcttcttcaccgacgcccgttacggcgcggcccacatcaaggccgtgagaccggaccgcgtgaagaacgcgctctcattgggagacatcgccatcgttgccggcttccagggcatcaacgccaagggtgacgccaccacgctcggccgcggtggttcggatacctccgcagtggcgcttgccgtggcgctcggtgccgatatctgcgagatctacactgacgtggacggtatcttcaccgccgacccgcgtatcgtgccttccgcccgccgcattccgtccatcgattacgagtccattctggagatggcgtcctgcggctccaaggtgctggcactgcgctgtgtggaatacgctcagcgtttcaacatgccgctgcacgtgcgttcctcgttctcccgtcgccccggcacattggtggtgcccgacggcattgacccgcgtacgctgccgaacctcgactgagcgcggctacagcgaacgataatcgtaagtaatttcaagcaagacaaggcaagacatgactgaagaagaagcgaaatccatgggcgacctgttccctgacctgggccccgaggcaccggtgatttccggcattgcccacgatcgttccgaggcgctggccaccgtgcgtggcgtgccgaacgagccgggtatggccgccaaggtgttcaccgagctggccaccgccggcgtgaacgtggacatgatcgtgcaggccggcgcatccgtcggcactgcggacatctccttcaccgtgcccgaatcggccgtcaagcaggttcagaacacactgctcgacaagcaggaagtgctgggctaccactccttcgatgtggacaccaacgtgggcaaggtggccgtggtgggcgttggcatgaagacccacgccggtctggccgccaagttcttccaggccctgagcgacgagggcatcaacgtgctgatgatttctacctccgagattcgtatcgccgcgctcgtgccgctcgatcagctcaacgacgccgtcaaggcgctgcacaccgcatacggtctcgatgccgatcaaatcgaagccgtggtgtacggcggtactggccgctgagccactgagccgcgtttttgcggtatatacgacgaaagccctccttgcggagggctttctcagtttcggactcagtttcaactacttcttggtgatgtagccgagagccttgagcatttcggcgcattcaagggcaccgccggctgcaccacgcagggtgttgtgggccagacccacgaacttccaatcgaagatggaatcctcacgcagacggccgatggaaacgcccatgccaccctcgtagtccacgtcgagcttgacctgcgggcggtcatcctcggtgaggtactggatgaagtgcttcggtgcgtgcggcagctccagctcggaagccttggacgtgtagttcaccagacggtcgatgagctcttccttggtggccttcttgccgaagttcaggaacacggtggcggtgtggccgttgagcacgggcacgcggatgcactgggaagtgatcttgaggtcgccgtcgaacggcacgatctcgcccttggcggcgtccacatgaccgaacaccttgagcggttccttctcagacttcgcttcctcaccggagatgaacgggatgatgttgcccaccatctcgggccagtccttgaaggtcttgcccgcgccggaaatcgcctggtaggtgctcacaaccacctcgcgcggctcgaattccttccacgcggccagcgccggcgtgtaggcctgaatcgagcagttcggcttgacggcgataaaaccacgagtggtgcccaggcgcttgcgctggtgctcgatcacctcgaagtgctccgggttgatctccggcaccaccatcggcacgtccggggtccagcggtgggcgctgttgttggagaccaccggggtctcggtcttggcataacgctcttcaatggcgcgaatctggtccttcggcatgtttaccgcagagaacatgaaatcaacgccagaggccacggactcggcatcgtcgccatcgacgaccaccatgttcttggcatattcgggcatcggggtttccatcttccaacggtcgccgacagcctcggcatacgtcttgccggcgctgtgcgcggaagcggcaagcgtgaccacctcgaaccacgggtgattctcaagcagcgtgataaaacgctgaccgaccataccggtggcaccaaggatgccgaccttcattttttcggacatgatgacctctatgacctctgggtttcgatggattacttacgtcggacggccgtcatgcgggtggccgtaaaacaatgcaattgtacgaaacacgcggaacaacggcagtggtcttcccagatggtggctgcccaatgaagcgaaggcgatgttctacactggtagccatgtctatcgcatcagtagaggcccaaaaacagctcgaccgtatcgtggctctcggctacccggatgtggcggatatttccgccgccgcattccgctcgctggcccgacctctgatcggggcgctcgagcattccgatttgggatcgaacatcctgctggtgcccacgcgtgaactggtttcgcctgagtcgctgattgcacgaacctccatcaatcgcatggcaggcttcaccaccatgccgccgcgtgacatcgccagcttcctgcctcaagacggcttcatgccgccggaaggcccgttctatctggtcgtcaatccgcacaccggcacgtgctatgtcaatcgcgagccggatgtggcccgcaaacttattgactccgatgagcgcctgccgctcaccctcgaggaaggcttggccatcgccacccagcacccggagtggctgctggaaaagaacggcttcaatctgctcggctcacgctccgcagacggacgcgtgccgagcatctggatgagccagaacgcaccgcgactgggagccgtctggcccaattcccgccatacttggctgggcaacgcgtattgcacggcccgtcgcggggtgagcctgtttaagtaggtttagcgcgcggccttgatcagcgaacggatgatggctataaagccaaggctcatcgcgccggccaccacggcgaacacctgcgggcggcgcagctcgttgcgtgcgctgaccgctccggtaacgcaatgatcctcgaaccagacgcgcagctcgttgctggagtagcggccgaccagattaccccatgtgagcatgcgggtcacatagcccgccggattgctctcatggaattcaaacaggcgaatgccgcggtaccgcgacttgggaccatagcattcgaacccgcacgtgggtgcatagcccagatcgatatcatgcacatgaccaacgaaagagttcttatggtcatgcccgcagaacagcgcgaaatagccgccagcctcgcgcaaggcatccacctcgcccacattctcgtccgcgcagccgatcgcctcgccgagccgcgagccggggcggcagacctcatggttgagcacatagcaacgcccggcgtgcgtgcgcgcgccttccacggcgttcggcgtccatgcgggcacttccttcagacaatcgtagaattcctgcggcggaatgtgctggaaggcgatggccggcacgggcttgccgtcgccattgcgctcgcccaactcggtttggacggaccccagccattcgatggccttgggggtgggggtgccgtacccgtcggcgtcggccaggtcgagtcctcgcggattgaccacatacgccgggtattgggcgtcgttttcttcgggtttgccggcataatcgcctgaattgaccatcataacggacatggccacgcggccggaaccatcggaggactcgacgggcagcgcgaacgtgccgggctcgagactgtcgtcggggttcaggcagccggggtattcgcggtagatgtcatcctgttcgtcggccagaatgccgcattggaagtcgtggttgccgtaggtggcggcaaagggcacgccggcctcgacgaccggaccaaggaaaccggagaacgtgcggcggaccttttcgcgggtctcaatcatgagttcgtcgagggtcgccggcgtctcgtgtgcggggctggccttgccggattgcgttgaatatacgagggtggaaaccgtctcgggcgtggggctggtctcaacggaatcgcctacttcggaagtcgtgatcacgtcggtcgaatcggcgccggcagcggcgacggcgttcgtcacggtatcggggtcaagcagcgcggctggtacaggcttgccggcttcggtgagacgatcggccacgcgatcggatgttttgcgaattacggggtgacgcttgatcccgcggattttggcctcgatctcggtgaccgcgcgcacgcgagcgcccggctcttcgccgcggcggcgcaggaacgtgtcgatgtaggcgggatcatagccgcggatctggtcgccggtgaacaccacaagatccggatcggcttcgcggatggcctcgcggatgaggcggatggtgtcgggcaacacatcggggccgtcctgtacgtcggccatttgcagcacgcggaagctgccgtcttcgcggaatcgcaagctcgtcatagctcttcagtctatgttgccgggcggcggatcgcccgcgcgttcacaggactggcacagcaagggacggggcagggcggggtgccgcagccgtgttgttgcttgatggtgccgcgattttgtcatgcagcgtcggtggagatccagacagcgtccctatgctgacgttctgagaccattggcgtcgttactgattcatagaatggcccggcgccgacgctcaaagaggctagcgtcggcggtgggccaatatttgtcgcgttgccgatggttgtgggcctcgtagcgtcggtagtgtgccatagcctggcaatttgccgacgataagctttcccagagtcggtatttcgccataagttggtccgctgacgacgctgagccgtttggctgtcggtgcagtaccaatatttggcccgccgccgacgtatggagggccatctggtggggtatcgcaggcggggtgttgtgccggagtcaaagcgtggcccggcgccgacgctgagtgccctcatgtcagccaggtgcataagcaaatgccacgatacggcatttcccgcgggtttgcccgaaccggcctgtaggatgttacgtgcgtattgacaaatccgcgtggcccggcgccgccctggcacaacgccgcagtcgcgtccgcaagagggcccgcgcaataaccagtaaaggaggaacaatgggtcaggatcaatcatccgtttttgatctcgcagcggtagccgcagcgtccaatggggggaacaacgacccgctgctgcctccggcgcgattcattggcgatccgcagaagccgagtcgtatgccgtacaacaagtacgccgcctacgacaagcagatcccgtttgattacccggagcgtacgtggccgggcaagcgactgcagcgcgcgccgcgctggtgctccgtcgatcttcgcgacggcaatcaggccctcgtcaacccgatggattccgagcgcaagctgcgtttctggaacctgctcgtctccatgggattcaaggagatcgaggtgggcttcccgtccgcttccgagaccgatttcgacttcatccgtatgctcatcgagcgtgagctgattccggacgacgtgaccatcgtggtactcacccagtgccgcgagcacctcatccgccgcacttacgaggcgctcaagggtgccaagcgcgccatcgtgcacttctacaactccgtgtctgtgttgcagcgcgaggtcgtgttccgcaagaacaaggaggagatcaagaagctcgccaccgacgccgccgaactgtgcaaggacctcgagaacgaggccaagggcatcgacctgtactacgagtactcgccggaatccttcaccggcaccgagccggagtacgccgtcgaggtgtgcaacgccgtgatcggtgttatcaagccgactcccgagcacccgatgatcatcaacctgcccgccaccgtggaaatgaccacgccgaacgtgttcgccgacgaagtggagtacgtctccacccacctcgacgaccgtgactccgtggtgctctccctccacccgcacaacgacgaaggcatgggcgtggccgccaccgagctggccgtgctggccggcgccgaccgcgtggaaggctgcctgctgggcaacggcgagcgtaccggcaacgtcgacttggtcacgctgggcctcaactggctcacccaaggcatcgacccgcagcttgacctgtccaacgtgcccgagattcgcaagacggttgagtactgcaaccagatcaagatttccgagcgtcacccgtacgccggcaacttcgtgttcactgcgttctccggctcgcatcaggacgccatcaagaagggtctcgaggctcgtcaggtggccgccgagcgtgctggcgccgatctcgacagcttcgtgtggcttgtgccgtacctgccgattgacccgaaggacatcggccgcacgtacgaagccatcattcgcgtcaactcgcagtccggcaagggcggcatggcctacctgctcaagaccaaccacaatcttgacctgcccaagcgtctgcagatcgaattcgacaagatcgtgcagaactacgctgacacgaccaagaaggaagtcaaggacgaggatatctggcgtctgttcaaggacgagtacctgccggtcgaacagtccggcatgaccgccgccggtgtggttgtgggcgatactcatgacgcctcgctcgtgccgtggggccgcttgaagctgctcaaggtggccgtcagctccggtgaggatggctccgacaccgtgctcaaggctcgtctgctcgaccgcggcgtgaacgtcggggtcgatgcgcccgtggagcgcgaggtctccggcatcggcaacggtccgatcgccgctttcctcaacgccatttccaactttggcgttgacgcctcgattatggattacgcggagcacaccatgtccgtcggcaccgacgccatggccgcctcgtacgtggaatgccaggtcggcgaggccgatgacgcgcagatcgtgtggggcgtcggcatcgattcgtcgattaccactagcgccctgaagtcgattatctccgccatcaaccgttcccagcgcaagcgctgagcgctaacagaacaaaaacaaggctccctctgattgcatcagagggagccttgttgtctgtgttttacttactactgagtgacgccgttggtgccggtgttcccgccggtgcctccggaattaccattatcgttgccggtattgttcccgttgtcaccgccggtattgttgccggcgttgccatctccgccggtagtggtgccgggataattcgggcactcggtggaatagctcggattggcgaggcactgctgggcgaactcctgagcctgctgttgcttcttggcttcctcttcggccgccttctgctgtgcgtcctgctcagcctgcttctgcgcgtcttcggtggactgcttgttggtgttgttggacaggccgctgctctgtcccttgcccaagccccaagtgccgtcggagccgccgatcttgccgttgtctttagcggtcgggaactgctccgcctcggtgccttgcaaggcctgagccatgaactcctggaacaggtgggcggggtatccagtggaagagacgccgtatccggagaaggctggcaccacttgcggattgcccttatcgtccggattccagatagcccacacattcatcatgctgggggtgtaccccacgaacgacgaagccatttcgtcgttggcggtaccggacttgccggcgacgggccggcccaacatgctggatgtgccggccgccgtaccgtacgtggtggtgccctgcatggccttctgcaccaaagcgcagtcgttggcatcgaacaccttggtgccgttgctgggcgcgttgtacatgtccttattgttggaatcaagcactttggacaccatgtgcaaggtgttcttcacgccattgttggcgatggtcgaatggccttgcgccaaatcccacacggtcagggcgttgatgcccagcacgttgtacatggagttttcatcgatatcgccctgaatgcccgcttcatgggcgattgcggccgtgcgcttcggcgtcagatgctcattgacgttcatgaacaccgtgttcaccgagttggcggtggcctgatacagattgatgttgccccagttgttctccagagcgttgttcacctcttgatccaagccggtgaagtgctggtgggaattgccgttgaacaacgtatcgaagctgacgccggattgcgcggcccccagcaaagcgaacggcttcatagtcgaacccggttcgaatacggcctgatcggcattgttgagctgcttggacagataatctgaaccggcgtatacggacaatacttcaccggtcttcgggtccagcgctatgccgccgatttgcagggattcaggcatgtcgtccagacgggtgtcgccgatggactgcataagatcctgcttgctcttgtcgatggtggtgatgatcttgtatccgccagtatccaaatcctctttggtaaaggccttggactgcaccagctcgcggcgcaccatatccagcagataaccgttcggccccgcgtattcgttctgctgcgccaccgcggcggtctgcgggaacttggcatcagtgtgctgcttggcagtgatgtaaccatcctcctgcatgatgttcagcacacgcttgaagcgcgatttggccatatcggcgttatcggccggatcccacgtggacggtgacggaataatgccggcgatcatcgccgcctcagacagcgtcagatccttggcgtccttattgaagtatgccttggccgctgcctggataccgtaggagttgcggcccagatagatggtgttcatgtaattgcacagcacctcgtccttggattcggtctgcgcgattttgatggccatgatggcctcgcgcgccttgcccacataggatgtggtttcgcccatgtaataccgctcggcatactgctgggtgatggtggaaccaccttggcgcgtgcccttggtcacattattaatgaatgcgcgggcgatgcccttcagatcaaggcctttatccgtgtagaacgtacggttttcggacgccacaatcgcgttgccgatgtagtccggcagcccctcgcaagagatgatttcacgattctgttccgcgtaggagccgatcgcggtggtgccgtccgcgtaatacacggtggttttctcggccaacgcgaacttttcgggttgcgggacctcggtggtggtgtacaggtatgcgaatactgcgataccggccagcaagcccagtccaatcagggagaagaagatgcccagcacccatttcagtacacggtgcttgccttttcctgtgttctttttcttcctgttcggggctcgatggctattggaagccttgtggcttgcgtggcgggaacggctctcctggggcgtataggggccctcctgtgcggagtggccggctctgctttgcgcggtgcgcggttgcctcagagcggggccattgcctcccgaatgtgcacgacgagtataagaagccatggtgtccaccgtaactgttggccttgaacaatcgtttgacgtgagcgtaaccacacgcatttatgccggtattttttccggaattcttacaattgggcacgcttcttgatgttgcatgaatattgcctgaatgcgctggttggcctgtcgtgcgacccggcgcgcacgtttcgtgtcgctgcgctggtccatacgtctccatagacttatccccagcctccacgcggcgctatgtcacccaactcccccagggcaggaatgcagcaagggtaagtggcctctgacgggtgcgtggaggttttctttatgtgcggatttggctgtgagctggcactagcgtggtcccctgtccggggcgcggccgtacagtcgaacgtatgaatgacgcacagacccctagaattcgcgacccgcatgcggcggtcaatctggtcggctcaggcgcagcacagcctgactcgtcgtcgaacgttgttgacccattggctgcgctcggcccggtctccggttcagatgcatcggcatccacatcaggctccttacgggatttcaggccgctggacatggacgatgcggatggggcatctgatatcgaccgcgccttggcccggcttgacccgcttaccgtgcgcccgcgaatctccagccgcgtactgtgcgtggtattcggtctgctcctgatcgctatcggcttcggcgtgtggtgggggtgcgtgtttaccgaaaacggacaatcgtacgacgaactggtctggaaaaacctgcacaacgatgtaccgtcctgggccaccggcgtgatgaacgccgtcgcacaatcctggctggttatcgctgtcagctgcacaattgccgcaatctgtatttcgtcaagtcggtgtttcgtgtttagtcatgtatttttttcgggtttagcgttgttgaccgtcctgtgcgcggtcttcgccgtgtactgcctgttcccgttcgtgtacctgctgatcaacgcgacgaagacacaggccgacttcaccagtacgttcggcctggggttcggcaagacgttcgctttgttcgacaacatcgcgaccgtgttctcctatcaggacgggatcttcgcgcgctggctgttcaacacgatcctgtacgtggtggtcggcgccggcggcgcgaccctcctggcgatcatgggcggctacgctctggccaagttccgcttcccggggcgcaaagcggtgttcgtggtcatcatcggcgcgatcagcgtgccgggcatcgcgttggcggttccccagttcctcctgttcgccaaattgggcctgacgaacaccccgtgggccatgatcatcccgtcgctgatcagcccgttcggtttgtacctgatgtggatcttcagcgagcaggcggttccgacggaattgcttgaagccgcacgagttgatggagcttcggagttccgcacgttcttccaggtgtccctgccgctgttggctccgggcatcgtgacgacggccctgttcacgatcgtggcgacgtggaacaactacttcctgccgttgatcatgctcaaggacgcggactggtacccgctgaccatcggcctgaaccagtggaaggaccaggcctcgaccgcgggcggccaggcgatccagaacctggtgatcacgggctccctgatcacgatcatccccctggtgatcgcgttcctgtgcctgcagaagtactggcagtccggactcgccgcaggcgccgtcaaggagtgaccgtactttggctcccttctggtggagggagccgagataaaggcataaccactaacagaaggaggcacctatgcagatattcgcattgttgagaattgtgcaggtgcctccttgtgtgtctgtgcaacgtgaggaatttattcccgcggacgcagattatcgataaaattcaataaaggagctgaatcatcatggaacgtaaagagttcaagtggccgcagccgcttgcgggcaacaagccccgcatctggtacggcggcgactacaaccccgaccagtggccggaggaagtctgggacgaagacatcgagcttatgcagcaggccggcgtcaacctcgtctccgtagccatcttctcctgggccaagcttgagcccgaagaaggcgtgtacgacttcgattggctcgatcgcgtcatcgacaagctcggcaaggccggcatcgccgtcgatctcgcctccggcaccgcatccccgccgatgtggatgacccaggcccacccggagatcctctgggtcgactaccgcggcgacgtctgccagcccggtgcccgccagcactggcgcgccaccagcccggtcttccttgactacgcgctcagcttgtgccgcaagatggccgagcactacaaggacaacccctatgtggtctcttggcatgtgagcaacgagtacggctgccacaaccgcttcgactattccgaagacgccgagcgcgccttccagaagtggtgcgagaagaagtacggcaccatcgacgccgtcaacgacgcttggggcaccgcattctgggcgcagcgcatgaacaatttttccgagatcatcccgccgcgcttcatcggcgacggcaacttcatgaacccgggcaagctgcttgactggaagcgcttcagctccgacgccctgctcgacttttacaaggccgagcgcgacgccctgctcgagatcgcccccaagccgcagaccaccaacttcatggtctccgccggcggtgccggcatcgattacgacaagtggggttacgacgtggacttcgtgtccaacgatcactacttcacgcctggcgaagctcacttcgacgagctggcttactcggcctccctatgtgacggcatcgcccgcaagaatccgtggttcctcatggagcactccagctccgccgtcaattggcgcccgatcaactatcgcgtcgagcccggcgaattggtgcgcgactccttggcccacttggccatgggctccgacgccatctgctacttccagtggcgccagtccaaggccggtgccgagaagtggcactcttcgatggttcctcacgcgggccccgactcccagatcttccgcgatgtgtgcgagctgggtgccgacctcaacaagcttgctgacgagggcctgctgagcaccaagctggtcaagtccaaggtcgccgtcgtcttcgattacgagtcccagtgggctacggaacacaccgccacgcctactcaggaggtgcgccattggaccgagccgctcgcgtggttccgcgcgctggcggacaacggtctcaccgccgacgtggtgccggttcgcggctcctgggacgagtacgaagccgtcgtgctgccgagcctgaccatcctgtctgaagagaccacgcgccgcgtgcgcgagtatgtggcgaacggcggcaagctgttcgtgacctactacaccggtctggtggacgacaaggatcacgtctggctgggtggctaccccggttccatccgtgacgtggtgggcgtgcgcgttgaggaattcgccccgatgggaaacgacttccccggtgccatggaccaccttgacttggacaacggaaccgtggcgcacgatttcgccgacgtgatcacttccgtggccgataccgctcacgtggtcgcctccttcaaggcagataagtggaccggtttcgacggcgctcccgccatcaccgtcaacgacttcggcgacggcaaggccgcatacgttggtgcccgtctcggccgtgagggcttggccaagagcctgcccgcgctgctggaggaactcggcatcgagacttcggctgaggacgatcgcggtgaagtgctgcgcgtcgagcgtgcggacgaaactggcgagaaccacttcgtgttcctgttcaaccgcacccacgatgttgcggtcgtggacgtggaaggtgaaccgttggtcgcctcgctggcccaggtcaacgagtccgagcgcacggccgccatccagcccaacggcgtacttgtcgtcaagctgtaaaaccgcgcatagcgcctaattactcaacggctctcttgctgctcatcgcagcaggggagtcgttttcgtatctccagcaaagtcgggtagggtggtcaccgtgcgaggcaaaaacagagtgacgatggcggacgtggcccatgaggccggtgtttcggtagcctcggtgtctaattttctgaacaaacagccatatatgagcgaggcgatggccgcgcgtattgcggaagccatcgaccggctcggatacaaagtcaactcgtcggccagaaacctgcgttccgggcgtacccggttgctcaagctggtcattcccgatctgcggcaggtgtatttctccgaactcgccgaggatattctggccgaggcccggcaacatggctacggcgtcatcgtggaatccaccaccaacaatcgtgcccgcgagctggaaagcatcgcatcgatgggcacgcacagcgcggacgggctcatcttaagccctctgatgatgacggttgacgatatcgcggctttggatggcgattacccgctcgtgctgttgggtgaacgtttgttcggcgtcaacgcgccgcacgtagtgattcgcaatcgcgaaggggccgccgccgcgacttatcacctgcttgatgccggttgccgccgcatcgccgtagtcggtgccgtgccccaccccgagcacgatttctcgtcgggctccatccgcacccacggatatcgtgaggcgctggccgcgcgcggcatcccctgtgatgacagtctgcttatcgaaacccaaggctgggggagcgccgacggtttggtcgcggtggacaccatgctggagagtggcctgcaattcgatgccgtgttcgctttgaatgacttgctggcgtggggcgtgctgcgtgaactgcgcgaacgcggcgttgccgtgccggatgatgttcgcgttatcggcttcgatgacgtggaggaatcggcctacatggtgccgtctctttccaccgttaaccccggcagggaagccatcgcccgactggccgtcgaatccatcatccaacaggtcgaatccggcagtcgcgctcctgcccaaaccatcgaggccccctatagcctctccctgcgcgagtcctcaccggcgttggcctgcgcctgatgaatccatggttcgaaatatccgaagtgaatgacaaggcccgtcaatcgtatggtgattgacgggccctggtcgtattggacttgactgtacttggtacgggcgtgactctccgtcttttagccgtggaattccacgctgatccaggagatggcgggaagcgttgccgtgcaggtgccggtggcgttcatcgcaatgccgagcggttgcggcgtgacggcttcgggcgcttcggcggtgttggtgcggtacggatcgtcctcatgcaacagttgcgccttgccgagcgcgagcgtgccgagaccgggcaggccgggcagcccggaaaggtcgatggtgagcgtgtgtggggtgttggcgtcgcggttgacggcaagcagcagaccggtgcgggcctgttcatcccacgtgactaccgcgtcgatggccggcacgtcgccgtatgcctcggtatggatggtgggggagctgatggccggagcgtaggcctggccgcgcgcgtgaagggcggcttcggcgaacgggtagaacgtggtctgccgccatgccgggccgtgttcctcggccatgatgggggcgatgacgttgaccagctgggcgcgcgaggcggaacgcacgcgatcgcagtgcttgagcagggtgatcatcagggaaccttcgaccaccgcgtcggccgcggtgtagatgtcttccagcaaatgcggagacttaggccatggctcgtggtgcaaaccctgcgcggcctccgccttccactggtcttcctgctcgttccacttgtccgaataccatacgccccattcgtcgaaggacagggcgatgtctttggtgccgttgttggcttctcgcgcctgatcggccgcgtccgagacggtggcgatgaacttggtcatgtcttcggaagaggccaggaagtcctgcatggaggcggcggcccgggttttatggccgcggtcgaagtagtaggcatggcaggagacgaagtcgagattctcgtaagccttggtgagcacggtcttctcccacgtgccgaaggtcggcatataggcacccgaggaaccgcaggccacgagttcgagaccggattcggcgagcttcatggcgtgggccaccttgtccaccgcgccggcatattcttccgggctcatgtggcccacctgccacgggccgtccatttcgttgccgatgcaccacatcttgatatccatcggctcctcgatgccgttggccacgcgctgatccgcccaagcggtgccgggcgcgccgttgacatactcgagctcgtcgagcgcggctttcagcccccgggtgcccatgttgacggcaagcatgatttcggtgccggctttctggctccagcggtagaagtcgtcgatgcccatctcgttggtttcggtgcaatgccaggccaggtcgcggcgcacggggcgattctcgcgtggaccgatgccgtcttcccagttgtagttggatacgaaattgccgccggggtagcgcacgcaggtgacgcccagctccttgaccaggtcaagcacgtcttggcggaagccgttttcgtcggcggtgggatggctgggctcgtagatgccgccgtagacgcagcggcccagatgttctacgaatgagccgaacagacgcgggggaacgtcggctaccggagtggcgtcggcgttgagggcgatgctggcgtccggcgtggttgcgttgccagttgtggagacgttactggccgtggtgccggcggcggtcggcgccgggctgctttcctgcttgtcgggatgggtggtttcggcggaatactggctgttgtgagtggtcatgagcgggatgcatctccttcggtttgcggttagtcaccatggtgcgacgtgtcgtgtttgcgtaaacataaaacatgtggtaccgtttcttaaaacgatacaaggcttggaacaaaacgccaagtcccgtcgtttcccataacaaggaaggaaagaacgatgaagttcggcaagaagacaattgccctgattggtgctgtggccatgctctcctctgtagctgcctgcggttccacttctgccggggatggcggaagcaccggctcctctgataagaaggtcgagctgaccgtgtggtcctgggattccacactgcctcgtacggtcaagggattcgaggccaagaacccgaacattaaggtgaaggtgaccaacgccggcaccaacaaggacgagtacaacgcactgtccaacgccatcgaggcaggctccggtgctccggacatcgcccagatcgaatactacgcactgcccgaatacgtgattcgcggccacctcgagaacctttccgatctcggtgcctccgatttcaaggacttctacaccccgggcacgtggtcctcggtgaacatcaatgacggcgtctacgccctgccgatggattccggcccgatggcctggttctacaacaagggcgtcttcgacaaggccggcgtcgatccgacccaggtgcgcacgtgggacgacttctacgaggctgccaagaagattcgcgccgtggactcctacatcacctccgattccggtgacgccggcttcttcgactccatgacctggctggccggcgcgaccccgttcgagacctccaaggacggcgagaccgtgaccatcaacctgaccggtgacaagaacgtcaagaccttcaccgacttctggcagaagatgatcgacgaagacctcatcgacaccaagaccgtcggctggaccgacgattggaacaagggtctggatgacggctccatcgcatccctgctgaccggcgcttggatgccgtacaacctgctttccggcgctccgaacggtgacggcaagtggcgcatcgcccagatgccgaccgcagatggctccgagaccaactccgagaacggtggttcctcgctggccatcgtgaagtccgacgacaaggccaaggtcgccgccgcctacaagttcatggaatacgcctgccacgacgccgagggcattaagacccgtgttgacggcggtgccttcccggccgacaacgacaccctcaagtccaacgacttcctcaatatgacctccctgaccgactccgacggcaaggcccacgagtacttcggcggtcagaagttcaacgaggagctggccaaggccgcagccaatgtgtccaccggctacaagttcctgcccttcgaggtctacgctcgcggcaagttcggcgactacgccggcgatgcctacaccggcaagaccacgctctccgatgccgtggcttcctggcagaaggacctgcaggattacgccaagcagcagggctaccaggtgaagtaacggcaatcacagcagacttcctcctgtggtttctgtagcgggaggttgcgataacaggatcgggcactcttcggagcgcccgattttcttatgccatgggagcagtggcgcgcggattgcgataccaagatggcgtgttgccgaagaatgtgtataataaaagatgttatcgcaaccatagctacaaagtggcgaaacaaagccgttttgtgactactgaaccatagagtgatggttcacgatagcatgacgacgaggagagttgccatgctgttgtggtgacaatcactgcagaccgccgaaaggcgatccaaggaaggagaacagaacgatgaagttcaccgttgctaagaaggccattgcacttaccggtgcggttgccatgctgggttccgttgccgcctgcggttccgacaccgccagtggcaagccggctcaagataaggacgttaccgaaatcaccgtgtgggcttgggagcccacgctgacccaggttgccaaggacttcaccaagaagaccggcatcaaggtcgatctcaagaacgtcggcaccaacaccaaggaatacacccagcttgataacgccatcgaggctggctccggtgctccggacgtcgctcaggttgagtactacgccatcccgcagtacgccatcaagggcaacctgctggacatcaccgacaagacctccggctactccgacttctacacccctggcccgtgggcttccgtgcagttcgccggcaaggtctacggcctgccgatggattccggcccaatggccttcttctacaacaaggaggtcttcgacaaggccggtgttgacgccgagcagatcaagacctgggatcagtactacgacgccgccaagaagattcacgctctgggcgacaactactacatcacctccgacaccggtgacgccggcttcttcgactccatgacctggctggccggtgcaaagccgttccagacctcttccgatggttccgaagtcaccgtcaacctgaccgaggacaagggcgtcaagaccttcaccgacttctggcagaagctgctggacgagggcctgctcgacaccaagaccgctggctggtctgaggactggttcaagggcatggtcgacggcaccatcgcctccctgttcactggcgcttggatgcctgccaacctggccaactccgctgctgacggcgctggcaagtggcgtgtgacccagatgccgaccgctgacggctccaccaccaactccgagaatggtggttcttcgctggctgtgctcgcctccaccaagaaggctgacgctgcttaccagttcatcgagtacgccaaccacggcgacggcgtggccacccgtgtggccggcggtgcattcccggctgacaaggcctccatggagtccgactccttcaagaacaccactactgtgaagaacgccgatggcgaggacgttgactacttcggtggtcagaagtacaacgaggttctggctcaggctgctgagaacgtgtcctccgactaccagttcctgccctacgaggtcaaggcccgcaccatcttcggcgactaccttggcaagtcctacaccggcgaccagaagctgactgacggtatcgccgcttggcagaaggcactgcaggattacggcaaggatcagggcttcaccgtgaagtaagccttgaaccctcgctgagactgcctagctaatctcacctgatacacaaagccccgtgacgaatcccgtcacggggcttttaccgttttaagccccgcctagtacactcgtcaccatgcgagtgatcggacagcgaatcaaaagaatggcaaccatagcagtgactgccatcctttccgtatccttggcctcgtgcgggcagtccaccaccgataaccgcacggaaatcagcgtatggagctgggaaccgagcatgggcgaggtcatccgccgtttcgaaaaagccaatccggacatccgcgtgaaatggaccaacatctccggctacggcaatctcaacaccgccattcaggacggttacggcacgccggacgtggctcaaatcgaatactatgcactgttgcagtacgcggtctccggccaattgcttgatctgaccgacaaaatcggctcggattattccaacttctttaccctcggcacatggtcgtccgtgcagctcgccggccgtacctacgggctgcccatggattcgggcccgatgggcttcttctacaacgaagacgtgttccgccaagccggcgtggacgccaccaagatcaagacttgggatgactactatgaggctgccaaaaagctcaaggagattggcgtgtacatcgccgccgactcgggcgatggcagcttttacgatgccatggtctggctcgccggcggccagccgttccacacgtcggccgacggcaaaaccgtgaccatcgatttggatgaggacgccggcacccaacggttcaccgaattctggcagaaaatgatcgatgaggggcttgttgacaccacctccgccacatggtccgaccgatggaagcgccgtgtgggcaccggtaccatcgcctccgtattctccggagcctggatgccgtcgctgctgctgtccaatgtgccgggcgcggccggtctgtggcgcgtggctcccatgcccacctatgatggccagcccaccaacgccgaaagcggcgggtcggcactgaccgtactgcaattgacccgtaagccggatgcggcctatcgtttcgtggactttgtggcgcatgacgcccaaggcattagcgcgcgtgtggatggcggtgctttcccggccgattatgccaccctgaattccgctgattttttggataaaaccacgattaccaatgaccggggcattgaaatcccgtatttcggcgggcagaagttcaaccgtgtactgtcggaggccgccgaggatgtgtcggtcggataccagtatctgccattcgaagtgtatgcgcgcagtgacttcaaatcgacggtgggccaggcatacgagtggtccggcagtttccacgcctatcagcagcgacaggaagccattgagatgggcatgaaggacgaggaaggcaacccgctcgaaccgttggagaagcccggcaagaaagtcagtctctccgacggcctggcccaatggcagaaagacctccgagaatacggcttcaatcagggctttacgattaagtagggattcggggttgggtcggaatcgaccgcgctatacgcggccgattcctgcatactacgtcacttcacattgcgcgagtagatgtgcgccatgcccttgaaaatcaaatccgggtcatacacgtcaatcagctcggtgtcattctcaaacactcgaccgaggccaccggtggtgatcaccttgaaatcctcgcctccgagctctttgcggaactgacgaatcgtgcgctccacaccgcccaagaacgtgtaatacaaaccggcctgcatgcaggtcttggtgttggtgcccagaatcgtatctggtcgcgtaatttccacttccggcagctgggccgtatctccccacagagcggccgcaccggcacggatgccggtggtgatgacgccggaatcgaccacgcccttgtcgctcacgtgtgtgaacgtggtggcggtgccgaaatcagccaccagcactgggccgccatactcgtaataggcaccggcgcagtcggccagaatatccgcacccagcgatttcggatcgtcaacgcgcacgttcataccggtcttgatgcccggtcccaccaccatcggatcaatgtcgaggaatttgacgatggacgaacggaaggagtgcatcactttcggcaccaccgaacagatgatcacatcgtccacatcggatggctgaaaaccgctcattctcaggaattcagtcagaaacagcccatactcatcagacgtatggttggctttggtggtgatgcggtaggtgccggcgatggtatcgccatccaaaaagcccagcacgatgttcgtattgccgatatcaacggcgaccagcatgataaccctccagattcaagatggatttcatgcgcaattctacagtcccatggctatgatggcctgcggtggtcgacccagcgtggcggccaaccgtagaacacaacatatacagaggaagaaccatgtctcaagacaatggtgcgcacgtcgaagacggcgcaaccacagatgcgagccttgcctcgcgcgcaaagaatccgaaaaaaagcggcccgaagtggtggctgatctcactgattgccgtcatcgtggcagtggcggtcgtcatcggcgtcacgctcgctttcggcggtaagaaagatgacaagtcggcttcgtccagcaaccaatatgccgacaccgtgaccatcggcctcaaactggcccccaccaatctggacatccgcaacaccgccggctccgcgcttgaccagatcctgatcggcaacgtatacgaaggcatcgtggcacgtgactccaagaaccaggtcgctcccgccatcgcctccagctgggagacgtccaaggacggcctgacctacaccttccacctcaataagaacatgaccttcttcaatggcgacaaacttgacgccgaggacgtggcctggtccatcaacgagctgatcgctaagggctaccacgacgccgacgcgctcgccgccgtcagcaaggtggaggccaaggacgccgacaccgcggtgatcacgctcaagacgccgaactccaacctgttgtggaccctgaccggtcgcgcagggctcgtgttcgacaaggacgccaagtatgacctgaagacgcaggccgtcggctccggcccctacaccgttgccaagttcgtggaaaacagctcgatcacgctgaaggccaatgagaagtactggggcaagaacaaggccaagacgcccaccgtggtcgtcaagtatctggccgacgacaacgccgcggtcaatgcactgaagtccggtgacgtgcaggtgctcgccccgattaccgagaacctcgccgaaccgttcaagtccgattccgccaagtacacggtcaaagccggcaacggcaccgacaagttcgtgctcggcttcaacaacgcttccggttccaaactggctgacaagcgcattcgccaggccatccgttacgccatcaaccacaaggagctcatcgcctctcgcggcggtgcggacaaggcgctcggcggcccgatcccgtctctcgaccccggctacgaggatctgacgaatctgtacccgtatgatcagaacaaggccaagtcgctcatggctgaagccggctattccaccgacaagccgcttcaacttacgctgacctacgccaacatctacggcaccgagctcggagaccagctgcgctcccagctcaagcccatcggcatcgacctgaaggtgaatgtggtggagttctccacgtggctgcaggatgtgtacaccaaccacaccttcgatatttcgctggtggaccacaacgaaagccacgacttcgcatcgtggaccgatccgacatactatttcggttacgacaacaagaatgtgaccaagctgtacaacgagggtgttgccgccacctccgacaaggagcgcgatgccaagttcgccgcggccgccaagcttgtctccgaggatgcgccggccgactggctgttcaactaccgcatcaccaccgccacggccaagggcgttgaaggattccccttcgacctcaaccagaccgttctgcccctctacaacgtgacctacacgaagtagttcgttacagcaatgagctccctcagtgagggggctcattgttaatccaagtaaagtaggcattatgcgattcgtgttgaaacggctggcgttattcgtggtggcgttgttcggcctgtccgtggtggttttcgcagcattgcgcattctgcctggcgatgtggcctccgtgatggccggcgtcaactcgccgcctgagcgtgtgacccagctacgcgaacaactcggtctgaatcggccattgattgcacaatacttcgattggatgagtgcgctggcccgtggtgacttcggcacttcaatcctgactggtcgctccgtaacctccttggtaggcgcacgtgcgtccatcacctttcccctgattattcttggcctgctcatcgccttggccatcggcttgccgctgggctgtgcggcggtactggcccgcagcgcaacggtgcgtgcggtgtttcatgtactggctattgtcggcggtgccgtacctgcgttgtggggcggtctgctgctgattctgttgttcgggcgcggcgtaggattgcttgacgtgtttccctcgcaagggttcccgctggatggctggggcgcacccggttcggcgatatcagcgttggtattgccggctgtatcggtcggcatcatcgtgggagcatcgcttatgcgatacacgcgcgcggccttaggggatttagccagttccggctacatcgatatggcatgctcgtgtggcatgacgcgcactcaggcggtgttgcgtgtgggattgcggttggcaaccccgcagctggtgtctgttatcgggctgaccttcgcttcgatggtcactggcgtgatggtcatcgaaaacctgtttgcgttaccgggcatcggcaacggtcttgtgaccgacgtgggcaaccgcgacctgattgccgtgcaaagcgagctgttcctgctggccgcgttctttttgactgtcggcctcgtggtcgatttgctccaccgcgtgctcgacccgcgtctgaaaaccgctaccgccattacggaggtgaccgcatgagcaatgttcgtcgtgcgacgactggtggtcgacgggctgccttcgtcatcgtcctgcactccatgtggcgtcgtgccgagggcaaattcgcacttatcgtgctcgctctgtggttgctcattgccatcgtttccctgttctggaccccgcaatcgctgtgggccactgatggctaccatgtatgggccaagccgtccgccgagcactggctcggcactgacggcaccggcgcggacgtgttcagctggctgctggccggctcacataccaatcttgtgatcgtgctgctgaccgtagtggcatctatggcttgggggctgctgctcatcgcggccatggtggcgcgcaatgcggcgctcgccagttcttcggtagtggtagttgatgcgttgatttccgttcccaccgtgttgattgcgttgattctggctgtgccgttgggagcgtcaatcgcggtgattgtgatcgcctgcggcttcggatatgggttgaatctggctcgtgtggctcgccccgcagcgttgctggcgtcccgctcgtcatatgtggaatcggccttggccaatggtgccagcgggtggcgtgtgctcataagccatgttatgccgaatattctgccggtattggctgtgcaactgtcattgtcggcgggcacggcggtgttggctgagtcggggctcacttatctcggtatcggtgtgccgtccggtgtgccgagctgggggcattctctggccacttcggtcaaactcatcaacgtgttcccattaaccgtggtgtggcccggcctgatcgtcacggttgtggttgtggcgctgaatatttttggtgatgtgctgcgcgatgccatcgatccggtcaccaaccccgcattacgtgaaataggaggcgaacgatgagcgtcgatgttcgcgggctgaaaatcacgattggcggcaaaccaatcgtctctgatgcggatatgaccattgccgacggtgaacgagtcggcttgatcggttcttcaggctccggaaaatctatgattgccaaggcgatgctggggttgctgcccctgaccgctgtgactaatgggtcgattgatatgggcggcacggaaattatcggagcttccgaacgtgcgcttgccgacctgcgcggccggtatgtgggtgcggtgttccagaatccggctgcctcgctgaacccggtgatgaccgtggcgcagcagatcgccttgccattgcggttgcactatgatctgaccaaggccgaacgagccgaccgagtgaatgccttgttgagcaaggtcgggctggatctcgatatggccggcaaatacccgcacgaactgtccggcggccaacagcagcgcgtgggcatcgccacggcgctgatcacctcaccgcgattcatcatcgcggacgaacccaccaccgcactcgactccatcacgcaacgccagatcgtggacctgctgacctcgctggtggacgacgccggtgcctccatgctgttcatcacccacgatttctccgtactcgcgcgtgccaccacccgctgctacgtgctggacgccggccgcatcgtcgaatccggacccaccgccgacctgctcgccgcgccgaccacaccacaagcccagcgcctggtcgccgccgcccaaaccctcaccctccacacccccaaggaggattcgcatgagtaacagcagtgtgccgctcctctccgcccactccatcaccaaatccttcggcccgcgcaccgcacgccaccaagtcctcttcgacgtctccgccgacgtccacgccggcgaatgtctggccgtgatcggcggctccggatccggcaaatccacgctgacccgcattatgctgggcttggaatccgcggactccggcagcgtggaatacgagagccaatccattgtcggcggccgaaaatcgccgggattcgcggccctgcgccgcgaatcgggactggtgttccaggacccgttctcctcgctcgacccacgttggcgagtcgccaaatcggtggctgaaccgctgagtctgcagcgacgtgatctgaacaacaccgatatcgacgagcgggtggccgcggctctgaccatggcaggccttgaaccggcggacttcctgaaccggtacccaatcgacctgtccggcggccaggcgcagcgcgtggtcatcgcccgcgctatcatcaacgagcccaaagtgatcctcgccgatgagccgatgagcgccatcgacgtggccgcgcgcattcagatcctcgacaccttcgccgccatccgcgcggcccggccgagcaccgccatcatcatggtctcccacgatctcggcgtggtacagcacatcgccgaccgcatcctcgtgctccatgacgggcgtctcgaagagacgggttccaccgctgaagtgctcggcaacccccaatccgattacacccgtcagctcatcgaggcagcctcgttatagaccttttttggctccctctctgaggggagctgtcgaacgcagtgaggctgaggggagttacgggtgccgtcgtattcccctcagtccgcttcgcggccagctcccctcagggaggggagccgaggccgccggcgacacgcgcttgtcgcgggttgtgctatggtgtgagacatgcagattatctcatgttgttgtcgctaaccgacgcccctgggcgagcggtcagtgacgcataacttgagatagagcattcgaatcgcggcaaatctgtcgcatgaattttcatgaaatcgatggcacgagcgtaaccgtgtaacgcgcgagtcgtggttaacatgaaaaactgattcacttttcggattcaccgtacagtgagcgggaatactcgattttcaaaccaaagccacagtccattcgtctgggaacgtcggttcacgaacgcaacgcagcaaaaccccacaaccccagcaacgaaggacttcacatgaccatccacaacagcctcgcagaactcatcggcaacaccccgctcgtcaagctcaaccacatcccgcaggcggccggcgtcaaagccaccatcgccgtcaaagtcgaatacttcaaccccggcggctcctccaaggaccgcattgccgaacgcatcatcgacgccgccgaacagtccggccagctgaagcccggcggcgtgatcgtcgagcccacctcgggcaacaccggcgtcggcctggccctggtcgcccagcagcgcggctaccgcacgattttcaccctgccggacaaggtttccgaatccaagcgcgcggtgctgcgcgcctacggtgccgaagtcatcgtcacaccgaccgacgccggcccggacgacccgcgctcctactaccaggtcgccgaacgactggccaacacgattcccggcggcttccgcccgaaccagtacgacaacccgaacggcccgctgagccactactacaccaccggccccgagatctgggaggctacggaccacaaggtcacgcacttcgtggccggcattggcaccggcggcaccatctccggcaccggcaagtacctcaaggaagcctccaacggcgcggtcaaggtcatcggctccgacccggaaggctccatctactccgcttcctcacgcgacgaagtccaccagtacgacatcgagggcgcgggggaggacttctaccccaaggctttcgaccggaacatcaccgacgacatcgtgcgcgtatccgacgccgaagcctttgaaatgacccgccgtctggccggcgaggaggcgttgctggtcggcggctcgtccggcatggccgtggccagcgccatcaagtacgcgcttgccaatgatttggacgagaaccagattgtggtggtgctcgcccctgattccggccgcagttatctggagaagatcttcaatgacgactggatgcgtgccaacggctacggcgacatcgtggaacgcaccagcaagccctccctcgccgagcagtaccttaacggaactccctctgatgagggagctggggacggactccataactagctatcaaaagaatcaataccaacatccgcgctaactaaccgcacctgttttaccttcgaatacggaacaatcccgaaaggaacccaatatcatgtccgctgaatacaacgccaagttcgccaacaccgacatcgccactcgcgccatccacgccggccaggagcccgacccgaccaccggtgcggtcgtcacgccgatcttcgccacctccactttcaagcaggatggcgtgttgggcctcaggggaggccacgactactcccgctccatcaaccccactcgcaccagcttcgacgagcagctcgccgccgtggaaggcggcaagtacgcgctgagcttctcctcgggcttggccgccatcgacgtgctgctgcgctccaccatcaagcccggcgacaacatcctgctcggcaacgatgtgtacggtggcacctaccgcctgctctccaaggtgttcgtgccgtggggtgtgggcctcgacgtggtggacatcaccgatctgaaagccgtggaaaccgcattggcctccaagcactaccagtatgtgtgggtcgagaccccgtccaacccgctgctcaacatcaccgacatcgcggccaccaccgaagttgcccacaagtacggcaccaaggtcgcggtcgacaacacctttgcctcgcccgcccttcagcacccgctggccgatggcgccgatgtggtggtctactccaccaccaagtacatcggcggccactccgacgtggtcggcggtgccgtggtggtcaacgacgaggagacccgtgagaaggtcgccttcctgcagaacgccgccggcgcagtgccctccccgttcgactcctggctggacatccgcggcctgaagaccctggatctgcgcgtcaagcgccacagtgccaacgccctgaaggtggccgaatggctcgaatcccagccctctgatgtgattgagcgcgtctggtacccgggcctcgagtcccacccgggtcatgaaatcgccgcccgccagatgcacggcggcttcggcggcatcgtctccgtgcagctcgcggccggtgccgaggcggccaagcacttcgtggaccacacgcagatcttcacactggccgaatcgctcggcggtgtggaaagcctcatcgaggtgcccgccgccatgacccacgcctccgtggccggcaccaccctgcaggtgcccgccaatctggtgcgtatttcggtcggtatcgagaacgccgacgaccttatcgccgatctcaagcaggcgttggatcgtatctgaccgtactgacggtactggtggcaccgtattgacggtgccaccacgcttatcggcggactcgctatcgattggtacctacaaaaaatccccggcccacaagggtcggggattttccgttatcgattaaacatggatcgaatcagctggcgttgccgccctgccatccggtggcatccgcaccagccgggcgcaacgcctgaccggaagtcggtgtggtgccatcaacgaccacacgagtgccgatggtggcaaagtcgtacatccacttggcgtcggccacctgcatgttgatgcagccgtgcgagcctgggataccctgctgcacatagatggggtgctcgccccacatgtatgcaggaacaccgtgcagggcctcgccgccgttatagtaggaaatccacggcgtgcctggctggttgtagccttcgccaaccatggtctgcgattcgtacttgagatacacgtagaacgtgccggtatcggacagcatggaaccatcggcggtgggcttgccagaagcgatgttgaacttcttgaccaccgtggtgccctgatatgcagtggcagtctggttcgtcagatcaacatgaacccacttatcgccatttgccgtatcgaagttatgaggcacctcgacctgcttgacatcatacgggctgtctttcacagccacagtggaatcagtggactggttctgctcgatggcggtagccagacgttcgggggcgtccccggcgccagtcacttcaataccatccacgccgagtgtcttatcggcaccaatttccacgccgccttcgtctttcggcgtgatgtagacctcgcgtgtcaccttgggaacagccagttctttggttacgctgtcactggtgacgtacttggtgatggcatcgcggtcgactaccagactcatggtgccttccgccttattcaccgtgggcttgaggaatgaggcaatggtatcggccgggatggtgacgctcttgttcacgccgttgtctacggtcagtttgaggccaagcctggcattggcgtcaaactgtgtttgctgtgcgctcgcgtcatcaatcggattctttgcggtctgtagcttgaccggcaccgtcgcattttcgcccggggtcgcgacggcctccttgactgcagcattgacaacattggtatccgggcccttgccgtcctgacccgcggtgtagtcgaactgtttggtgctcttgttgtagacaacggtggcaatctgcgctcggtcggcctcatcgaccaggccggcggtgacgaattgttcggcagtctctttgtccgtggtggcggtcagagcgatatgcggctgatcgaaaatattgagcttggccacgtcgccggtcttcgcgttcaacagcgcatccacggttttatccgtgtcgacggtgacgccaaggtccttcagcgaggctttgacgctgttgccttcggcggtgaacgtcaccgtggtgttattcagccgctgcttcacagtattcgcaagttcttcgcgggtctggcccatgacagagacattgcccaaatgaacaccgggcgcagccttgtcttggaagtaccaacgtccgacgaagaaataggctattaatgcggcaagcaacactgcaaatatggttatgatggcaatccgtgcggccttgccatgtgatttagcggtggtagatgccataacatgttcacccacataggctgtattatcggcatggttattggtgccattgtcactttgctgtggtgtggcggtacctgaatccgcggctgcgaacagcccatcggtggccacaggctgcagcaccgccgtctcctgatcgtcaggagaggagaaggaaaatgtatcgttggccatcaaaatgccccgtcttagttctctcaaagcggcatatcgtgcgatatgccgggaataacgttccttgacgcataataatacggaagggctacgtacatcgttgcgaggtattccgttatacgatgagatccagccgcggtcggcctacactggtcatttatgacagcacatcaggcggcgctggaggcgctcacacgatacttcggctatgactcgtttagacccggacagcaaggaattgtcgaggctttgcttgccggacgcgatgtcttgggcgtgatgcccaccggcgcaggcaagtccgtgtgctaccagattcccgccgcgctcagcccgggtgtgactttggtcatatctcccttgatttccctgatgcgcgaccaggtcgatgcgctgaacgacctcggtctgccggccgcgttcatcaacaccactcaaactcccgacgagcaggcgatggtgttcgcccaagccgccgccgggcagatcaaactgctgtacgtggccccggaacgcttggaaaccgggcgattccgcgactttgccgcccgtacgccgatctcgctgatcgccgtggacgaagcccactgcgtctcccagtggggtcaggacttccgctcgtcgtacttaggtatcggcgatttcatcgccgggctgccgcagcgtccaccggtgggtgcgttcaccgccaccgccaccgaacgggtgcgccgggacatcgtgggactgctgggattgcggaatccggccgtcaccgtcaccggattcgaccggccgaacctgtattttgatgtggtcaaactggagaccaaatacaaggccgcatgggtggcgcggtatgtggccgaccatccggacgaatccggcatcgtctactgcgccacccgcaagaccaccgaagcgctcgccgacacgctgaaccagatggggcatccggctgtcgcctaccatggcggcatgtcgccggacgcgcgtgaggtggcccagcgcgacttcatcaccgacaaggtgccggtggtcgtagccaccaacgccttcggcatgggcatcgataagtccaacgtgcgttacgtcatccaccacaatctacccgaatccattgaagcctactatcaggaggccggccgcgcgggccgtgacggcgagcccagccgatgcacgctgctgtggaatgagtcagacatcgtcacccggcgtcggttgctggataacgattatgagaacgagcgattgactcccgaagagcaggagatcgttcgccagtccaagcgccggctgctggacggtatggtcggctactgccgcaccaccgactgcctgcaccggtatatgacccggtatttcggtcaggaattgtcgccgaatgctggttccgcggcgggtgaagacattgcggcggactcttcgcagtccggcagatgcggtgcctgctcgaactgcgaaagcacgttcgagaccatcgacgtgacccgcgtggcgcaggcgatcagccgttgcgtgcatgacgtggggcagcgcgtcggttccggcaagatcgtcaagatcctgcgcggttcgcgggcacaggatctggcatggctgaacccggagcggatgcccaccttcggcatgctcaaggacgtgaacgaagctcgcgtgcgcgacgtgttgagccagatggccacggacgggtacctgtcaatcgccgaagggcgtatgccaatcgtcatgttcggtgcgcgggcggccgaaaccgccgctcccgacttccactatgagatcaaacgggtggaacgcaagtcggcggcggccggttccggtcggagcgggggagtggctgatactgccgattccgccaatgttcccggcgatgcgctgggctcgtatatcccggacgatgacgaggaatcgctgttccagaagctacgcgaactgcgacgcaccatcgcccaggaaatcggcaagccgccgtacatcgtgttctccgacaagaccttgcgcgacatggcccgcatcaagccggttaccaacgcgcaatttctggcggtcaacggcgtcggtcaacacaagctcgacctctacggccagcgcttcatgcaaaccatcgcctcgttcaatgccgggagtgcgtcataacaatctcctatagcgaaccgcggagtatttgcgggcgttcttgggctggcgcgactacgatgactgttcgatacttcatgaccgaacactcagtaagtagaaaggcaacagcatggcagaagacaaggccgaaaagcccgtcgtcgaatcattccagcttgatcacaccaaggtcaaggcgccgtacgtgcgttacatcgacaccgaaacgggccctcacggcgacgtgatctccaattacgatctgcgcctgacccagccgaacgagcaggccatccccaccggcggcctgcacaccatcgaacacaccatcgccgtgctgctgcgtgaacgcattcccggctacatcgactgctcgccgttcggctgccgcaccggcttccacctgctgacctggggcacccaccccaccgaggaagtggccaaggccctgaaggaatcgttggagttcatcgcgtacaaggccacgtgggatgacgtgcccgccaccaccgagaagagctgcggcaactatcgcgaccacagcctgttcaccgccaaggaatgggccaagcagatccttgaggaaggcatcagctccgacccgttcgagcgcaaggtcgtctgattcgtctgattcgatccaattctgattcggctcccgctggcgggagccgggggcgaagccgactgagggtggctgtcctcaactcggctggactgtccggctcctgcggacgggagtcattgtttattagtgtccgtcatgcaacgcggaggggatttcttgtgcctacggcatggtaggttggccgtcagttagtcgccggtcaccgtgccggcaacccggcatgtcggagaggtgagaagtgactcagtcgaacgctgcaaacaaggcgacaggccgccgtttccgccacgccaccatgcgcgatctgccgcagatgcagaaaatctacgcacgcgcacgcgcgttgatggccgccaacggcaaccccacccagtggggcaacgaatttccgcgtgaatcggtgattgaggacgacatcgccaaccagcgtacgatgctgctggtcgacacctgcaatggccacgaacgcattctggcccagttcgccctgtgcccgggcgaggatccgacctacgccaaaatcgacggcgcctggctggacaacgacgcctatgtgaccatccaccgcatcgccgcatccggtctggtgcgccacgcggcccgcgactgtatcaggtgggccctgaagcactacggcaacgtgcgcgccgacacccaccccaataacaaggccatgcagcacgtgctcgaaagctccggcttcgcccgttgcggcctgatccagctgctcgaccggccggtcgacaccaccagaatcgcctatcagcgccacgagtggtgagtgtggctgtcgccagcgtgttcggttccgcggtggagctggtcaggtaaggtccacgtcgtcgcgcacgtacggtccgtcggccgcccgttcaaactcgtgcatatcgcaaaaaccgtacgctgaaagtaactcagcgtacggttttcacgaaagcagccatcggctatcggtcagccgatagacctcagtcctcagtcgcagcgaccttggtgtcagccccggccttctgctcaaggccgagcttggagcgcttgcggctgtagccgaagtacacgatcaggcccagaccgaaccagatggcgaaacgcacccaggtctcccagttgagaccggcgatgagcacgaagcagaatacgatggccagaatcggggtgaccggcacgcccggcgcgcggaagccgcggggcgcattcggctgggtcttgcgcatccatagaataccggccgacacgatgatgaacgcggacagcgtaccgatgttcaccagctcgaacagcacgttgatgttgatgaagccgccggcgaacgcggtcagcagaccgaagaaccaggtgcccttgaacggggtgcggtacttctcgtgcacgtggccgaagaacttcgggaacaggccgtcacggctcatggcgtagcagatacgggactggccgtacagctgtacgagcatcaccgtggtcatgccgatgagggcgcctaggttcacgatcaccgcgagccagttcatgccggtctccagaatcacgccggccaccggggcgtcgatgtacttggcgaactccttgtagggcaccacgccggtcatgatcagggtcatgatgacgtagagcacggtggaaacggccagggacagcagaatgccgcgcggcagcgtcttgttcgggttgatggtctcctcagcggaagaggacacggcatcgaagccgatgaagctgaagaacacgatggaagcggccggcacgatgccgtacggctgggtggagccgggctggaaagtgtagatgccgtacggggagaacggctgccagttggacggcttgacataccacacggcgcacacgatgaacagcacgatgatggcgagcttgatgagcaccatcacgtcattggtgcgcttggtctggttgatgccgatggagagcacccacgtgatgatgagcacgatgacgaaaccgggcaggttgaagtaggtggtgacgtccgggttggtgccgtaggcggcggtcagctcgaccggcaggtgcaggccgaagccttccagcagtttgttgaagtagcccgaccagccggcggacactgtggccgcctgcagggcgtactccagaatcagatcccagccgatcacgaaggcgatgagctcgccgaacgccagataggcataggagtaggccgagccggacaccggggccatggcggcgaactcggcgtagcacagaccggcaaaaccgcagcagacggcggccagcaggaacgatacggacagggccgggccggcggtcagcgcgcccttgccagtgagcacgaagataccggtgccgatgatcgcgccgatgccgagcatcgtcagatcgaaggtgcgcatcgtgcgcttgaggggagtggattcggcgacaagctgatccacgcttttcttacgaaacagatccatgttcttctctcatgaaatctaggattatggggctgaaccggacggatttccgggatcccggcacgcctcaacgccgggaatcaaaggcggcttccgagaaaccgcatatcggtcattagtgtacgactgccgggcgaaaacagacgattgcgactacacgtcacattctcgcgcaacaataggtgtctatgagcatgaacgcagcacctgaaatcgcattctcgtccgagcagggcaaggccaactatgcggccgcccgccgccaataccccgcacaggccatcgtggacctcaaaaccatgcgcgacaacatggcccacctggtctccgtggtcggcgggcccgcttccggcacggcggtgatgggtgtggtcaaggccgacgcctacggccacggactgctgcccgccgcactggccgcgctcgccggcggcgccacatggctcggcaccgcgcaatcgcatgaagcactgctgctgcgcaaactcggcatcggccccgaccgctgccatattttgacttgggtatacaacggcaccgaagtcccgttcgacgagctgatcgccgccgacatcgacgtatcggtcggctccctgcccggcatcgacgcggtggccgccgccgcacgcaagctcggcaagcccgcccgcgtacacgtcaaggtcgattccggcttcggtcgcaacggtttcacgccggccggattcgacgccgcgctcgccaaactcgtgccgctcgccaaagagggcgtgttgcatattgtgggtcagtggagccatctcgccgtggccgattcgcccgatgtgcccgaattcgtgtcctccaccgaccgccagatcgaaacattcaaggacttcacgcgccgcatggaacaggccggcattccgccggagatccgtcacctggccaacacggcggccactttggaccgcccggagattcacttcgaacttacccgccccggcatcggcctgtacggctacgagcccgatcccgcgatgggcaccccgcgcgactggcatctgaccccggccatgcgcctgcaggcgcagctcggcacggtcaaggatgtggaggccggccatggcatctcttatggccgcacctacctgaccccggacaacacctcgaccgctattgtgccgctgggctacgccgatggcatccaccgctccgcttccggtttcgatatggaaggtgccaagcacgtggagaagccgggcggcccggtgcgcatcatgaccactgaaggtccgaagctctaccgcgtgtgcggccgcgtgtgcatggaccagttcatcgtggacctgcacggatccgccgccgaactcggcgttcacgagggcgacacggtcgaactgttcggcccgggccgcggcgaggattacgttgagcctaccgccgacgattgggcccgcgccgccgacaccatcagctacgagatcttcacctgcctgcgcaaccgcatcccgcgcctttacgagcatgccgccgaagtactgcccgccgccgacctcgccaagctcgaccccgccacgctgctataaggtgcattaccgccatacggtggcaccccgtaatcccttcttcccgaatatgtgccactgacatgtgctgagcgtcacatattcgggaaatcggccccaatctcccgaatatgtgctgttgagttgacgtcagtggcacatattcgggaagtcgggattactgcggccgatatgtgtgcctatgcttggaatatggaaacgactttggatggggaacaggtgctgagcgatgagggctacagcgccttcgacgaggagcgatgggcacccgagccgcccaaatccaagtcgcgcacggctttcgaacgcgatcgcgcgcgactgattcattcgtccgctttgcggcgtttgggcgcgaaaagccagattctgattgccggtaccgacgatttcgcccgcactcgactgacgcatacgctggaagtcgcccagatcggtcgccaaatcggcgcattgctcggctgtgatccggacgtggtcgactgcgcctgtctggcccacgaccttggtcacccgccgttcgggcacaacggggagcgtgcgctcgccgacatcgccagcaatatcggcggcttcgagggcaacgcacagaccatgcgtatcctgacccggctcgaacccaagatctttcacccggacgggcgttcggccggcgtgaacctgacccgtgcggccttggatgcggccgtcaaatacccgtggaccttggccgaagccgaccgacacccgaagggggagcggtcgaagaaattctgcgtctacccggatgacgaaccggtgttccgctggctcaaaatcggcgcgccccaggccgccaaacccatggaatgccagatcatggacctttcggacgatatcgcctactccgtgcatgacgtcgaggattccatcgccaccggcgcgttcgatccgattgtgctcgccgatccgaagatgctggaccacatcatcgagcagacgcgcgcatggtatggggcgaagtgggatgccgacaagctgctggccgcgttcatgcgattgcgccgagagcatttgttccctgcacatttcaatggttcgcgcgaatcgttggcacagcttaagaacattacgtccgatttgatcggccgcttctgctggtcggtggaaaccgccacgcgcgacacgtatgggcccgggccgttgacccggtattcctcgaacatcgtgattcccgagaacacgaattacgagatcgtggcactgaagggcatcgccgtgtacttcgtcatggcgcctcgcgagcgcgagccattccatcaggaggagctcaagatcgtatcggatttggtcgatgtgcttatggctgattcgccgctcccatccgacgctttggaaagccagttcctggccgattggaacgaatccaccaacgacgacgaacgcctgcgcgtcgccatcgatcaggtcgcgagcctgaccgacaactccgccctggccctgcactccatcttgtgctgagggcgtgttgggcgggcgcttcccttagtctcgctgcgcgagccagctcccctcgggtgaggggagctgtcgctgtagacgactgaagggagtttcgcggaagaaatgataaccgacggtaaaaatttaccgtgtctcaggtgaggcggtactctagagacttatggtcggaatgattaagaaagaagatgtcgagaaggtgcgcgccgccgcggacctgtatgacattgtatctgcgaccgtaacgcttaagccctccggcaccggcaccttcgtgggcctgtgcccgttccacgacgagaaaaccggcagcttcaacgtgcgtccctcgctcggcgtgtggcactgcttcggctgcggcttgggtggcgacgtattcaaatacgtcgaacaatccgaaaacatcgacttccgcgaagccgtggaactgctcgccgacaagtaccatatcgagctgcactacgagaacagcggcaacggcccggcgcgcgagaacaccggctccaagcgcacgcgactgctggaagcctgcgaggaagcccagcgcttcttcgtctcccagatcttgaccaaggaagcactgcccgcccgcaagctgcttggcggccgcaacttctcccaagctgattgcgaacgtttcggctgcggctacgcgccgcaaggctgggataatctcgtgcgccacttggcctccaagggatttacgcagaaggaaatcctcgacgcgggcttggcccgtcaaggccagcgcggcatctatgactatttccgcggccgagtgacctggcccatccgcgattcgaccggccgcacgctcggcttcggcgcgcgcaagctgtatgaggacgaccagatcgccgccaaatacatcaacacgccggatacgcagctctaccgcaaaacccaggtgctttacggcatcgatttggccaaatccgccatcgtcaagaagcggcaggtggtgatcgtcgaaggctatacggacgtgatggccatgcacttggccggcatcgacaccgccatcgccacgtgcggcacggcgttcggcgccgagcacgccaagattgtgcgccgcctgatcgccgacgattcgctgggcgcggtccagctggtcgggccgttgaaggtcaaggaccagccgttgagctcgcgcatcgtgttcacgttcgatggtgacgccgccggccagaaagccgcgctgcatgccttcggccttgattcggccttcctctcccaaaccttcgtggccgtggccgacgacaatctcgacccgtgcgacctgcgcatcgagcgaggcaacgaagcagtgcgttcgctgatcgcccgcgccaaaccgttgtatgacttcgtgatcgacgccgccatcagccggttcgacctgacctacacgcccggccaagtgggtgcgatgaaagccgtggccccgctggtggcgcagattcgcgaccgctccctatgggacgcttacgcgcgcaagtccgcgggccgtatcggcgtggatcttgaggtgatgcgccgcgaggtgatgaacgcgcgccggcagatgcatgtacgcgatgaggacgcctacgcgcccaaacgtcgattcgagcgtgacgagccgcgtgtggaacccggcaccaacccatacgccaatccggccacgcgcaaggcgttggagcgccgtgacgccgccgaacaggtatatttcaagatcgacgacgccgtattcatcgccgaacagcagttcatggccgtgctgattcaggtgccgcgcgccatcgaccgcaccatgttcgggcagctgaccatcgaccatttcatgacttcggtgttccgcaccctgttccaggcgatcgcggccgccggcggactgccatccgacgataccccgcaggggctgtggatgcacaacctcactaaggccggcggaccgatgctgaatcaggtgatcaacgagctggccgtcatgccgttgccactgcctggcgacgacggtggtaatggcgcacaacctccgcagtcgaacgtgcctgggggagtcggcggtggtgcggccgccgtgcagctacgccctgccacgccggaagagcagcgctatgccaccgaactgctcacccgattgttggacatgggcttcatgcgccagatcggtttggccaaacgccgcatggcccagctgcccgacggcgaagagaagataaccctcctcggccagatcacccgcatggaaaccgcccgtaaagacctccaagcccaaatctacggcaacaccgttggctagtaatctctccctctgacgagggaggttactggccgcagtcgggcggggcgagagaagcgacgtcagatatatcgcgcagcatcgatgtcacatcaactattcgtttgatatcaactttttaatgacaaacgataaattatggtataatgcaagtatgagttgcttggtttgcgcaatgaagcggaggctcaatcatggcaacgacaaagaaactatccttcggtttggataaggccggtggcgcggccttgatcctggcccgcatcggtgccgcgctcctatggatcatcgcagcgctcgcggccgtggtgtgggtggtattcctcatttccccgcgctcgttcgccgcgaacttcggcagtgtcgacctgaatgtcggcggcgcgttcaccctcagcatcaagggcgacttgttggactactcctataatctgcagaacttccacgacggtcccgtcaacatggtagctaccatctccaccggtctggcgagaatggtggtctacgctctactggccttggcgttctccgaaatggccgcactgtgcaaggatttgacggtgtggcttgcagacggcagggatgccacgcctttccaaggcatggtgtccgaccggttgaacagggctggctggtatctgattgtcgcgccgattgtgggtctggtgaacttcatcgtatgtttcctggctggcacgggcggcaactggggcttatggatgagcggcatgatggtgatgattggcattatcctgttgctgattgcgcgcatcttcgattatggcatgggtctgcaacgggaagtcgacggtctgctgtgagggggaagagcgccgtaggcccgcgtggcgccggtccgaacagggccggtccgaacaccgagggcccgaatgaggacagcctgaacatcgttgattcgagcgagaccggcctgaatacggctgactcaaactccaccggtccggccggcataggccatatcgtcctgcgcctcgaccgcatcatggtcgagcgaggccgctcactcaactggctggccgatcaggtgggcatcaccaacgtgaacctttccaaaatcaaaaacaatcgcgtttccgccatccgcttttccgccctcgccgccatctgtgcggcattggattgccagcccggcgacattcttgaatatgtggatggcatttcgggcgatgcggacgatgcgaatagcaagtaatcgcacgcatgccaactcttctcctcctggcctgtgattgattgacaatcagggattacatgccaaatgggagagataaacatgtggaggttggattggatgggtgcagaagttgcgaattggccccatccaaattggactggtttgggtggggccaatccactccgttcaataatgaagcgcgataccaagcagcgtcgaacgaagggaaactcatgacgcagaatcgtgcggaactcaaccgtaatttggcccagatgctcaagggcggcgtgatcatggacgtcaccacgcccgagcaggcgaagatcgctcaggacgctggtgcctgcgcggtgatggcgctcgagcgcatccccgccgacatccgtgccgccggcggcgtttcccgcatgagcgacccggccatgatcaagggcatccaggaagccgtgtccattccggttatggccaaggtgcgtatcggacacatcgccgaggcccgcattctgcaggccatcgaaatcgattacatcgacgaatccgaggtgctttccccggccgacgacgtgtaccacatcgacaagaaccagttcgatgtgccgtttgtgtgcggtgcgaagaacctgggcgaggcgctgcgccgcatcgccgagggtgcagccatgattcgcaccaagggcgagcccggcaccggcgacgtgattcaggccgtgcgccacatgcgcaccatgaacaagcagatccgcgaacttgtcggcctgcgcgacgacgaggtctacgaggccgccaagcagctggccgtgccctacgatctggccaagtacgtgcacgacaacggccgtctgcccgtcgtgaacttcgccgccggtggtgtggccaccccggccgacgccgccctgatgatggaactcggtgccgaaggcgtgttcgtgggctccggtatcttcaagtccggcgatccggccaagcgcgccgccgccatcgtcaaggccaccgccaactggcaggacgccgatctgctcgccaagctgtccgaaaacctaggcgaagccatggtcggtatcaacgaggacgagattcagaccatcatggccgctcgcggagagtgacgggagtcgaagccggagaggacaacatggttgtagctgttgaatacatttccaaagaagaatccgcagacgccgaaaccgccacgcacggcgtgaccggtattctggccgtgcagggcgcgttcgccgaacatgcggcggtgctcgacaaactcggcgccccgtggaagctgttgcgcgcggccgaggatttcgatgaatccatcgaccgggtcatcctgcctggcggtgaatccaccacgcaaggcaaactcctgcgttccaccggcctgttcgagccgatcgccgcccacatcaaggccggcaaaccggtgcttggcacctgcgctggcatgattctgctggccaagaagctcgacaatgatgagaacgtctacttcggcgcgctcgacgctgtagtgcgccgcaatgcttacggtcgtcagctcggcagcttccaagccatcgctgatttcggccaagccgacgacccacagcgcatcgcggactttccgctggtgttcatccgtggaccctacgtggtgtcggtcggccccgaggctacggtcgaaaccgaagtcgatggtcacgtggtgggcctgtgccaaggcaacatcctcgccaccgccttccatcccgaactcacggacgacgtccgcatccacgagctcttcctgtcgctgtagccgattcgtctgccgttagactggtattcgaccgacgaatcaaggagacgatctgccatgcagttcacgctgaaccggcgcagcacggtgccgatgtaccggcagctggctgctgagctgcgtgaacagattgtctccggcgcaatggctgagggctatcgtctgccgcctgaacgcgagttggcctcacgcctcgaggtcaatcgcaccacggtattacaggcctatcagcaactcaaagatgagggactcatcgcctccaaagtaggcaaaggcacgttcgtgctgccgttgcagcatattgagactgcccggattcctgtagtgagacatgagccgattgacgaggagccgaaaccgagcgttgtgcggccgccatggtcggtgttgttctccgactattccaaccgattcacctaccacgacattgcctcggccgagcgggcgcaacgcggcgataccatcatcgactttgccaccggctcgcctaatccggcggatattcccgacgatttgttgcgttcagtgagcattgaagcgtttgagtcgcgcgaattcgacggtcagccagaatcgcctatcgaaggattcgatgaactccgcgcattacttgccgagcatatgagcacacgcggcgtgcagtgcgatgtacgaaacatgatggtgctttccggttccgagcaaggcatcgatcttatcgtgcgtgcattcgtcaatcctggcgactgcgtgctggtcgaacaatccacgttcttcccggcattgcagaccttccgctcggcggatgcgcgcatcatcggcgttccagtggacgagcacggtatgcgtacagacctgttggacggctattgcgcgcgattccggcccaagctcatctacaccgtcccgacgttccaaaaccccaccggtaccacgctgccgcccgaacgacgcagcgaactcatcgacgtggcgcggcgctatcagtgtctgatcgtggaagacgatgcttacggcgatttgtggtacggcggggaatcgtccgacgcacatcgccccataccgcttaagggcatggagaatgcgggatacgtgatgtatttgtcgacgttctcgaaaaccgtcacttcgggcctgcgcacgggatgggttgtggccgacccgcatgtgattaaccggctggcggctctgcggcgcatggtcgaccagcatacgagcacgtcatcgcagcgcatctgcctggaactgcttaaagaaggccgcgtcgccgaacatttgcgcggtttgattaaggcttaccgcattcgacgagatgcagcaatcgcagcattggagcggtatgcgccggatgaagtgtattggaccgtgcctgcaggcggctactatatttgggtttccttaccggacggcgtgcgctctctggatgtattggaatcctgccgttcccaaggcgtcacgttcatgccgggcagcgtgttcgacgttgacgaaatggatgattcccacatccgtctcaactttgtgcgcccggatgctgctgacattgataccggcattcgaatcattggcgagacgatagcacagatgtagccaagtgactggctcattgcggttgtcgagtttttttgatggctgcatacccacatcgatgggtgcattcgacgaatgaataagcgaggaagccatcatcagttcgctgtggcatgcgcatagcgttgtcgggcgaacggggcagaccacgtggtcgttgcgtgacctggccgatcgagccggcatcgcattgcccctggcgtagtggcgaggtggcgcagtaacgagtcacgccatcgcgagccgatgatgcgaaatgcggaaccggtcgcggccatcaacggctatcatacatgcggaagcaacgatacgttggcgtcagcacatccatctgactccagaaagggacacgatatgaccacatcctccgtttcgccggtgaccactgaactggcgggcagcgaaaccggcatcacgcttgtcattcacgccggagcgggcagtcgtggcaagcacagcacgcctgaacgcatcgcccaggtcgaacttgatctgcagcgcgccctcgatgccggataccagttgttggaatccggagcaccggcgcatgaggctgtggtcgccgccatccacgtcatggaagacgctcccgaattcaacgccggccgtggtgccgccctgaccagcgatggcatcgcccagatggacgcctgcctgatgaccggcgatggcgaggtcggtgcggtcaccggcgtaagcaccgtgaagaacccgatcgatgcggcgcgtgccgtcaaagagcagaccaagcatgtgctgttcgcggacccgaccgatgcagaaatcgccgattggggcgtcgcgaccgaaagcaacgagtacttcatcaccgaacagcgtcgtcagtccttggccgaggctcagtccggtggcgatgagtgggagaagcatggcaccatcggcgccgtggcgcgtgatgccgaaggcaatatcgccgccggcacgtccactggcggcatcaccaaccagatgcacggtcgtgtaggcgattcgccgctgcccggttgcggcacgttcgccaaccagtccacggtggcggtgtcctgcaccggcatcggcgaggcattcatcaaggtggtcgccgcccatcaggtgtcggatcgtgtgcgtttcgccggcgagaacgtcgaagatgccgcgacggccactttggacgaagtcgccgcgcatcatggcgatggcggcatgatcgttctgccggcggtcggccgtggcgtggtcgcctacaacagcgagatgatgaacttcggataccgtagcgcgcaaggaggtaaggtgcagggctgattgccccctgtattgcggcatataacatgaatggccggtgtgctgcggattcttggtaaggaatccgcagcacaccggccattcatgtatgcggcaagtgccgccgatcagtgcggcagtgcgcgctacttggtgatcgtgttgtacgtgggcatgttcgtgtaatcgaactgcacgttcttcacgttctgtgcagacacggcggcgaaacgtttgaccgggaatactggggtaatacgcaacttcatcgctcctcttcctcgaatgaaactatgttccattggtatgagccagccacgtacggtattcgtgtctggcctgccacacaatgatgcagccgtatatacgggcacagcattgcgcggcagttcattgtatggaagacatgcaaactcaatgtttccttgtccaaataaaaaaacgagcgcggctgatgtgcggcaccggtccaaaaactcatgtccgccagcgcaacgcgactacgtaccttatgctggtctgcgcgtaaaatagaatggttgcgatattgggttattcacggaggaatggatgcgacgctggctgatcaatgtagccaaaaatgagacgattctcatcgtcgccgcaatactcgccctgatttcgtgtttcattgtgccgccggacgccgattacaaaagctacattcacgccagcaccatcagccagctcatctgcctgatgattgtggtgtgcggattccagcgtatcggcgtgttccgcatcatcggttcgcgattgctggagaaggtcagcaccatgcgcggactggtcattacgcttgtcgctttgacgttcttttccgcgatgttcatcaccaatgacgttgcgctggtcacgtttgtgccgttcgcggtggccgtgctcatcatggctgggcaagaggataagaccatcctcgtggtcacgctgatgaccattggcgcgaacgtgggcagtatgctcaccccgatcggcaacgcgcacaacctgtatctcaaagccctgaccggcatgccgaccatggaattcctcggcatcatggcaccgtattccggcacggcggccgtgttgctggtcatcgtgatttccgtggtgtttggcggcaaaccggtcggcgacctgggcgacctcgaaaccggcgtgctggctcccgagcgcaacaaacaccagcccgacgagattcgtatcaccggctacggcgccggttatggcggctggcgcaccatcgtctactcgctgctgttcatcgtctgcctactggccgtctccgacgtgattcccctgtgggtgatgtgcgtgatcgtggtcgtcgtgttcctgttcaccgatcggcgcgtattcaaatacgtggattggggactgccgctcaccttctgcatgttcttcatcttcatcggcaacatgaagcgcgtgcccgaattctacgaactggcgcgctcgctggtcggcggccatccgctggaggtggcggtcggctccagccaggtcatcagcaatgtgcccaccacgattctgctttccggcttctgcgaccaatggcgcgatctgatcattggcaccaatttgggcggcatgggtacgctcatcgcctcgatggcctcgcttatttcttacaagaacgtcgtgcgccaatacccgcacaagaaaggccggtatctggccgtctactccgccgtcaacgttctgtttttggccgtattgctgaccttgagctggatcatcgagccgagtctctgagccgccgttgtgggttgggccggtctaccgcgcgtatacggtgggggagccggtcagtcggctcatggccgactgcgggatgtcgtggatgcggccgatggtggcatccagcgtggatacgccggatacgccgtctgtgttggctgtgttggctgcagaggtgatgctggatacgccgactgcggacgatgatacggccgcaaccatcggctgacgataggcgttggagttgcgggccagccgggcgagcgcagggcgctgcctgcggaacagattgataaacataccgcatactccttcatcgttggccggcggtcttctggccgccgtggattccatcctgccctcctgcgcttgtattcgctatgggggatagcccctattattccctgaatctgcacgattccccctcatccttgagggtgattctaacggcaaaggcatcggcctaatggccgatgccaatcagcgcgaaaccaccagcgtgacgctgtacggcttgatcttcatcgccagcaatgaagacggcgacggcaatgtgtaagcccgacgttccggcacaatcgcccccgaagcctcgccgcggtatccgatagtggtcttcgccgtcggattggcgcttaacgtcgtcacctccaaacgcaccggtcgcgatggcgaggcgcccagcccggccagtccgcgcgcgatttccaacgtcacatccaccggggaatcggagatattgacgattttgatgtaacggcaggcgtcatccctgtcatgcccggtggcgctgacatacagatgtttggcggggcgtgacgcggtctgctcgatggacacggcatacgtcgtgtcgcccagatgcgtggaaaacagccgctccacctcataattcaccgtggggttcacatgcgccggattgaattcgataagattctgcgcccaccccttagccggaatatgcgcgagcagcggcgcataggaggtcatgcgcaccacgtcggaattgcgctcgcagccggtcaggaacgcggcctcgccgagtgccgacttccacgtgttcgcgccttgttcggtctgtggttggccggcaaaatagccgttggctgaatattcgccgaaatagacgccggcgccacaacgcgggtaagcgtcgaatcgtgacgcctgggatgcaaaccattcgggggagtggtaggaatgctcgtcgacgataatcgcgtcaccggtggcggaatcatgtgccccggaatcggttgcggccaacgctcgcgcatggtcccagctgcgcttcatcgccggctggaaggggaacagtccggcgctcatcacacacagcatatccgggtatcgttcatgaatggcctcgctgatcatgtcaaacttggccacgtagtcagccccgaagttttcgttgcccacgccgatcatgtccaagccgaacggctcaggatggcccatatcacgccggaccgcggcccacgagctggactccggatcgccattcgcgaattcgatgaggtccaggtagtcctgaatcacattgttgcggaaggtggccgaattgatatccatgtggcgcggatctcggccgggcgactggcatgcgatgccggcgaacagagtaggcagcggcttggccttgaggtcctcgcacaggcagaaatattcgtagaaaccgatctgatagctctgcgaatagctggaaccatccggcatcttgaacgaccacatcgaatactgttggcgtcgcgcggccagagagccgacggtatccttccagcgatactcattgccgggcgtcacaccttcgacgatgcagccgccggggaatcgcagaaacgctggatgcaacgcctgaatggtctccaccaaatcgcggcgcagcttgccgtaacgccatttcgggtcgcccgcgccccaatagtccgcatccatgaactgcaccagatccagatcgaacgtggtgcgttcgccggcgtcaatggtgatacgcagcttgccgtaatcggtgttcagtccggttacgtcggcgttgaaccggtaccagccgtcacggccgatgacgatggcaccatccgacgaatccggactgatcgaaacgccggaatcctgcgcatcggccccatcgtcctgcctcagaccggtctcttccgtatcgtcaagcggatcggagtccacgatatacgacaatcgagtgatactggtgagcggcaggccgtacctatcgaccacgccgacggacagctcggcccgcccatgaaccggacgtaccgcgagactgacggaataggtgtggtcggcgacgatggagaacgcgggctcgcccccgttgtcgccgcctccgttatagccgaggttttccagatatgcagggccggtttcggaaggaacatcggacgtgatgcgagcgtatcggctatgtgcgtgaattggcggggcggggcagtcggtggtcacccgctggccgtgaatcccgcgtatctcactgccaaggccggcggcggaacagttgatgaaatcccagaaacgcagggaatcagcctgcgtacgccaccgttcggcaccggccatacgccacgtgtgatggtcgagataaacgccgtcaaaactgtagttgttcaccatgttggcgttcagcccgccatccgcaccatggttgatgtcctcgaagaacacgccgtacagtcgcccgcttgtgtgatgggtggggcttcccacgctaatccgcaccatggtttcgattgtagagggaatggagcggaaaggtaaacggaagagttcgctcaccgttcatgttgcggtcaatccaagtcgactgttcgccggtatacagccggtaacctcgaaacaggaatggaaaatacggacgactaggagcgcggctgtgcaatcctcggtgggaatacgtgagcgcatcgaccacgtgtatccgtcgctgcgtccggcggagcgcgccgtagcccagtatattcggaatcatatcgaggaggcggccgacctgaccgtcggtcagatggccgacatcgcccacgtcagccagccgacggtgattcggttcgcccgcaagctcggcttcggcggttaccgtgaactgcggtacgtgttgcgcaacccggccgccgaacacaaagtgaccttcaatccgctggccggattcgatctgaatccgtgggatggcgaagatgagattcccggtaaagcggccgatggcgcgaaggcgctgatcgacgagctgcacagtgcgttggaccccaaggcctatcgcaaggcggtcgccctactcgccgaatcggagttcatcgacattttcggcgtggagaattcgttgacaccggcgatggatctgttcaccaagctcggctacctgggactgacatgccgtctcaataccgacgcttacctgcagcagatcggtgccgggcacctgccccacggcgctgtggccgtcgccttctcccattcgggcagttcggcggatacggtcaaagcgttgcgattggcgaagtcgcatggcgcgaaaaccatcgccataaccaatgccatcggcgcgccgctggccagctgggccgacgtgacgttgctgacgggtcgtgattcgcacacgatctatggcaatgcgattttctcgcgcgtggccgataccgcgctcgtggacatgctgtacatgggcgtgattctgtccgactatggccggttctccaccgcgctcgacgaatccggtcgcatgattcgcgaccgcgtattcgagaactgagctgctgctttatcgcgccttgggccgtattgctctggtcgttgctgcttgggttgttgacgatttggtcgttgtcgccctggtcgctaccgtcctgaggcatgtgccagcgaatacgtagtggacttggcgtgcgtatgacgttcgatcttgccgctcaactccagctggtccaagagctgcgtcatctgatccttgttcaggccaagcgctttctgcatggttttacggctgagcttcacaccgcggaacgcgaggaaattgagcgtgaactgttccaacgtttgaggcgacggttccagcgttgccgtatcaagcgggcgggtactggcctgatcgtcaccgtccgggcgttcgccgaatccactgccgagaatcagcgtctgcagtggcgcgcagccgatgatgcgtgcgccggccaaagcatctgcggcgttatccgtcatgcgctgaatcgtggggaatgagtacattttggcatgctgtgcttcgtcagtggtgctgggcgcggcggaagcatcggcatcggtccgatgcgaggacgcggcctcggccgatacagggataggcagtaccattgccaccgaagtggggcccacgcgcagttgcggactgaccgcgctctgcgcgtaggcgtccataatgcgttgaatgccggtaccgcagttctcgcagaggcccaaatcggcgaacaattcagccaaacgcggggtgcgtggctggcatacgccgttgagtagatcgttgatttccaaaccatcggtcaggccgccgagcgacacgatttccaagcgggaatcgaagatattgatcagtgtggggccggagtacgtgtaatcgcgatgttccagtgcgttgaccaatgcttcgcgcagggctatggccgggtattggccggattcgttgatgccgttcagcagggcgctggcttggtcgagctggcgcagcaccgagccggtgaatgtgtgacgttcgcgaatggcgtttttgccattgccctcgaaaatggtggccttgataacgaacgggcattggttggacagcagggtggcaagcgacgattcggtggtgctggtgaaggtgttgttggtgccggtgttggtgatgctgccggcggggacattaccggcatcggcagagacggatgcagccatgttggtcacaaccgggctttcccaatccttgccttcactggcaaaacgatcctgtgcgtatgtgaaagtgagctcaccgctatcgcctgcgacggtctggcccgatgcggcgtgatctacgttgctctccgttgtccccatatcgccgatggtaccggtgcaagccgacgttacgccgaggtgttttacacccctacggctagacttacacgagtttggccccgtagctcagctggatagagcatgtgacttctaatctcaaggtcgacggttcgagcccgtccggggtcacgatgtaataagcccttggtccctcatcgtttgtgaggggcaggggcttttgaatattatgccggtctgggtccgtctggagcctgaactgtcgaccttgagattagaagtcacatgctcatcaccaccatccgggaacacccttaaggggtgcgtctcctgcataacggctatactctgacttgagatgtgctgaataataaccagctatcgcgcgtccgccaatggcgacgaacgagggaagaaggcccgtgccacgagcaatcatcgaggtaagaaacctacgcaaggaataccccgtcgaggatgagacggtggtggcgcttgaccgtgtcaatctcagtatcccgcaaggccagatctgctgcattttcggcgaatccggctccggcaaatccacgctgctcaaccagttggccggcatggaaaaaccgacgcgcggcggcgtgagaatcggcggcgtacccgtcagcaaactcgacgagcgtgagctggcggccttccgccagaagcatcttggcttcgtattccagtcgtacaacctgctgcccaatctgaccgcgctcgaaaacgtggcaatgccgctgatgttccgcggcgtgcccaaggaacagcgcgaacgtgcggcgcgtggcgtactcaaacgagtcgggctcggccatcgtctcagccattacccgcgccagatgtcgggaggccaacagcagcgcgtcggcatcgcccgggcgtttgtgaccaagcccgaggtggtgttcgccgatgagccgaccggcaaccttgactctaaaaccaaaaccgaggtcatgacgatgatctgtgcattcgcccatgacttcaaccagaccatcgtgctggtcacacacgatccgcagatggcttcatacgccgaccgcatcgtcaccttgctcgatggccgcatcaccagcgatcggctcaacaccgacctttcccgcccaactgttccgtccacgccgtccgcccaaagaacccaaggagttgaccgatgaagcacctctcccaccgcaccatcgccatcatcgtcgcgttgctctccacgctgtcactggcacttgccgtcatctcccttccgcaccaggcgtacgcagtcgacggcacagacggcacaagcggcacgaacagtacgtctcagggaagcgacggcgattccgcgccaatcgccggcccggtgccgaacatcatcgtcaccaacttcacctatggcggcgattccgtggccgccggcgccgatttcaacctcgacttcaccttccagaacatgggtcaggtggcggtgacgaacatggtcatcaccgtggacggcggcgagagcttcgccatcgcgggaggcacgaacacgttctacgtcgacgcgctgtggggcggttacgccatgacgcaaagcgtgccgatgcaggcgctcgcctccgcgaaaagcggtgcccagcccgtgaccgtgaacttccgatacgagtatgtggacgccagcgcccgctcctcaagccagtctgacgtcaagatttccgtgccgatcagtcagcctgaccggttcgaaatcagtgatcccgtagtgcccgaccaggtgatcgccggccaggaaaacacggtcacgatggaatatgtgaacaagggcaaaggcgatatcgccaacgtcgaggccacgatggagggcgaaggtttcgatgccacgatgaaaacccagtacgtgggcaatgtggcttccggcaccaccggcacgattggttacgccttcacaccgcacgcgtcaggcgagctgaagaccacgctcaaagtcacgtacgaggattccgacggacagaccaagaccaaggaattcccgctcaccatacccgtaaccgatatgcagccgatggatgattccggcatggccgatccgaacatggaccagaacgccaatcagggattgccggtgctggtgtatgtggtcatcgtcgtgatcgccgtggtcattatcgtggtgattgtgctgctggtgcgtcgccggcgcaagcagaaggccaagaagaacgatattgatgaggactgggatgattggtccgaaggcaaggatgataagaccgataccggcgtgacggatggtgctgcggcagacaccgctcctatcacaccagttaccccagcctcatcagtcgcaccagccggctcatcccacaaggcctgaaaggcccgaccatgcgattcggcgacatactgcggctctgcagacaaaacctatggcggcgtaaatcccgtacgattctgaccgtgctgggcgttatcgtcggctgctgctcgattgtgctcatggtctctttgggccaaggcattaacgagcagaacgagaagatgctcaaatcgatgggcgatctgtccatcgtcaccgtgtacaccaacggttatgccggtccgatggacgatggcggctcgtccaagatgggcgataccaagctcgacgacaaggccgtggaatccttccgcgcgatgagcggcgtatccggcgtgacgccgatgatgaacttcccttataacgtgacggccagagccggcgcgggcggccgttacatctatgattacgtgcagatcatgggcatcgacatgacccagttcgaccagatgggctacaagctcgtcggtggcgagaagccggtcaaaaaggatcaggtgcttgccggcgaatggttcgcctatggtttcatggacaccctgaagaacggcgaacaacgcaccagcacacgcggcggtcagtattcctcatgcacgtttgaccagaccaccggccagtgcgaggaagaccaggacgaggatccgttcttcgatccgctcgccacgcaaatcagtctgaccaccggcaccaattatcagggcgaccagtacaccatgaacatgtacggcggcggtggcggcacaggcggtgcgggtggcaacaccgcgggtcagtcggaaaacgtcacctttgatgtgcgggcttccggcattgtggcgggcgactacaacaaaggctatgccacctccgacggtctggtcatggatttgcaggcgttgaaggaactggccgccaaagtcgatccagccgccgccaaaaaagccaccgcctataatcaggtgctggtcaaggccgccgacctcaagtccgtgcccgaagtcgaatcacagatcaaagcgttgggctacgagacctcctcctatgaagacatgcgtaagtcgttggaagaacagtcgcgcgcgattcagctgattctgggcggtatcggtgcggtttcgctgttggttgcggccatcggcatcgccaacacaatggttatgtccgtaaccgagcgcacgcgcgagatcggcattatgaaggcgcttggctgctacgttcgtgacattcgcgtcatgtttcttgcggaggccggcgcgatcggattcttcggcggattggtcggctgcgtgctgagcggactgatatcgctgggcatcaacgttgtcggcgcgttgtatgcgggcggcatgagcggcggcatgtctggcggtatggtcagcggtgcaggcgggggctccggcgacggtaccggtggcggaacatctatctggaccatactctggcaggcgatagttggtggcgagaatgtgacccgttattcggtgattccgtggtggctgttcctgttcgtcgtactgttttccacgctgatcggcttgctgttcggcttcggcccggccaataaagccgttaaaatcccggccctagacgccatcaaaaacaacgagtgatcgcctctgtcacctgctccaccgttagtccataacgttcgttcagttcgcccagcggcacgcggtcggtaaattccttggctgcgccgaagttcagcacatgaggattacggctgccgtccgagacatgatgattcgcataatatgcggtcactttctcgccccagccgccttcaagctgcccgtcttcaagggtgatgacctgctggtggccatcacgcaacgactccagtacgtctgaatccagcgacgtgcactggcgcgggtcgataaccgttgccgtgatgccataatcggcagacaatgcggcggccgtctgctccgccaacggatacgcattgcccagtccgataatcgcgacgtgcgagcccgtctgattgacccgccaatccagcatgtgacgcacaccggcacgctgagccgttacgctaacggtcccgcggactgttgcggcagatatgcccccgctggcggagctgacggagactggcagcgaagttgactgggggcggtcagcgatctgcccacccgtcaccggcagcagcgtcgcatcccgttccgccgtcagaatcgcctcgcccggcactcgaatcaccaccggaccagcaggggcgtccgccgaaccggccggcgcggtagcccatgccagatcagctagatagtcgcgagccgaagtcggcaccagcatcgtagcccctggaatattggagaacatcgtcacgtcatacgcgccggaatgcgtattgtccgaaccggacaggccgcccagaaaatcaagtaccgtgactcgcgaacggttcaggctcatctcctggaagaactggtcgtacgcgcgctggaagaaggacgccgtggtggccaccaccggcgtgccacccgcccgtgcgatgccggcagcgtacgccacggcatgcgattcggtgatgcccgtgtctacataatgtgcgcccgcgcgctctcggaactcatgggtgatgccgttcgagcccggcgtggcgggggagatgaccacgagtcccggctcggcggcgaaacgcggttcgagtgcggccatcgccattttgccgtaatgcttgcgcggatcgtccggcttgccgattgcggcatccggattctgccaatgcgaggcctcgcactggccctcatgcggttcatgatcggacaggttgcagtgatccgaatgccacggctcgctgtggttcacgttatcggtgggatgcacgccggtgggggagtcgaacgaaaccggtgaggccgaggcggtttgccgatctgcgtgagtctcctcaccgtcatatcctgcgcccttcagcgtatgaatatggaccaccaccggatgatcgatatcgcgcacttcctcgaaagccgcgaccagcgcggaaacatcgttgccggcctccacataccggtaatccaagccaaacgcgttgaacaggttcggctgggcagtgccgccggatgcgcgcagacgggcgagcgggccgtacatgccgccgaaatcgccggcaatcgacatctcgttgtcgttgaacacgatgatgaggttgccgccttgctcggccgcgttgttcagcccctcgaacgccacgccagaactgagcgaaccgtccccgatcacggcgaccacattgccgatgccgctgcccggctcctccatgtcgcgggttttcgccaggccgcaggccaaggagatcgaagtgccggtgtgcccgagcacgaactggtcgtgttcgctttcgtcggggttggtgaagccggtcacctcgccgaaacggttcggatccatatacgcgccggcccgtcctgtgagcatcttatgcacgtagctttggtgggatacatcgaacacgatacggtcacgcggcgaatcgaagacgcgatgcagggccaccgtggcctccaccatgcccagattggagccgatatgaccgccgtgttggtggccatatgccagcagcgtggcgcgaatctcgcggcacagttcggcgagctcgtcgggggcaagggccttgacatcggccgggctggcaatgcggctcagcagatgggagtcgtcgccatgggaaggggtaatgctcggggggatgtcgtgaaggcgcgcggccccctcggcggcaccggagacggcgaaggaatcgcttgaatcaaatccgtttcctgacgcgttgcgcataccctcgaatctcccttcgctagtctttccgaagttgaatgctaacgcccggcattgtccgaggtccacatgacgaatcaatgcccccaacatctccgtaaatgggtgattcgttcgctgcgcgatgtgggacaatgaatgcggtaattccttttgataccaaggagcgcgcaatgaaggccgtatacgcatccaccgtcaaccatgacgatccgcttgccgcgttggcggtgggcgagcagcccgaaccccaggcccgcccgttctggtcgaccgtttcggtgcgcgcggtgaccgtaaaccatcacgacgtctggtcgctacagggtgtgggtctcgccgccgaacagacgccgatgatcctgggcaccgatgccgtgggcgttctggacgaggacatccccggcaagcatgggctcaaggctggcagcgaagtggtgctgtacacgttcgtcggcaccgatggcgcgggcgtggccccgggcgagcgccgcacgatcctctccgagaaataccccggcacgatggccgagaagactgccgtgccgtccgccaacgtgttcgccaagcccgcaaacctcaccacggctgaggcggccgcactcggcaccagctggctgaccgcctactcgctgttgttcgatgccgccggcatcaagccgggcgactccgtgctcattcagggcgcgggcggcggcgtgtccactgcggccatccagctcgcccatgccgccggtctggaagtgttcgtcacctcgcgtgacgcggacaagcgcgccaaagcgctgaaacttggcgcgaacgccgcgctggagaccggtgcgcggttgccgcgcaaggtcgatgcggtgatcgagtccgtgggggcggccacatggggccattcggtgcggtcggtgcgtcccggcggcaccatcgccatctgcggcgccaccaccggcgaccagcccggtgcggagctcacgcgactgttcttccaggacattcgcgtgcagggctgcaccatgggttcgcgcgaggatttcgcccggctgctgcgcttcgtggagcacgccgacctgcatccggtgatcgattccgtggtcagcgggttggacgccgcccccgaggcgttcgccagaatgatcgccggcgacatgttcggcaagatcgttattgagctgtaagcctcacagaattatgtattgagaacgattcgctgcgtggcttaactccgctatcaggagtacagtgggccttattctcaataactagggagtaaatgataatggcaaatgaatccaagcccgaagtcgcagtggtcatgggatcggccagcgactgggagaccatgaagcgcgcctgcgatattctcgaccagttcggcgtcgcctaccacaagcaggtcatttccgcgcaccgcacgcccgagctcatggccgagttcgcgcacaacgcccgcgccaatggcctgaaggtcattatcgccggtgccggcggtgccgcccacctgccgggcatgatcgccgcgcagaccacactgcccgtgatcggcgtgcccgtgcgctcccacgccctgtccggctgggattcgctgctgtccatcgtgcagatgcccggcggcattccggtggccaccaccgccgtcggcaactccggtgccaccaacgccggcctgctcgccgtgcagatgctctccgccttcgagcccgaactggccgacaagcttgaggattaccgtaacgaactgaaggaaaaggtggccgaatccaatgcccagcttgtctgaagaaacgggcggccgcgtctccatgctgatgccgggctcgaccatcggcatcatcggcggcggccagctcggccgcatgatggctctgtccgcccgctacatgggcttccgcgtcggcgtgcttgacccaacgccgaactgcccgaccggtcaggtggccgacttccagatcaccgccgagtacgatgacaaaaccgccatccatgatctggccgtgcagtccgacgtgctcacctacgagttcgagaacgtggacgccggcgccatcgacgaggtgcgcggcatcaccgccaccccgcagggcaccgacttgctgcgcgtgacccagcaccgcgtgcgcgagaagcagttcatcaacgaccacggcaccgccaccgcaccgtggcgcgctgtcaacaacttcgatgagcttgacgccgcattgggtgatattcattatccggccgtgctgaagaccgtgtccggcggctacgacggccacggtcagctcgtgctgcgttccgacgccgacttggagaagatccgctcccgctccgaccgtggtggtggcttcccgccgagcatcctggaaggcttcgtcgacttcgcattcgaggcttcgattctggtctccggcaacggcaaggacttcgtcaccttcccgattgtgcgtaacgagcaccgcaacaacatcctgcatatgaccatcgcccccgccgaggtgtccgaacatgtggctcgcgaagcgcatgaactggcgattcgcctggccaagggcttcgaactggctggcacgctggccatcgaactgttcatcaccaaggacgatcaggtcatcgtcaacgagctcgccccgcgcccgcacaactccggccactacaccatcgaggcctgctcgatggaccagttcgacgcccacatctgcggcatcgccggctggcctctgcccaagcccaagctgctctcgccggccgtgatggtcaacgtacttggccagcatgtggaaccgacgcgcgcgctgatcgccacccacccggagtggaatgtgcacgactacggcaaggccgaagtgcgccacgaccgcaagatgggccacatcaccgtgctcaccgacgacccggccaagacggtcgctgaccttgaggccaccggctgctgggacgacctgaaaaagaaggcgtgaccttaccgatggttgaacatatcgaacgccagaccaagcagaaggacgcgattcgcgccgccttggccgactgcgaggagttcatctccgctcaggacctgcaccgcaggctggaggacgaaggctcgaaaatcggcttggccaccgtataccgccagctcaacgccttggccgatgccggtgccgccgacacgatccgcctggacggccagcagctgttccgcctatgcggcgacgacggacatcaccaccacttggtgtgcaggcggtgcggcaaaaccgtggaaatcgacccgcccagcgaggcttggctgcgcaaagtggccgacggccacggcttcaccgttgaatcccacaccttggaggtcttcggactgtgctctgattgccaaaaggagcagaaagcgcagaaggctcagaaagcagtgagcgaataacaaatgggatcggcttcaaagccgatcccatttgttattccgctgctattccactgacttcagcgcgccgagcatgctgtttctttgaggtcgtgttctgcacgatgcctttcacgccgtccagcttcatgagcttggcgctgcgcgactccacattggaggtctcgtggttcttgagccgcaccatataggcgttcgactggtgctgctcgccgaacacgtgcttatagccacccgaagtcatgaacatgaaatgcccgaagtagggaagccggcttgtcacgcagcttgcgtttggccgctacccaggccggtaccacggtgctcgcccaggccagcaggaacgccgccagggtgatggcagggtggaacgccagcatgacacgccgatgtaaatgcaaatgataataattctcaatacatgttattctgtcgtgttggtggctgggcgatgatgcagcaacagcagcatcgcccagccgttcggctaattagagaggaaaacccaatcatgtccatcatgtccaacgccaagcgcgcgctcgccatcgcggccgccgcggcgaccctgctctcgatggccgcctgcggttccagcaacgccgccagcggcaagtccgattccagcggcgccgcgtcttccggcaagatcgaggtcgtcgcctccatcaaccagtggggttccgtggccgaagacctcggcggcagcaacgtcgaagtcaccaacatcatgaccaagaccaacgtcgaggcgcacgattacgagcccaccagccaggatgtcgccaagttcggcaccgccaaggtagccgtagtcaacggcgccgattacgacccgtgggccaccaaggccgcccagccgaccaaggccacgctggtcaccgccgccgaaaccgccggcatcaaggaaggcgacaacccgcacgtctggttctccgccaaggtgcgttccaacaccgccgacgccatcaccgccgcctaccagaaggccgacccgagccacaaggacgactacgccaagctcaacaaagaatggcacgccaaggaagaccagcttgagtccaagatcaaggagacttccgccaagaccgagggcctgccgtacgccgccaccgaatccgtggcctggtacctggccgacgacctcaagatgaccgacgccactccgaagggctacgcccaggcctccgccaacgagagcgagccgaccccggccgacatcaaggacttccaggacaccctgaaggccggcttcatcaagatgttcgtcttcaacagccaggaagcaaactccactactgaccagatcaccggtgccgccaaggacgccaacgtgccgatcgtggagctcgccgagcagatgccgaagcagtacaccaacctgctcgactggatgagcgcactggtcgaccagttcgccgccgccgtgaagtaatgcggcagtagccgtcaatccgcaacagcgataaggggaataatcaagtcagatagcgaggcgttgtctaggggagaacagaacacttcgctatcagggataggctccttatatatcagggtgcttcggggatgtcccgaggcaccctttgcgttagggtaaatagttaggaaacggtaagaaaaatagtggaactatggattttccaaggttcagcggcaacaatatgcccttgaaaagtcacatacggaaacaggcgaatgagcgagaacactagtaataccaccacagtgaaaccccatttcaagctttgggccaaaaaggtcgaagccaatgaagtcacgccccaacacccccacaagcccttccccggctgggtgtacggcgtgctcttcgttatcttcgacatcattgtcgtgacggcgctcgaagtgggcgtttcgtccagctccacccgtgtgcagctgtccagtccgatcgtcggattcggcttcgtgagcaagatgtggaccgacggcaatttcgtattcgtgctcaacgtgatacttgtcgcgttgctgtacctcatgttgctgatgctgttcaaccggttctggacggcaagcatcgtgattctcgcggtcggaatcatcgtggccgccatcgaacatttcaaggtcgagatccgttacgaggccattctgcccgccgatctaggcttccttggctcgaacaccggcaacatgctcaccttcattccggccggtgcgcatgtgaccatcctcgtggcactcggcgcgttcgccgtactgctcgcgctgattctggtgctgcgtcatttcgatgggcgcaaaggtcgcatgattcgtacggataacctgagcctgaacctcacctcccgtctgattcttctgctgctgccgattctggtgttcgcgttgtactgcattcatgtgagcaccaccgattcgctggccaacaagttctcccgcgccttgggagacacgccatccatgtgggattccgtgtatgacgcgcagcgcaatggtccgctcgtggccttcacccgccagctcaacccgaagatcatggacaagccgagcaactactccgaggagaccatgaagaaggtcgccgctcgctatcagaaggaagcggagacaatcaacgcctcccgcaccaacaacctcactgattcgacagtggtgtacgtgttgtccgaatccttctctgacccgagccgcgtgccgggactgaagaccaataaggattcgatgcccaacatccgcaagatcaaggcgggcaccacctccggcctgatgctctcctccggctacggcggaggtacggccaatctcgaatacatgggactttccggcctgagcatggccaatttcgagtcctccctgtccagcccgtaccagcagctggtcccgagccagcattggactcccaccatcaaccagctgtggggcgcgcccgtcaactcgctcggctaccacccgtacgaatccagcatgtactcgcgtgccacgaactacaagaagttcggcttctcgcacttctacacgttgaccggtccggacgtgatcaagtatcaggacaagatcgacgagtcgccgtacgtctctgataagtcttcctatgattctgcgttggaaggcatcaagtccggcaagacgaacaagttcattcagatcattaccatgcagaatcacatgccctaccacgagtggtatgagaataacgactacaccgccgaatccaccacgggtacgccgctgggtgatgatgaacagcagtcgattgagacctatcaaaagggtgtggagattaccgatcaggccactcaggagttcctgaatgaactggatgcgctggataagcccgtcaccgtggtgttctatggcgaccacttgccgggcatctactcgtccgccagcgaggatgacaacaactccttggccctgcacctgaccgattacttcatctggtcgaataaggcttccagctcccaaggcaataaggcaagcgatgcagcctactcctcgccgaacttcttcgtggcgcaggccgccgatcacatgaacgccaaggtcagcccgtatctggcgttcctgaccgaaatgcattccaagatcgccgccatggaaccgcctgtggtcaacaagatccaaggctgggatcgtatccccgaaggccagaacatctatcttgatcagaacggcaacccgatgtccaccgatgacttcgacaaggaaaccaagcagttgcttgccgactacaagctcatccaatacgacatcaccgccggcaaaaactacctcaaagacacggactttatgacgctgccgtaaagcagacagcctagtaggctgtctgtaggcagcgtgcgagccgacagacgagccagcaaggcgcggggcgtagcccgtccaaaattgcagtagcgctgccgtaaagcagggggtgctttcatgacgaaccagactttcgaacaactgaagaagacttacgaatccggtcgtacccggccgctggcatggcgccgcgcgcagctgaacgcactacgccgtctggttacggagaaccgtgatgcctttgtctcctcggctatggctgacttgggcaagcccgcggctgaaaccgtgctcatggaactgaacctggtggctggcgaagcacagttcgtgcgcaatcgtctgagcctttggaccgcccggcatcccaaagcgatgcattggatgttgcagccggctgccggatggacaattgccgagcccaaaggcgtggtgctcatcatttcaccgtggaattatccggtgctgctggccttggaaccaatggctgatgcgctcgctgccggtaacgccgtctgcttgaaaccgtccgagctttcaccgaatacgtccaagctccttgctgagttggtgccgcaataccttgactccgaggccgtgcgcgtggtcgaaggcgggcccaaggaaaccggcgaactgctgaaatgcccgttcaaccacatcttctataccggtggcggccacgtcggcaaaatcgtcatgcgcgcggcggccgagcatctgacgccggtcacgctggaactcggcggcaagtcgccatgctttgtggatcgcactgcggacatcaatgtggctgcacgccgcattgcgtggggcaaattcaccaatgccgggcagacttgcgtggcacccgactatgtgctcgccacgccggatgtggccgaggctctggccgagcgcatcgccgtagccatcaccgaattctatggcgaagatccgaaggcctcgcctgattttggtcgtattatcaacgatcgtcattttgaacgactgtgcaagctattgccggtcggcaccgtgccgcctgaggagccgagctcgccgctggtgcaggtggcatcggcggtaggcgcggccatggatatggttgggcggcgcttcaatgccgtgactactgggcgcggtggcgcgggggagatggccggcagcgcgaacaatgcggcgaagccgacggccggttcgaatatggcagccgctgatgatggtgcgactgcctcggccgctgttgagccgagcgagattcacaaggtgcccggcgtgttcgacctggccggtcgaatcgtttgcggcggcaaggtcgatcgtgccgcccggtatatcgcgcctaccgtgctgtacggtacgtcgccagatgcgccagtaatgaaggaggagattttcgggccgattctgccgattctggtggtcgaggatgccgagtccgcaatccgattcatcaacaagcggtcccggccgttggctgcatatgtgttctcgcgcgatcacgaggttcggctgactttcgaacgtcagaccagctccggagccttgggatattcgctgccgttgggccatctgctgtccagccggttgccgttcggtggcgtgggcgcgtccggcatcggcacctaccacggcaaagcaggcttcctcaccttcagccacgtcaaaaccgtggttaccaagccgcagttccccgacactctgcgcctcgtgtacccgcccttcaatgaagccaaggccaaactgttcgacatcatcgccaaattcagctagcgtgatatcgctcgctgatattgggtgatggcgttgtcatagtgacgttcgctgtcccggtaattacgtcaatcgattgattcgtgtaccgggccagatttttctgtcctagtatttgatttcgggtcatttttgcttaccgggacaaaactgacgccggaagtatcgtccgcgtattacgaaaatggcggaatagtgcggtttcgtatggaagggaatttcaaatattcctatattcgaggggttcagctgtcctggtttgcgaaaaagagccgaaatcggctaccgggacagaaaaatctggcccggtagccacgtcaatcgattgacatgtctgccaggccaaaaatatgcagcagatgcgccgcttctgttacttcagggctttgaagccgatgtcgtggcggtaaaacagtccgcgcagctcgagcttgtcgatgattgcgtagaccttgtcctgggcggacttgatgtccggagcggaggtttcgacgagcagcacgcggccagagttggccacaaggttaccgtgctcgtcagaggcgacgccggcgtagtagacgtgcgaatcctcgtcgacttcgatttcgggcacacgggcacccttgatgacgttctccgggtagccgttggaggcgatgaccacgccgagggtggcgttggactcatcccaggtgaattcgggggtttcgccgtcgagaatggcggagatgccggcaccgaggtcggaggtgagcttcgggagcacgacttcggtttccgggtcgccgaagcgggcgttgaattcgatgaccttcgggccgtcggcggtggcgatcagaccggcgtacaggataccggtgaatggcgtaccttcctcggccatgccttcgacggtggggcgcacgattttctcgatggcctcgtcgaccacggactgcggaatctgcggcaccgggctgtaggcacccatgccaccggtgttcggaccctcgtcgccatcgtgggcgcgcttgtgatcctgggagatgggcatcggccagaaatcggtgccgttgacaaagctcatcagggagaattcctggccgtccaggaagtcctcgataacgaccttggcaccggcggagccgaagcgatggtcgatgaagatgtcttcgagtgcgcgctgggcggtgtgctcgtccatggccacggtcacgcccttgcctgccgccagaccgtcggccttgatgacaatcggggcaccgtgctcgtgtacgtagtcctgcgccatctcgagatcgctgaaggtcttgtattgggcggtcgggatgttgtgtcggtccatgagctgcttggcgaagtccttggagccttcaatctgggcggcggccttggacgggccgaacgccttgatgccggcggcggcgaaatcgtccacgatgccttcgatcagcgggacttccgggcctacgaacacccagtcataaccattgttcttcacgaattcgataagtgcggcgtgattcgactggctcagctgcgtggtgtggatgccgtccttgagcatgcccgggttgccgggagccacggtgacttcgtcgatgctcggtgccttgagcagcgtgtaggcaatggtgtgctcgcgcgcgccggagccgataaccaatactttctgacccatgttgttcctttcctgcggaaagcgagttacttcagtacgatttgcgtgccggtggtgtcggctgcgatctggccgagcacgtaggcgggctcgttgttgtcggcgagcagcttcagcgcctcgtccttgcgagcggggtcgatggccagcaccatgccgatgcccatgttgaagatgttgtacatctccttatgatcgatgttgccagccttctccagcacgtcgaagatcgggagcacgggccaggtgccgagctcgatttcggcggccaagccgtccggaatcatgcgcgggatgttctcgatgaagccgccgccggtgatgtgggccacgcctttgaccacgcccgccttgaacaggggagagagggccttgacgtagatcttggtgggggtgagcagcacgtcgccgagcttttcgccgcccagctcgtcgagttcggtgtccacggtgtagccggcctgctcgaacagggccttgcgcaccagggagaagccattggagtgtacgccggtggagggcaggccgatgagcacgtcgccttcagcgatggtggaaccgtccacgatggcggacttttcggcaacgccgaccgagaatccggcgagatcgtattcgtcttcgtcgtacatgcccggcatttcggcggtttcgccgccgaccagcgcggaaccggcctgtacacagccgtcggccacaccggccacgacctgctcaagcagtgccgggtcgttcttgccgcaggcgatgtagtcaaggaagaacaacggctcggcgccctgggcggcgatgtcgttgacgcacatggccacgcagtcgatgccgatggtgtcgtgcttattggccagcttggcgaccatgagcttggtgcccacgccgtcggtgccggagatgagaaccggctccttgtagcccaaggaggccagatcgaacaggccgccgaagccgccgatgccgccgaccacgccggggcggttcgtgcgggccacgtgcgacttgatgcgcttgacgacttcgtacccggcttcgacgctcacgccggcgttctcatatgcttttggcatttggttggcctttctacttattttggctcccctctggaggggagctgtcggcaaagccgactgaggggaggcaagcgcctctggttcaaagaattgttattgagtggattggtggtgagctattcggcatccggctgcacggtgttgtactcgttgccgatgtacttgctcttgtacagcgcgaattcaggcagacgcacacggtcctcgggcgtgagggacttcaggaagtcggcctcgtagtcgtcgagcgcagtggggtagtcgccgttgaagtaggcgacgcacaggccaccgtatggggcgtcggcgttcagtccgatggattcgaccagaccgtcgagcgaaaggtaggccaaggaatccgcgccgatgtattcacggatttcctccacgctcatcttggctgcgatgagttccttggtggtggagatatcaatgccatagaagcaggggtacttcagcggcggggagctgatgcgcatatgcacttcagcggcgccggcttccttgagcagctgcacgatgcgcttggacgtggtgccgcgcacgatggaatcatcgatgacgataacgcgcttgcctttaaccacgctgcgcacagcagagagcttcatacgcacaccctgctcgcgcagttcttgcgtgggctgaatgaaggtgcgggccacatactggtttttgattagacccatttcgttgggcaggcctgctgcttccgcatagccggatgcggcggacaatgaggagttcggcacgccgataaccatatcggcctccaccggggattcggcggcgagacgtgcgcccatgcgcttgcgggcggagtgcacgttgacgccatagatatcggaatccgggcgggcgaagtagatgtactccatcgagcagatggccagctgcgtgttgttggtgtactgcacgatcttgtagccgtgatcgttgaccaccacgatttcacccgggcgaatgttacgcaccagctcggcgccgacgacatccagtgcgcaggtttcggaggcgagcacgtaggcgccgttcttcatcttgccgagggagagcgggcggaagccgttcgggtcgagtgcgccgatcatggcgtcttcggtcatcagcaggtaggcgaaaccgccatgcaccgtgttgagcgcttccttgagcttgtccataaaggtgcgctgcatcgaacggcgaatcaagtgcatcagcacttcggtgtcggagttcgaatggaagatggcgccttcgtcttcaagcttgcggcgcagtgacgggcagttcgtcaggttgccgttatggcacagagccacgtcgccgtcatggaagcggaagatgaacggctggatgttgtccgtggtgcccgagccggccgttgcgtaacgcacgtggccgatggcgcaattgcccttcagtcgttcgatttcgcgctcatcgccgaacacctgggtgagcaggccgagtccacgatgaccgatgagatgaccgttatcgttggagacgatgccggcaccttcctgaccgcgatgctgcagcgcgtgcaggccaaaataggtgagtcgtgaggcgtcggggtggccccatacgccgaagatgccacattcctcgtgaatgtcttcgagttcagccgacaagccaaagctcctttttcaaacaggggattaactatctatcaaccctaccaatcggcggctacatcgcgtgttgtggggtggtggaacttgttggggtttgcggacgcggtttaagcaccagatcagtcaagtatgaatagtggcttaggattttggcctttcgctgtttgtggtgggtggttgtggtgtggggtgatgccgacgggtaggttggaagcatggatacctcttacctgttcaccgccgcattacctggtgctccactttgtgctcaagcgtgataccgaattgtcggtgtgacgtgatcggttgactttcgtcaacgcaatttgaaaggctccgacggtattatccgtcggagcctttcgtcgtatgaatccggtgcttgtttttcggcttcgtctcagtgcctgaaatggctgaagaactcgatggtctcgggatcctgcgactcgtccatcacctcagcgggtgtgccgttctcggcgatgacgccgtgacggagcagtacgatgcggtcggccgcttcgtgggcgaagctcatttcgtgcgtggccatgaggattgtggtgccttgggcctttaactcggcaaccatgttgagcacttcgccgaccagcatcggatcaagagcggatgtgatctcgtcaagcagcagcagttccgggtcggtcatcagtgcgcgcgcaatcgccacgcgctgctgctggccgccagagagctgatcggggtaggcactggctttatcgcgcatgccgatgcgttcaagcagttccatagcgcgggtttcggcgcgatccttgctccagtggtgaaccttgattgcggcaagggtcacgttcctgagcaccgacatgtgggggaagaggttgaactgctggaacaccacgccgatacgtgcgcgaatcttgtcctggtcggcacgcgggtcggtgatatcggtattgcccagccaaatctggccgtcatcgacctgttcaagcaggttgacgcatttcatcaatgtggatttgcctgaaccggaaggccccagcaaagccaccacctcatgttggtgaatgtcaaaggaaatgccacgcagcacctgcgtgtttccaaaggatttgcgcacgtcatcaagacgcagcaccgtcttgttgctcacgggggagtcactcgcctcggtggtgatattggtcatttcgctcataccgttcctccgctgagttcgcgcttacgcagacgttccgtgtaccagtcgttcagcaggatgaacggcacgctcatcaggatgaacagcaggctggcgaccacatacggcgtgaagttgtaggtgctggccacgtcgatctgtgcggcgcgcacggcatccaccgcacccagcacggaaatcaggccgacgtccttttgcatggagatgaagtcattcatcagtgcgggcgccactttgcgcaatgcctgaggaatgacgatcagtcgggtcgtctggccggaggtcaggcccaacgagcgggccgaggctcgctgagaaggatgtacgtcgttaaaaccggcacgcagcacctcggagacgtaggcgctgtatcccattaccactgcaatggtgccgagtaccgagggatcgatacggccgaacaagcctaggccgggaatgccgaaaccgattagatacagcacgacgataataggcacgccgcgcatcacagtcgtgtagatcaatgccaggatacgcagcgggaacagaataggggagcggctggtgcgcaccagcgcgatcagcgtgctcagaatcgccacgccgaccactgcgacgagcagaacgcggatgttgagccataggccgtcaagcacatggggaaacgatttgacgaagtattcgccggagaagaaggtctccttgactcgtggccagccgggggagagcttcaagccgatgacgatgaccaccacgaacacaatggtgctgatcagactggtaatcgtcgattgaatttgctgatgaacacgatattggcgtcgttcgagctcgacctgacttacctcgtgtccgtcaggggcattgtgctgcctggtttcggttggtgctgcggtcatgtgatgaatgtcgctcgcttcctgaatgccgggatggccgggtgccacaggaaaattcccgcagcgcccggccaaggtgttgtgaccttatgatgtaagcctacttcacttacttcttcagttcggtcaggtcggtggtgtactcggccagccacttgtcctgaagcttcttgatggtgccgtcggcgttcaggtcatccactgccttggtcacggctgcagtcagcttggaatccttcggcagcacgatgcccatgccgctcttgtcttcggagtcaggcagacggccgagcaccttggcgtccttgacctgctcggactgcaccatgtacacgcattccacggtgctggtgaccagtgcgtcgatctgaccggcgtcaagtgcctgagccagtgcggcatcatcattgaacgtctggatgtcgtccttgatgttcgccttggcgtagtcgtaggcaagggtgccgaccatgacgcccacggtcgcatccttcagatcggataccttggtggcgttggcgaacttgctgtctttcttgaccacgacggactggctgtcgttgtagtagctggacgagaagtcaacggccttcttgcgctcgtcggtgatgccgaactgctggatgttgaaatcccagtccttggcgccgggagcgatggcggtgtcgaatgcggtgcgggtccacaccacgtcgctcttcttgaaaccgagcttgtcggccactgcgtaggcgacggccgcctcgtagccctcaccgctttccggcttgtcgttcataacccacggctcgtaggccggctgtccggtggcgatggtcagcttgcccggcttgtacgtctgctgggtgatgtcgtccgaatcggtggaattggatgcggtggactggccggaaccgcaggctgcggtgaacgacagagccaggatgctgacggtggccgcaatggtacggacgatgtgtcgcttattgaacatgggtttcctctcctcaagtgttcgtcatgcacacggttcaaaccgtgcttgatgcattcgcgccaattgtatggctattgggttacaaaacatcgatattttcggatgctggctatcgccattgcttatggccgactagagccgcgcaatctggcgcgtaagcggacggatatctcatattggcgcagagcgaaatggcgttcactgttcgagtgtgaagccgtcgaatacgaatcccggactgaccacacaggagaccagcgcatcgccctggcctggcactgtgcgctgccagacgccagccggtacgaccgcatgtcccgatacggttacgtcggcctgatcggtggtgatgccggaacccaaggtgattacggttcgcttggattcgtcggattccggagtctcgtcgctgccgccgagctccagtttgaccgatgccgggccatgccacagccagacctcatccgcatcgaccttatgccaggcgctggcatctccctcgggcagcaggaagtaaatcagtgacgatagcggtcggcttgaggcctcatccgtgtgcggggattgccagtcacgcgtgtaccagccgccttcggggtgggtttccagtccaaggcgttccactatggaccgggcgtatggactcatgtcttgcaaagcgacgctcataatgagatctcctgttcttggcgggtttgctggtttttggcttcttgatatcaggtcaggtcagcggtgtcaccaggcgttgttgtaggcttcgcgcccggatatcaccgtggctcggttcgtgcctgcgccgtgcctcaccagtgtttccagcgtttcttcgatgccggccggagatgatgtgtcgacggggatgtcgaagaacgcgaaatcagccaatgcgcccgcgttgatttgtccaatgcggttgcggcccacgtgcatgcccatggaggcggcgccgcccagcgtcatcatacgaatcaggcgatgtgtcagatcgtcgctggcatagccttgttcgcgggccaggtcgtaaagcatcgacacatcatcaagcagatcgagggtcggcgtgctggagagcgaatcggtgcccacgcttaccagattgccttcctcgaggtattcgcgcaccggtgcatctttgccggtgttggtaatgcgattcgatcgggggcacaaggccacgcccacgccgcgctgacgtagaatacgccgatcctcgccattggcccacacgccgtgtgcaatgtgcacatccggtccaagcgagccaagctgatcgacgaactggatggcggaggcacctttgcccacttccttgagctgccggtagctttcccaatcgtggtcactccagtcggccgccgaataagtggtgagcaccggcggataagtgccggcctcgagcggggtctccgccagatggatatgcagtcgcatgttcagctgacgagcaatgtctggaagatcaacgaacggttcggactccagcgtatacggagcatgcgggctgatgccgaggtttggcagctgctcctcgttcatccggcgcaactgccggatgagctcagtgcggcccttttccatccattcggcgttgtgccagcccattacctcccaataagcgatgccgtgcatgccctgcgaagccagcgcgccggcggcgtccaaatcggtgacgatgtctgcggcggccgtcgttcccgattcgaccatctggcgagcgccgtcctcggcccactgcttccatggctgggtcttctgcgcctcggcgtacacctcgttgaatgccagttcccaggcgcggaaccgatcgtaggtgccttgcccgacctgcaccatgccgctgtactgcagatgagtgtgcgcgttgatcaatccgggggtgagcaccccatcccaatgccgttcatggatggtgccgtgagccgtcatttcctgcttcagcgccttcagcacccagcggcgtttacctacatgaaccacgcggtcgccatgtatggcaactgcgccatcgatgatgacggggcccgtcacggggatgatgagtttggcggaatacagtgtcacatcatcgataagctcggtatcgacggtcggccaggtgttgtcggtcatattctcctcgctgcgttgtgttcggtgccgtgtctatggctatcggtcggcgttctctcggtcgttttccgcgaatctggtcagtcgccaattgtagccgttgtcctccacggcatggctggctcggtatccgcgcgccttgagcgcgctggcggcgatgcgctggtcggtcgctgcgtcaagtctgataagcgtgtgatccagtgtgcctcgatgttccagaagatatgcgacggcgctggcctgtacggcgaagctcagatccatgatctcgattggattgccgcctcccaccgtgtagttcacgccatcgccgtcggcgattagcgtgagcgttggtccgttgggaacattgagttgcacggtgtccctgttgacctgtggggtgaagtcgcttacctcgtccaaggcgatttcgttggcgatgccgccgatcactgcgagcgccgcgccctcgtgcattgcgcgcatgtgctcaagtgtgaccgtatgtctcacgccagtggcggacaccaccatatccgcgcaagggagtgcctcgtcaatgtcttgtgcggcgaagccgtcgaacaccgctttgagtgaagccactggatcgatatcgcagatggtgacttcggcgccaagcgcgcgaatgcgccgtgcgaagccttggccgaccgggccgtagccgatgacggtgacgttcttaccgtcgaatgcatgctcgccgagaatgcgctgcatggtggtcacgcatgtctccccagtgccgtgggcgttgtcgaatccggttttcagcacactgtcgttaacggctacgaccgggtaggtgagggctcccgcttcctgcatctgctggaacgcgcgtacgccgctggtcgtttcctcggccactccaatgaggttcgccgtgagttcggggcgttcgagcgaagcgagacgggcgaagctggcaccatcgtcgatgatgatgtccggctgtatttcgtccagcaggtgcagggccgcctcgtgcgcctgttccgcggtccagtctcggctggattcgaccgtgattccttcccggcgcagctgttccgccactcggggatccgtggaatccgggccgcaatatacgccgacgattgcgccggcggccttaagcttgcgcagcagaatcgcggtctttggctccagtatcagacagacggcaatacgaatgcctgagaaatcgacgcgagtggtgaggctatccatggtgtcgcgtaataccggcatgtgctgttccgcgtactccattgcctccagtccgcttgccttgcgcatatcggtgatggaatcgatgctttgtgtgccgtcgcataggaattcctcgttgtgctcgtcggtcatcgtggcatcttcgacggtcatgccccattgctgggcctgagacttgatttcggcatgcttctgtggctccggaatcgcgagtcgggctcctgccagtgatcgattcgtcttctgggatcgggctgccgcccacgctgcaaaatcgctgtctgctgtaatgcttttcttcatattccccatggtacgcatgcatgccgctgctccgccgctgcgcgtgtggcgtgggtgaagagcgtgcttgggcgcgttgcgtgcgtcgacttcggcagcttcgaacaggcatgtcgcatcgaacaaatgttcgactgtgttgatatgctggtcgggccagcggtggtaaggaggtgatggcgatgggcagcggaacggtatcgacgcaacgcgagcatacctatattgccattgatctcaagtccttctatgcctcggtggagtgcgtggctcgtgggctcgacccgttgaccacgcatctggtggtggccgatgaaacccgcaccgataagacaatatgtttggcggtctcaccctcgctgaagaactatggcattcctggccgtgcgcggctgtttgaggtaaaacagcgcctgaatggagtcaacatcgagcgcgcggtccatgctcccggcggccgattaatcggggagtcctgcgatgcgtgcgacctggaacgctcgccggggctcaaagcctcgatggtcatcgccaagccgcgcatggcgcactatctggaaatcagcgggcaaatatatggcatctacctcaaatacgccgcacccgagcacatccatgtctactcgattgacgaggtgttcatcgacgccacgccatatctgcgctcgctgggtatggggccgcatgcgatggcgcgaactatcgtgcgcgaaatcctcaccaaaaccggcatcaccgccactgccggcatcggctccaacatgtatctggccaaagtcgccatggatatcgtcgccaagcacatgcccgccgacaaggacggcgtgcgcgtggccgaactgaatgaaatgtcatatcgtcggctgctttgggatcatcgtccgctcaccgatttttggcgggttgggcgcggctatgccaagaagctcgagcatgccggactgatgaccatgggcgatatcgcccgatgctcggtgggtcgtgcttcggattactacaacgaagacctgctgtatcgcatgttcggtgtcaatgccgaactgctcatcgaccatgcgtggggctgggagccgtgcgaaatcgcggatatccgatcctatgagccaggtgcgcacagcattagcagtgggcaggtgctcaccggccccgccgactatgccacggcccggctgatcaccaaggagatggctgatgcgctggccctcgatctggtcgataaaagcgtgctgacgaaccgactgacgctcgccgtcggctatgacatcggcagtcttgattcgtcaaagctcgattcgtgcgctgattatgcgatgaaacgtgccgctgagcgggcggcgaaaagctatcaagggccggtgaccatcgaccgatttgggcgcaaggtgcccaagagcgcggtcgggtcgattggtttgggcgatttcacctcgtcgtcggcacgtattcgtgaggctatgacgatgttgtacgagcgcattgtggattcacgcttgcttgtgaggcggttgaccgtcatcgccgatgatgtggccactccggaggagctggccgccggcaaacgctatgaacagctcgacttgttcggtgatgacggggcccaatcgtatggatccgattccaccagcgaaaaagatggagagcatgatatccagcgtgcgctgctggatgtgaaacgtaaattcggccgcaacgccgtcatcaaagccatggacatggaagacggtgccaccggtcaggaccgcaaccgtcagatcggaggccatcgcgcatgaccctgcaagagacccgtgcgtacgacgacatcatcaacctgccacaccatcagtcgcgcaagcatccgcacatgtcccgccaccagcgggccgcgcagttcatgccgttcgcggccctgaccggctacaaccaagtcatcgagcaaacagcaaaaaacgccgaaaccgccatcgctcaggccgaagcccaaggcgataccgatttcggcgcttgacaatcgctctcgttggaggaagtctcagattcgtcagcctacgtgacgttcgaagcggtggaagccggtgatcttgtcgatttcggccatcgcgtcagccggaatcacaaagcccgcggccttcatgttgttctccagttggctgggcttggaggcgccggcgatcacacagctgatctccgggtgctgcaggatccatgccatggaaagcaccggcaggttcgtgccgagctcgtcggccaccttgcgcagctgctcgaccttgtcgaggttctcatcggtcagcagatcgttgatctggtggtcggactgccaggtggcgcgcgagccggccggcagcggctggcccttgcggtacttgccggtcagcagaccctgcgcgagcggggagaacgtggtgatgccgatgccgagcttgcggcaggtgcccatgatctcatgctcgatgtaacggtcgtttaggttgtactgcggctgaaccacggtgatcgggtacaggttgtagcggtcgatgatgcgctgggcctcttcaaggcgagccgaaccccactcctcggaaacgccatagtacagcaccttgccttgggcgaccaggtcgctcatcgcgcgcaaggtctcggtaaggtcggtggtctcgtcaaaacggtggcagaagtacatgtccagataatcggtctgcatgttcttcagcgtctggtcgatgctctcgaaaatgtgcttgcgggacaggccgcggtcgttcacaccttcgccggtggggaagtagaccttgctggaaatgaccagttccttacgcgggtactgcttcagcgtcttgccgaggaagcgttcggccgcgccgccagaataggcgtccgcgcagtcgaagaagttgacgccggaatcgtaggcgagcttcacggtctccttggccacgtcctcagccgccgtgcccttgagatccgtgacccagctgcccagtgcgacctcgctgatcttcagtcccgacttgccaacgctgcgatacttcatgtgtgctccttgataatcaatcgtcaccgtcgtctcttcatggccggccgtgaacgctaacaattcttattgaaacagttcaaccccacttgaacgcaagttggcggctattgcgacacgccggtggtgacttcgcgggcgcaacgaatgaaatcatcaatgacgctccaccgatacgatgtggccggaacgccgaactgaatggcatatgcggtatccgggccgcaatccagcacgcgcaaagtacgcaaccgttcgccgtcaagcagcgctggcaggaaccgctccgggcataggcaggcacccatgccgtaatggcacagttccagcagagtcagtacgttatccgaacgggctgtgactttcggctcaaaaccggcacggcggaacagcagatcggcaatgcgtccgtcaatatcttgtgggctgcctaggagaaacgggcaatgctccagtgaggaaaggtcacctgcggcaatggcgcgctcgtccggcgcggttctgacggcatcgacttggccattcgccgcgccaccggtagcggccaaatccatccacagtgattgtgcgaggaccagcaccatgcgctcgttatagaaatccataagttcgatgccggccggtttcccggcgaagtccgccaccgccagatcaagatcgccgttcgccagccattgttgaatctgatcgttgcggccctcaatgagttcaacgatgatattcgggcagtcacgttgcatcgccttcacaatcggcggcatgatcgcccggctacgcgtgtaggcaacacccacgcgcagcacgccggcctgatcgccggcgatgtcgcgcatttcttggccaagtgcatcgcgatcgcggcggaatcgctgcgcatatcgcgcgaacaccgtgccggcataggtcaattcgagcggcacatggcgtacgaaaagcgtgcatccgagctcccgctctagggcggcgatgttcgcactcagcgtctgctgcgtgatccccaaccgtttcgccgccttgctgaagctatgttccgaggccacggcggcgaagtattcgatgctgagaaagttcatggcgatactcccgtgtgtatggcgtttgcgtggtgtgtgtatgacgtgtcgtggcgcgaatcaatgccacagtattaaacctgtaatagatatcagtttagtctgtatttctcctgttatcttaggtcatggctcgtgcgaatagcgttgatgtttgcgactgcgggtcatgagatggaatctgagatgaggctgtagccggaagaggagaggatcgcatgctggaagcgggcacgatgttgctgttctgtgcggtgctgtttgccagcgtcgccctcggctggtcgattattcccgcgctgttcgttggtgtgctgctgttcatggggtatgggctggttcgccggtgctcgttgcgcgcgatggcgagccatgcggccggcagcgtacggtccgcggggaccgtggtggtggccttcgtgctcatcggcgtactgacctcgctgtggcgggccagcgggaccatcgccttcatcgtggcccattcgaccgcggtgattcacgccgccacggtgattccgctgtcgtttctactgtgctcggcgatgtcggtgctggtcgggtcgtcgttcgccagtgcggcgactatgggcaccatctgcatgtcgttgggattgtcgatgcaggcgaacccggtgatgctcggtggcgcgattcttgcgggcgtctatgtgggcgatcgttgttcgccggtttccaccagtgccttgctggtcaaacagcttacgcatacgaacctgttcaatactattgcccgcatgctgcgcacgggtgcggtgccgtttgtgctgagttgtgtggtatacgttgcggctgcggtggtggagtggctgtgcgcgagcggtggttccggatttggtgcggctagtgcggctgctacggctggctcggctggctcggctagagcggctgtttcaaccaacgcaagcagcataaccgatatcggcggattgttctcatcggccttcgatttgcattggcttaccctagttccagcattactggtcatcgtgttggcgttgctgcgtgtggatgttcggctgcttatgctcgccagcattgccgcctcggtcgcggtatgcgtgggcgtgcagcacatggaatgggcagaactgttgcggctgcttattttcggttaccatgcgcaaaatccgcaggtggccgcactcctggacggcggcggcatcctctccatgctcactgtgatggccactgtctgtatctcctccgcctacgccggcatttttgccgagacgcggatgcttgctcggctgcagcaggtcatcgagatgctcggtcatcgcatcggcgcatgtggtgccaccatgattaccgcgacttgcgcggcggcgctcgcctgcaaccagaccctcaccatcatgctcactcaccagttgtgcggtgggctgtacggcgacgacgaatccgaacgctccgcacaagctatcgatttggaagacagtgccgtggtgatcgctccgctgattccttggtcgatcgccggtgccgtgccgcttgccaccatcaacgcgcccacgctcagcctggccgccgcgaccttcctctacctgctgccgctctcgcggatgctcgcctcggctgtacgccgccgctcgggatttcggactcggcatcgatcccaaaatcaaaacccgggactcgccatcccacaccggcccaaacccatgctccacatgttcgctcatggtttccatcctaagtcgggcgattgagcgcacgaggcaatcaggccgagaactgtttgccgaattccgagaagagctgacggcgggcgaagacgagcaggccgagcagcaccagcagggagaccagcccgctgaccatcaccagtacatcccacggagcccagccgagcggaatgaacgtcagaggcatcagaccagcgacgatgtcgaacgccagatacttggcgtactcgtcaatggccttggcccgcagcacgataagcagcaccacgtcaaagaccagcgaaaccagacacgtgatcggtatgacgaacatggtgacgacatgattcatcgtcgccacaaaccagaccagcgcaatcgccagcatgatatagaaatatcgaaacatgaggcgaagcggccgcggcacgtgcagaatcgcactattgatgaacagcacgctgatgatcagcgcggccgccgatgcactggcaatcggtatcggccacgaaaacagatagctgaagaagccatgcagcagcaaaatcgcgccggttacaaacgtgatgatttccaccgccaaacgcctcggacgcagatagatctgctgcgcggggaatgcggcgggggaggcctcgccgcgcaattcgttctggcagagcgggcaacgggccatatcgccggtgaaatcgacggtgcaggcatcgcaatgcttcatgccgacgctcctttctccacatgcacgccagcgatgttcatacggccgctgatgccctgcgcggcgagaatccgacacaggttcttgatgacgttcagatcatggtagatggtggagatgccgatgctcaggtcgtcgccgaacgagcagaccgtgaaattcaggctggccggtgtggtgaggaagctcaccgaacgtacatggcgcgcgagtcgttcgtccaaggtgactcggccaaggttcgagacggtggtcgtggtctcgcggtcggcgatgaaccgggccagctccagcacccagtccttggcaggggagggcgcaagacgcagcaccggattcttttccagcgcaatcatgcggttcatatgcgattcgacgcgctcgcgactggtggcatggccgagctgctcctgcacatggcgggcgatgtcggccaacggctcatcggtcagcaatccacccataccgttgccgtgcgcggtgcgggcggcggactgctggccgtcgccggctgcgtctgggcttgttgcggaagttttcgcggagtcctcgtcggcttcgatttcggccggcgtgtacgccacgtaagtcatgccgtagaagttgcgcacggtctccgacctgaagaaggcgcgcaagtcgaccggaatatccacgcgaatcgcgcgattgcgggcgcgcgagggcatgacgtcgcgaatcgcgcacagtatcgcggcgatgaggtaggaggtgagactcactccgcactgatgcgctgcaccaagcaccttgctggcgctgacgtggtattccatgaacgtaggcgcggcccggtcgatggggccggccagccggtagatcttcgtgcctggcgcagcgccggccttgtctttctcgtagtatttgtcgaagctgttttcggctttgtcgctatccgaaccgtcgtaatccgaaggcacgcccggcacgtcgtatcgctcggcgatgtaggcgtgcagcagcgacttgaacaggttgatggcgccgcgaccgtccgaaatgatgtgcgagacctcgagattgacacgattgcggaaatagcttacgcggaacagcatgcttttgggcccgtaatgcagtcgcgagcatatcggcagatgttccggctccaccagcggccggccgtctgactgttcgaggtaatgccagaacatgccgttgagcaggtgcacgttgaagctcgggaactgggcgatggcatggtcgagcgcgtgctgcaggatgtccggatcgatgccgtccgccagctcggccgaatagcggaacacggtctgcgaggagcggccagcctgggaggagtagaacttgccgatgttgtctagtcggtaccaagtacgtcttgccacgcgtcgcctccctccggtgcgttggcggtggtgccggtgccgggagctggttccagcggtgtgccgtcgaggaaatgctcgatgattcggtaggtggtggccaccagtcccacggccgacgtattgagcaggtagccgtggatgccatcgtgaattcggtaacaggagacgttgtcgttcaccaattgcaggcgacgggcgtacgcttcgtcctcgtctctgagcgggcagtattcggcggacaacaccagcgtgcgcggctgattgctcaggtcgtgcgcggtgagcggcgcgaaatacggattggtcagatcggccacggacgaacggtacatgtcgatgtagtcggccatgtcctgtgcggtgaggatgtagtcggtgccgttggtccgcaccgattcgaacgggctggtctcgggattgtaatcgttgccgactaccgggtaaagcagcatctgcgtgcgcggcatgaactcgccgcggtcgcgggccatgagcgagacggcggccgcaagattgccgcccgcgctgtcgccaaacagcacgatgctgtcgggatccggtgctgggattgtcgcagatatatcgcccccgccggcgggggctgtcggcgcagccgactgggggtgatcaacatcaacagaaccacccaccccagaaatcggcaattccccagcaaacagctgccgggctacctcatagcaatcctcaacagcagtagggaagcggtattcaggagccagccggtactcgactgagatcacacggcgttgcagacgtacggccatatgcgcgcaagcctgcgtgtacaggttgatgccgcctgtggtccaaccgccaccgtggaaaaacaggatcgtgccacgcggcgtgactgagggaagttccgtgttggcattgccggaaataccgtcggcgttgccgctcgacgtgctttccttgatgagtattttgggtaggactttgggtaatacggcgggcagaatcgcggatattgccgaggccacgggcgtgccattggcggaagattcctccagggcttcgggcaggggcgctccataggcgaccagcggcgtgaacactcgcaatggtacggcatatccatccgccataggcgcgaaggcgtcctcgacacggcatttcggattgtcgggtgcctgcttggcgataagctcttccgccacgcgctgcaatttgtacgacttgcccgcgttgggcttgatgtagctggcggccttcatcgcggcgaacaatgcctcgttgatcggcatgacgacaggtcctttcagcggcggattcggtagtgcgaacaccccaaccttagcccatgaccggcatgaacaaaaaagggaaggaacccgagagttccttccctgtgtgccgtatcagacgcgatacgcgccgattatcaggcggtgaagtattccacgccggcctcgaagatcggctggtacttgttgccgggcacgttgacgtacaggccgttgccggaacgctccgagtgacccatcttgccaaacacgcggccgtccgggctggtgatgccctcgatggcgagcagcgagccgttcgggttcacatccaggtccatgccgggggtgccggtctcgtccacgtactgcgtggcgatctggccgttggccctgagctgggcgagcacctcgtcggaggccacgaagcggccctcgccgtgggagatggccacggtgtgaatgtcgccgaccgaagtcttggacagccacggggagaggtcggaggccacgcgcgtgcggaccagtcggctctggtggcggccgatggtgttgaaggtcagcgtcgggcaggcgtcggtcatcggcacgatgtcgccgtacggcaccagacccagcttgacgagcgcctggaagccgttgcagatgccgagcatcagaccatcgcggttcttcagcaggtcacgcacggcctcggtgacggccggcgcacggaagaacgcggtgatgaacttggcggaaccgtccggctcgtcgccgccggagaagccgcctgggatcatcacgatctggctcttgttgatctcgtcgaccaacgcctgcgtggattcggcgacggcggccggcgtcaggttgttgacgatcagtgtggtcacatcggcgccggcacgctcgaaggcggcggcggaatcgtactcgcagttgttgcccgggaacaccgggatcaccacatgcggcttggccacggaagagccgacgtacacggtcttcttcggcgcgtggaagtcgatggtctcgacggtcgcgcccttgtcctcgcccttggaacggtacgggaacacggattcgatgccggactcccaagcttcctgcacagcgtccaggtccagcgtctcgccggcggccttgaacacgtactcggaggtggtggtgccgatttcgccgatctcgaccaaattggagacggccggaagcttggcatcgtccgccagctcgacgatgaacgaaccgtatgccgggatgaacaggtcgtccacggcgatgctgtcgttcagggtcacgccgatgcggttgccgagcgtcatcttgaacagggcttcggcggtggcgccatagcccggcgtagagacggccagggcatcgtggaagtcggtgagctcctcgatcacggagaacacctcaagcagcgcatccttgtccggggtcagaccgtcggccaggtagcgcggcgcgatgcgtacgatacggtgatcggcgtccttgaattcaggggaggtggcgcgcttcatgttgcccacggccacggcgaaggagatcagcgtcggcggcacgtcgagatcctcgaacgaaccggacatggagtccttgccgccgatggcgccggcgcccaggtccacctgggccatcagcgcgccgagcacggcggccgccggcttgccccagcgttccggctcgtcgcgcagcttctcgaagtactcctggaagctcaggtaggccttctcatgctcgaagccggccgcgaccagcttggccagcgactcgaccacggacaggtaggcgccggtgaactggttcttggacatgatgtacgggttgaagccccacgccatcgccgaagcggtggtggtctcgccgaacaccggcagcttggcgaccatggccatgttcggggtgagctgacgcttgccgccgaacggcatgagcacggtgcccgcgccgatggtggagtcgaagcgctccgaaaggcccttgttggaggccacgttgatgtcggtgaccagcttgttcatgcgttcggccagcgtgccctcgccccacggggtctcgtaggactgctgttcctcgacatgcacggtctggtgcttggaagcgccgttggaggccaggaactcacgggacagattcacgatcttgtcgccgttccaggtcatcaccatgcgcgggtcctcggtcacggtggcaatcaccgtggcttcgaggttctcttcgcgggcgtaggccaggaactcgtccacgtcctcggcggccacgtccacggccatgcgctcctgggattcggagatggccagctcggtgccgtccaggccctcgtatttcttgggcacggtgttgaggtccacgaacaggccgtcggccaactcgccgaccgccacggacacgccacccgcgccgaagtcgttgcagcgcttgatcagacggcaggcatcgccgcggcggaacagacgctgcagcttgcgctccaccggagcgttacccttctgcacttcggcgccgtcgagttcgagcgattccacgttatgcgccttggacgaaccggtggcaccgccgatgccgtcacggccggtgcggccgcccagcaggatgattttgtcgccaggggccggggtttcgcggcgcacatggtcggccggggtggcggccacgaccgcacccacctccatgcgcttggccacgtagccggggtggtagatctcgtcgacctgaccggtggccagaccgatctggttgccgtaggagctgtagccggcggcggcggtggtcacgagcttgcgctgggggagcttgccttccagcgtctcggagaccggcacggtcgggtccgcggcgccggtgacgcgcatcgcctgatacacgtaggagcggccggacagaggatcgcggatgcagccgccgatgcaggtggccgcgccaccgaacggttcgatttcggtggggtggttgtgggtctcgttcttgaacaggaacagccagtcctcgtcgtggccgttcacgtcaaccttgaccttgacggtgcaggcgttgatttcctcggactcgtcaaggccggtcaggacaccgttcttcttgagccacttggcgccgatggtgcccatgtccatgaggcagacgggcttggcgtcacggccgagctcgtggcgcatcgccaggtaacgctcgaaggcggccttgacggtggcgtcatcgatggtcacttcgtccagctcggtgccgaacgtggtgtgacggcagtggtcggaccagtaggtgtcgatcaccttgatttcggtgatggtgggctcgcggctctcctcgctgaagtacttctggcagaattcgaggtcggccagatccatggccagaccgcgctcgtcgatgaacttctggccggcttcggcgtccatctcgttgaaaccggcgatggtctcgaccttgccgggcaccggcacctgggtcttcagggtttccttggtctccaggctggcctcgcgggcctcgaccgggttgatcacgtaatgcttgatggtgtccacgtcggcgtcggtcaggtcgccttccagcgcgtacagcttggcggagcggacggtcgggcgctcgccctgggagatgagctggatgcattcggcggcggagtcggcgcgctggtcgaactggccgggcaggaactcggtggcgaagaccttggcgccggcgaagtcgggcaggtcgtaggccacattgtccacctgaggctcgctgaacacggtgggcacggtctggtcgaacagctcctgggagatgccttcgacgtcatagcggttcacgatgcgcagggccttgaggccggtcagtccgaggatcgtgcgcagttcgcccgcaagctgctgggcttcgacatcaaagccgggcttcttttccacgtacacgcgaaaaaccatggaaatcctttcttgaaattaaagacaattggctcccctcgagaggggagccagataatgcattactcggcgacttcgatgccttcggacttggcgagttcggcgaggcgctcctcgatctcttcgtaggccgggatgatgctgccgagaccacggcggaacaggtccttgtcaaggtgctcgaccttgccggagtggtccttctggtcccacagacggcaggaatccggggtgatctcgtcggccaacagcagcgtgccgtcggtggcgcggcccatttcgatcttgaagtcgaccagcttgacgtcgatcttggcgaagatctcgatcagggcctcgttaatcttgcgggccagcggggcgatctcggcgagatcctcgcgagtgcatacgccgagggccaccaggtcatcgtcgttgacgaacggatcgtgcagatcatcgttcttcaggaagtactcaagtaccggctccttgagcggcaggccttcctccacgcccagacgggagcagaagtggccggcggccacgttgcgcagcacgatctccaacgggaacatgttcaccttgcgcaccagctggccggtgtcgtccactcgcttgataaggtggctgtcgatgccgcgcttcttgagcaggtcgaagatgatggtggtgatgaggttgttcagacggcccttgccggtgaagtcttccttcttttcaccatcgccagcggtggcggtgttcttgtattcgacccacagaacctcgggatcgtcggttgcgtacagttgcttggccttgccctcgtagagcttttccagcttctccatgactcacctttcaggagtggaatttctgggtgaactaacggtaaaagggtaccaatcgagggctacaacaacactcagcatgacgctacgatgcggccggcgcatcatacgtcgctgcatcgaacggccatacgctgttgggatggcggaggcggccgtcattggccagtacgatcagctcgtctccggtcgtgtagccttccggcatgaaggtatctgcagaagcgcgtgtgaatactcagatgttcgtcaatagacgaaacatgactcttcggccatatacacacgataatgggagtgacgaaatggtacaaggaggttcgtcatgatcgttcatccacgacccggacggcaataatattgaggccatgctgagctgatcaggccgtggactactccacggtaatcgtcaacgcatcggccacgaggccggccttggcacgggcgtcggcttcggactcgccgacggccagtgccacggccatgcggcggtggccatgcacttcgggcttggcaaaaatgcgcaggtccgtgccgggttcggccagagcagcggccacatcggtgaactcgacctcaccgtcgccggccaccacaatcgcatggcttgccgccaccgagccggccggaatcgtgagcgacacatgctcgggggtgatcggcaggccgagaatcgcgcgggcgtgcagcgcgaactcgctcagacgctgggaggccattgtcaccataccggtatcgtgcggacggggggagacctcgttgaacagaatcgagccgtcggtgagcacgaacagttccacgccgaatacgccccaaccggtttcgccggccgcctgagccttggccaccaagccttcaacggcggtacgtgcgatgtcgcgcgcccgctcggcctcaccatcgggttcggtagccggctgccaggactcgcggtaatcgccggactcctgacgttggccgatcggcgcgcacgtcacaatgccggcggacgaagaaacagtcagtaccgtcagctcacgctccagcggagcaagcgcctcaacgatcacgcgcgacacatcgccctcatcggcggcgcggcggccctcctgcgcttcggtccaagcggcatcgatggcgtcggcggaacgcaccaccgactggccgtgaccagacgagctcatcaccggcttgaccacgcacggatagccgacttccgaagctccggcgcgcagctcttccagcgagccggcaaaacgatacggtgtagtcggcaagcccaattcttcgtgggccagtacgcgcaggcgctcgcggtccatgcaaatcgcggcgatttcggcgctcggcaccacctgggcgcccgcggccgcagtaccggccagcacatcggtggcgatggcctctacctcgggcacgatgatgtccggcttgatttcatcgaacaatgcctgcaattcggcggcattcgccatatccaacgcgcgatattcatgcgccacctgctgggccggagcgccggcatacgagtcagcggcgcacacccacgcgcccagtcgcatgagctcgatggccacttccttgcccagctcaccagcgcccaaaaacagcacgcgggtggggtgcttgcccagcggtgtgcccagcgggcggttggctgcgcgagttgcgggggagacggcggaagtctcggcgggaattgcgggagaggaggtggaagtcacggcagtatttacggcgttctcagtcatacccacattctgccatgccgcgatgatttcgcctatgcggggctcgaattcggcggcgtgcgctcgctgagcctgctggagactccgggcgcgctggacgtggcgctgatgccgggggtctgcttcggtcaggcgggcgaaggctgggtgcgcatcagtctgctcaagcacgccgccgagttgttccaggtcgtggcccacgtcgatcgtgtgctgcggagcgcgtgattcaatattgggcaaaatgcggcagcccataccatttcatacgcgttcaggcagcgcggccgacgccattgcagcgcggtggtttaggatgaggcaatgcgcgaaaacgggattgaagagagcattgatcgtccgctgactatcgctcttgtggtcgatacggtgggcaatcagggcaacggcacctccaattcggccttgcaatgggctgcagaattggagcggcaaggccatcatgtgaggcttgtcggtataggggcgcccgaatatccggcgcgcgtgaatagggtgccgctcgtctcgtgggtggccgccaagcagctcatgcaattcgccgaacccagcgacacgttgttccgcaccgccttccaaggcgtggatgtggtgcatatctatatgccgttcaaattcggccgtcgtgccgctaaagtcgcccaccaaatgggcattcccgtgactgccggattccacctgcagccggagaacgtgctgtattcggccggcccgctacgtcgcattcccggtatttccagcttcctgtactggctgttcaagcactggctgtacaagcacattgaccacatccatgtgcccaccgaaatgaccgcgagcctgttgcgcgcgcacgggtataaagccaagttgcacgtgatttccaatggttattcaccggtgtattcgccgaagaagccggccgatccggatgcctcggctcccgtgccgttccgcgtcatcgcttccggccgactggctagcgagaaagatcagattacgctgatcaaggcggtgtcgatgtcccggcacgccggcgatattcagctggtgatcgccggtactgggccgctcaagcagtatctcaagttccgcgccgggcgtttgctggcgcgcaaggccgatatcggattccacaagcacgccgatatgcccgatttgttgcgttcgggcgatttgttcgtgcattgttcgattgccgacatcgaatcggtgagcgtgatcgaggcgatggcgtgcggattggtgccggtgatcgccgcgtccgaactgtcggcggccagccagttcgcgctgatcgacgagtcgttgttccccgtgcgggacgcggccctgttggcccgacgcatcgattggtggattgcacatcaggccgagcgcgccgaatggggcgaaaaatacgccgaatacaccaaggcgcattattccgtggaagcctcggtccacaagttcgtggatatggaacgcaaggcgataggggagtaggagccttctcgtttgcggagaggtctttccctcagtccgcctgcggcggccagctccctcatcagagggagctacgaaaaaacctccctctgatgagggaggtggcatcgcgaagcgatgacggagggagagattagcgaagggttttacaacaactcaataagctgatcgacctcttcatgcgtggtggcccagctggtgcagatgcgcatcacggtatgcgtgtcgtcggccttctcggtaaagccgagcttgacctcgcgctccagacggtcgatagtcggctgatccatcgtcacgaaaatctggttggtgggcgcttcgaaagtgagcgtgtagcccttggcgcgcagggcctcgcgaatacgatcggccgcctcattggcgttgcgggcgatcttgaaatacaggttgtcagtgaacaaagcgtcaaactgcgcgcccagcacaaagcccttggccagcaaggcaccgtgctgcttgatgagggtcaagaagtgcttcggcgtgttgtgcttggtaaacaccacggcctcgccgaacagggcacccaccttggtaccgccgatgtagaacacgtcggcgatggtcgccagatccgcgagcgtcatgtctgaaccggtggcggtcagcgcgtagccgagtcgcgcgccatccacgaacagcggcatgtcgtacttgtgcgccacatcggcgatggcctgcaactcggccttggagtagatggtgccatattcggtgctttgcgagacgtacacggagcccgggaacaccatgtgctcgtagttgccgtccgcatagaaggtcttgcagaactcgtccagttcggtcgggtccattttgccgttgtgctggggaatcgtgagcaccttgtgcccggagaactcgatggcgccggcctcgtgcacgttcggatggccggaggcgaccgcgaccacgcctgcatacgccggggtgatggtgtcgatgacgacctggttggtctgcgtgccgccgacgaggaaccacacatccgcgtccggctggccgcaggcctcgcggatcttggccttggcctgatcgctcagttcgtcggacccgtagcccgaatacagatggttgttggcttcagccacggcttcaagcaccgcgggatgggcggcgcgggagtaatcgttctcaaaagacagcatgacggaccttttgtccttatgttcggtgaattggatatgccctgagtgtacaacgcggtggttcccggcatgcctatttggcctataacccaggagcggggaattcagggagaaaaaacaaaacccttccgcgaacggaagggttttactggggtggccaacgcggctcgaacgcgcgaccttctgaaccacaatcagatgctctaccaactgagctatggccaccatagtgccgtattcagcaagctgaattcgcgcaacaggtgaatactatacacaactttgcggatgtgtgctcatcggtgtgtcgcgatggaatcaagtggtcggtttcattcttggggccaggctgcgggctgtctcagatggcgggatgtggatgagtgggtcttgtgcggcgattgatgaaaagtcaaggcacacgacggtgtgatggtacgaccggggattgcagaaatgattacgtgagtgttcgcaatgtgagcattatgtttcatatcaaccgcgacccgcctagtttcatgcgatgttacctacaccaaacaagggaagagaaacaccatggaaaaggttaaagcctttgcagattggctgaccaagtggtttacggtcatcgtcatcgtctgggccgtcttcaactacttcgtgccggccgccagcttgtggggcaaggcgtacaccggctacatgctgggcatcgtgctgttcggcatgggcctgaccctgacgctggacgacttcaagcgcatcctgacccagccgctgatggtcatcgtcggcaccgtagctcacttcatcatcatgccgctcatcgccgtggccctgtgcgcgatcttccacctgtccggcccgctggccgtgggcgtgattctcgtcggctgctgcccgtctggcacctcctccaacgtgatgagctacctgtcccgtggtgacgtggccctcgatgtctccatcggcatcctctccaccctgtgcgccccgttcatgattccgctgctgatgcagctgctcgcttctcagtacgtgtccgtgccgactcagtccctgttcctcaacgccgtcaaggtggtgctcttcccgatcgccctcggtgtgatctgccacatgatcttcggcaagaagatcgagaaggttacggtcgccctgcctatcgtttctcaggtggctattctgcttatcatcggcgtggtcgttgccgccaacggtccgaagctgttcgtggccagctccctggtggccatcccggtggtcatcctgcacaacctgtgcggctactcgctgggcttcggcttctccaagctgatgtacaagatctacccgaagggcttccgctacgcacagcagaaggccatcaccttcgaagtcggcatgcaggactccgctctgggcgcaaccctggccctgacctccttcgcaaccaacccactcgctgccgtgccgtccaccttcttctccgtgtggcacaacatctccggctctatcctgtccagctggtggcgcaaccacgatgacaagcacgagatccactgggattccgacaatggcgagaagggctctgccaagagcaccgtttcagcggcccacccgttcgacgccgataaggccgccaaggtcgctgcctgaaatcctgaaatggtgagaaaggtcgggtaaggcacgactccagtcagtcggtcatccacctttcctacctcgcataacatagccgctcccgcttactcccgattgaggtatcgcccgttgtctaaatgaaagtgcaacacccgttagattggaaattgcctagaaaacgttttctaggcaatttccaatctaacgggtgttgcactttcatttagacaacgggttcttattgagaaccattcgctgcgatatcatgacagatatgacttcccgccgcaagactcttaaacgcgattggttcgacaaccaacctggcgcatgggtaatggttatgctgcccgctgtggctggcttctttatcggcgggcctaatcttgatacgctttggctattggcgacgtgggccgtgtgctattgcgtgcagttcagcgccgcgcactggttcaaagcacacttttcacgccgttatctgccgccgatgctcacttatgccgtagcgctcatcgtcatcggcttgccattcctgattacgcataccggcatactgcgttgggctcccttatatatagtgctggttgcgctgtcgatgctgtcctcgtggctgaggaaggagcgctcgctgtggggcaatgccgtgtcggtgattgccgcgtcggccatggccacggtgatcgagtcgtttggcagcactgttgagacggcatgtgttatgcccatcaacgcagcacatgcctcgtgcgcagccgctgatgtcaccgccgcacgcgccgcgattcggaatatgccagatttgagccagatattcgaccttcacgcctggtggcccgcgggttcattgcccgtgagcgggctgattgccaccgtgctgtttgcgctgacgcagtatgggtcggttttggtggtcaaaaccatgatccgggaacgcgggaagcgttcgtacgtggcggcttcgtgggtatggcatgtggcgctattgctgctagccgccgtgccggctggacgcagcccgtatctgattgcgatgactgtgctgctgttggcccgcgccgttgcgttgccggtggttacacggcgcacaaccttgaagcccgtggtgaccggcattaccgaggcgtttgccagctttattgcttttggctgcattattgcggcgatttagcgacgcttcagcgattccatggggtggtaacccactcatggggcggtaattgacccatggggcggacggtaaaattttaccttccgcagaatagagccgtttttgtacaccgccccatggggttttcaccaagttaccgccccatgagtgggttaccgccccatggaggtacctgctggctgagggagcgccacatatgcaaaggagcccggcccctgtaatggggtcgggctccttgtgtcgcgctatgcagacactaagctgcaacaccgcggttggtggctactgatggtgccaccaaccacaaaccgcctgcaatcaacgctcggaggcttcctcagtagcggcctcaccctcgcgctcgatgcgcagcttgtggccttccgcctgggagacaccgtagtaagcaccgacggcgatgtccttcatgtcgttgatcagcgggatgcgcgggttggccggggtgcactggtcctcgtaggcgcgcatgccgatctgatcgagcacggaccagaagtagtcctcgtccacaccgcaatcctggaagctcttgttcatgccgagcttgttgtcacggtagtcctcgacggccttcgccaggttctccacggcttcggccggggtcttgccggtgtcgatgccgaggttgcgggcgatatcctggtagcgttccggggcgatgtacttgttgtacttcggccaagaagtgggctcctcaggaatctggccgttgtaacgaatcacgtacggcagcaggatggagttggtacggccgtgggcgatgtggcacagggcaccgatggtgtgggccatgccgtggcacatgccgaggaacgcggagccgaatgccatgccggccatggtggcggcgttgtgcatcttctcctgagcgttggtcttggccaggccgggctcgccattgacggactcagccaggttgtcccagatgagcttggccgcgtgcagggccatgccgtcggtgaagtcgttcgcgtacacggacacgtaggcttccatcgagtgggtcagggcgtcgaagccggcgtcggaggccagcttgcgcggctgggtgcgagccagcaccgggtccacgatggccacggacggggtcagcgcgtagtcggtgatcgggtacttgtagccggtcttgtgatcggtgatcacggcgaacggggtgacctcggaaccggtgccggaggaggtcgggatgcacaccagcttggccttcttgcccagcggcgggatcttgaaggcgcgcttacggatatcgaagaacttctcgcgcacgtcggagaaggcgatttccgggtgctcgtagagcagccacataatcttggaggcatccatcggggagccgccgccaaccgcgatgatcgtgtccggctcgaactcctcgcgcatcatctcagcgcccttttcgacggtctcgacggagggctccggctcgacgtagtcgatgatgcggaaggtcacacggttagagcgggcgcgcagctggtcgatgatcttgtcgacaatgccgagctgctccatgaccttatcgcacacgatgacggccttctcgatgccgtacatgtcgcgcaggtacttgatggcgttcggctcgaagtaggtcttggccgggatcttgaaccactgcatgttgttgttcctccgagcaatgcgcttgatgttaacgagattcacggcctgcacgttgccggacaccgagttgccgccgtaggagccgcagcccagggtcagcgacggggcgatggcgttgtagatgtcgccgatgccgccgagggaggaaggctggttccagatgatgcggcaggcgtgcatacggacgccgtactcacgcacgagctcctggttgttggtgtggatggcggcggtgtggccggcacccagcttgagcatcttctcgcacatctcgaaggcctgctccttgttgtcggccttgagcacggcctgcaccggagcgagcttctcgtgggtcagcggctcgtcgtcggagacttccttgcactcggcggccagaatggtggcgtcggccggaatctcgaagccagcagccttggcgatgaactgaggggacttgcccggcaccgcggagttcagcacgggcttgacgccggaaccggcagtgcagccgaacatgtactgttccagcttggccttctcttcggcgttgacgaagtaggccttacggaccttgagctccttgatgagctggtcgtagacgtccttgtgggcgatgatggcctgctcggtggcgcagatcatgccgtaatcgaagtgcttggagagcaccagatcgttggcggcgcgcacgatgtcaacatcggtgtcaacgtaggccggggcgttgccggcacccacgccgagggcgggcttgccggaggagtaagcggccttgaccatgcccggaccaccggtggcgaggatcgtggccacgcccggatgcttcatcagggcgcccgtggcctggatggacgggtgctcgatccactggatacagttctcgggagcaccggcttcgatggcggcgtcgcgcacaatcttggcggcctcgacggagcacttctgcgcgccggggtggaagccgaagacgatcgggcaacgggtcttcagggcgatgagggacttgaagatggcggtggaggtcgggttggtgaccggggtgacgccggcgaccacgccgacgggctcggcgacctcatcgatgcccatcacatcgtcttcgcggatgatgccgacggtcttctggccggccaagtagttggtgacgtgctcgcaggcgaagatgttcttggtggccttgtcttccacgagaccacggccggtctcgtcgacagccatcttggcgagaacgaggtgcttgttcagagcggcgatggaggccttggcgacgatacgatcaacttgcttctggtcgaggttctcgaattcgacgagagccttcttggcgcgggcaaccagcgcgtcaacttcggcctcagctgcggcctgcttctcttctggagtcggcttggtagcttcgaccttcttctttgcttctgccacttggggtcctcctcgatcttcttggggtatatggcaaagttctgggccatcgcctcgtcacctcagttgcaccagcgggataccgcctcagtaaccgaaaatgaccggtgatgcgttgtcacattgcatatgtgacctgaggcacaatatactgaacggtccggcgcgatgcatacgcacaaaatcgacggcgtttcacgtgcgatattgaacagtttttgttacgagttgtgcgaaatatcgaacaaatcctcactctatccggcgatttggtactttttgttcactttttaccgaaaatcacatgcctgcaaacaacacaatccgagaacttttttaaagtaagttttcaaaagcaatcattttctccacatttctagaaagttggtttaaaaaagtacccaaaatcgcctacaaatatacgattgttgcctcataacctccgcgtcgaggcacatgaaagccactttcataaagtaaacttgcatatatctcatcgcacaaaggggtaaacatgagggcaatgccatcgaccgcagtgaaagcgcacaaccgcagtgccatggcccagtatctgtatggccatagccatgtcaccaagcaggaactggaacgcgaactcggcctcagcctgcccaccatcacccaaaatctgcacgcactagaagatgacggactcatccgcaaaggcgaactgcaggattccaccggcgggcgcaaggcgcaaaattatgagttcaatcccgatcatcgcactgccatcggggtagtgatgcggtccaacgaactgcgcctgtgcgcgattaacctgtacggcaacgtcatcgaaaaacgcaacgatgccctgccttaccgcaacaccaacgtttactaccagcgtatcggcggcatcatcaacaacttcgccgccgacgtcgaaaagaagcacggcaaggtgctcggcgtctcgttcgccatccaaggcatcctctcccccgacgccaccaccatcatcttcggcacaattatgggcaacactgggctcacgctcgaaaccatcagccaatcggtccattacccgtgcatgatgatccacgattccgatgcctcagccatggccgaactctggttcgactccacgctcaccgatgcggtgtgcgtctatctggagcgacgcccgggcggcgcggtgatcgcggggggcaaactgtatcaaggcccgaaccagtgcaacggcgccatcgaacacatgacgctggtgccgggcggccgcgaatgctactgcggccagcgcggttgcatggacacctactgctcgccggagaccttgcccgaggattacgaaagcattcccggcttcttcagcgtgcttgagcagggcgaacggcatcatcgcgagcgcatggatgagtggctggattacgtggcgcaggccatcgtcaacgcgcgatccatcatcgcgggcgacgtgattgtcggcggtgaagcagcccagcatcttgaagacagcgacatcgaggatctggagacgcgcgtcatcgcacgcagcccgttcggcaccgaccatttcaatctgcgcaagagctactgcgccgaagatcagaacatcatcggtgccgcgttgcggttcgccgagaattatctcgacggcatctgcggtgctgcggaacgcggcaggaaatcaagggcttccaccaaaagtgacaacacgtctacaatggaggtatgaaaaacccaccgttgcatcgttacgccactcgcccagggctgtacttcactgacgacggtggggctgacgtcgttgttcgttccgaaactgccgatcaggtttggctatgcgtactggagcccattgatgagcccagcgctttcttccaagacgccatccgcctgttcgaggacccgaatatctcctttatccagcagattcatgagttcccggtatgcacacgcattatcgaacatttgtatctgcgcgagaccttgttccgcatgaccgggccgaactacggcctgtggtacgtgcacctgcccaaagcatgggacggcatgcgttatggctaccgcgtggacggcgcatgggacccgaaacacggcgtgcgcttcaatccatacaaattcctgcttgacccgtatggcaagggcatcgacggctccatggagctcacccccgccgccttctcctatgaatgcgatgtcgtggaccgcaaggtaatcggctcggcatatggtgccatgagcaccgtagactcgctcggccatatgccggtgtccgtggccatcgacgatcgcgatacccataagcatgagggcgacccgcagcacccgcatgtgccgtggcgcaaaaccgtcatctatgagatgcacgtcaaaggcttcaccgccaacgcaccgtggctgcccgaatcattgcgcggcacgtacgccggactcgcacaccccaccacgctcgcctatctgcagggtctaggcatcacatccatcgaactgctgccgattatggccaagcaggacgagctcttcctgcaagaacacggccgcaagaactactggggctactccaccctcagctacttcgcccccgaaccctcctacgccactaaagccgcccaggagaagggcgcggccgccgtgcgccaagaagtcatagacatggtgcgcgcactgcacgaggccggcttcgaagtcatcatggacgtggtctacaaccacacatgcgaaggcggcgtcgaaggcccgacggtctgctggcgcggcctcgacgacctggcctactatcgccatcaaaaatccaataccggacgactcgaagacaccaccggttgcggcaatacgctggacttcaccaacacgcatgtggtcacctttgccatcgactcattacgatactgggccaagcgtatcggcatagacggtttccgcttcgaccttggcgtcacgctggcccgcctggaaggcgaattcacccatcatcacccgttcctctacgccctgcgttccgatctgctgctgggcaacctgaagctcattatggagccgtgggatctgggcaacctcggctggcgcaccggccaattctccgtgccgttcgccgaatggaatgaccgcttccgcgatacggcccgcaccttctggcttgaggatgtggacggcggctccgatttcgggcgtatcagtttgcaggagatggccacgcgactctgcggctcggccgatctgttcgccaccgaaccagggcgtggcgctccggcctccatcaatttcgtgtcctgccacgacggtttcacgctgacggacctcaccagataccgctccaagcacaatgaagccaacggcgaaaacaataatgatggctcgtcggtgaaccattccgccaatttcggcgtcgaaggcgtcaccgatgatccagacgtcattgcggcacgcgaacaggcggccatgaacatgatcggcatgctgctgctctcgctgggtacgccgatgatgctcgccggcgacgaattccgcaacacgcaggacggcaacaacaacgcctactgccaagacaacgacatcacgtggctgaagtgggattggatgtattccaccaacaagacgcgcgaaatgcgccgcttggaaaccgtgtctcgactggtggcgctgcgtaaatcactggacctgtatcaccacgaggatttcttcacccgactgacccagatcggcctactcaagccctcaagccgcgtgcagtggttcctgcccgacggtaccacgccgatggagcgtgactggttcgatctgggcgtacgtagcttcaccatgcgattgctgtccaacagtgaggtggacgtgtgcattgtggtcaacggcaccgctgacgaccgcacattccgcctgccgccagacacccactggacgcctaaatggtgctcggccgaaatcaacggccgccgagccgggcatggcactcaggtcgaggaatgcgatttgaacggtgacaccaccgtctggacgcagcatgtaccggacgccagcgagacagtactcaagatggtcgaagaagtggccatgcagcgtacggaatcctcgactgagaatgaagcggataccatcaaattcgcgatgccagtaacagatcacgccgcaaacggcacctcgtccgcgcctcgggatgaggtatcagctgatatgcccgatgcccctgtggatgatacaccggacactcccgtcgacgacaatgtctggaccatgccggcgctgagcatcacgctgatgaagcaggtgtgagtcacactcaagacagcgcgacacaaacacaaaggctctccgcggaattccgcggagagcctttgtatgctcggtacaggacaagcgaaattaacgcttggagaactgcggggcgcgacgtgccttgtgcagaccagccttcttgcgctccacgacgcgagcgtcgcgggtcaggaagccagccttcttcagggcggcgcggttggcatcacgatcgatggcgttcagagcgcgggcaacgccgaggcggatggcgccggcctggccggtggtgccgccgccgtcaacgaggacgatagcgtcgaacttgccttcgagcttgagcagaacgatcggggagttgacctcacgctgcagcagcttggaggggaagtactcctccagagtgcggccgttgatggtccacttgccgtcacccggaaccagacggacacgggcgacagcctccttgcggcgaccggtgccgtagcccggctcaatcgcggaggtgccggtgccagcgccagcgttggtctcggtggtgtagttggtgagctcctcttcggtctcgacaacctgggagtcgttggtgttttcagccatgattcttatctcctctcaggtttcacttggcctgctgcgagacctgggcgatctcgaagacctggggcttctgcggggtgtgcgggtgctcggcgccacggaagatacgcaggcggtcgagctgcaccttggccagacggttcttcggcagcatgcccttgacagcgttcttgatgatgcgctcggggttcttctcgagcagctcggcgtaggagtcacgacgcagaccaccgggacggccggagtgcgagtagagctccttgcccatcttgttgccagtcagagcaatcttgtcggcattgatgatgatcacgtggttgccggaatcggcgtgcggagcgtaggtcggcttgttcttgccgcgcagcaggattgcagcctgggtggcgagacggccgagcaccacgtcggtggcgtcgatgacgtaccagtcatgagtcagatcagctggcttcggagtgaaagttttcactggattaccttttctatattgtgttccgggtctcagctgcttggtgtggcttggtcagggccgcatccaagaggcgtcgaacctcattatccgtgggctccctgaaagtcctcgatggcgagtgggatagcgctttgaaggaccccttagggaaacacaacaatccactagtatatcgccgggcttgacatagggcaactggggacactccattgggtttatggcttctcttcccctatttatggtttctctcccacccacttcggctaaccgactcacctacggtgaggcaattccctgccttctctcagctatcgcttctttcaggcctcgtctacggacagtccactggactgtccgcttaacgactcggctcgtcagagggaggtaaagcgggtcaggaattgaagatttgggcgaagcgttgggcaccgggggtgtcgaagagggtttcgagcggtaccacgttgcccttggcgtcggccagtgggatgcgccagttcgggtattcgttgttggtgcccggctggttctgcgcacgcttctcccccaccgcgtcggtgatcgaggcggcgagcagcttgcacggcgaacccttcagtgcgtggtacagcgcgtcgacgatatccgcctcgtgatcctcacgatgttcggcaaagtcggcatcaagataaccctgctcgaccagcatggccagcatcgcatcctgctcggccttggcggaggcttcgaattcctcggccgggccggtcagcaagcccagacgctcacgaatcttgacgtgctcgtattccaggtaaccggcggccggcggcaaatcatgcgtattcacggaggccaatgcatacggacgccactgggagggggcgcggaacacgccgtcgcactgctcgaaccattcaacggcgcaaccgagaataccgtggctcgacagggaatcggccacatggtccggcaccacgccgaggtcctcacctacgaccacgccgccggcgcgagaggcctcgatggccagaacgcccagcatgatgtctgagtcgtagtacacgtaagcgccatccatagccgaacggttctcgggaatccaccacaggcggaacagaccaaggatgtgatcgatgcgcaccgcaccggcacgggcgaacatgccatgcaccatattgcggtaggcctcgtagccggtggtctccagattgatcgggctcagcggcggctggctccagttctggccttgctggttgaacatgtccggcggtgcgccgaccgtggctcccttggcgaagcgctcgggattccaccacacgtcagcgccggaggggtgcacgccgacggccatatcggacatgatgccgatatgcatgccggcgtccttggctgcctgttgggcggaggacagctgctcggcggcaatccattccagccagcggtagaagtccaaagtgtccgggtactgcttgcgcagattggcgatttccggggagttgcgattgaacttgcgctcccagttgctctcctcgccgttgggtgctccccacttgtcgtagcacaggcaccacgtggcatacgcctccaagtcggaaccacagtccgccttgaattggtcgaatacgctttggcgttcggcggtacggccggccttaaagataatccacagggcgtgcatcttgctgcgccacatggcgtcacggtcgatgagctgggaatcaccgttcagcggttcggtgtcggcatgcagtccgtcgacggcattcttgtcgccctcgctgagcgtggcatattcggcgatcgcctcaggacggatgtacgtgaagttgatcaggcgacggcttaccggcagatacggcgacggggtgagcggggacaccggctcggcggcatgcaccggattaatgagcacgaagtcggcaccggtcttctgcttggcgtccaccagcatggtcttcagatcctcgtaatcgcccacgccccaggagttggaggagcgaatcgagtacagctgggccatccagccccacagactgccgcccttcatcgggtcaagcagatcgacgcgatcaggtgcactgatcaaagtggcgtcttgcacacggtcggcgaccttgacgtgcagcgtatggtaaccaatcggcagatcggcgggaatgaccacagccgcattcgaaatgaacgtaccatccaagtcgtaggcctgggatccatctccaggaccaacttcaatggtgccttgatatggctcgccattctccagcgtgatgctcgccgaaggcacgtccagaataccggtgttcaccagcacccggtcctcgctaccggcgatatgcagcacggtgggtgccaccaatcgggcgtaacgctcgttcagaatgcgtcggatggcgatgagttgggcgctctcgctggaggcgtcgatgcccagcgctgccagcacctcgatcaggacgtcatcgtctatctcgtggtagtcatggctcatgcccaaataactcgtgccgacaccgaccaacttggccagtcgaatcaacggacgggccagacgctcttcactctcggtaatctcactcatagccccagtctaacgccgtttgattgcgccacaccgtaagaaaaatgccatgattccgccaaattatgtactttttaccctcacatagtgagatgtgagcgctcacaatggtggacagggggtgattgccggccaaatttgcgcggcaaaacacagcaatagtgtgcttagcggcggctttccacggcgtgccgcacctcggccgaggggtcgttggccaatttggcaagcatcgcttcggacgtattggggttcagtgccacggcacggcggaccatcgaagaaagcaccgccggtgctccctcttcggattcggtgccaagtacgcccaagaaatccaatgtctccgcatccgcagtggggtcctgcgcaccctcaagccgcatcttccagctggtgcgcttgtttttcaacgccgtatcccggaccgcaggcaccgggtccttggtcagacggccgaccagccaattcttgtcgtccccgttggcggccacggcttgacgcacggacggttcggggtcttcggagagtttgaccaatacgttcgggaacggcatggtgtcggcgaggaacacacgatcggccaccggggtgtgcgggttgccggccacagcctccaaaagtgcggtggcgcgggagaacgccgcctgatcggcacggtcaggcaacggccgacgggcgaattcggacagttcggccgggtcggtggaatggcgcagacgctcgtatgtagcggtcagcggttcgaaatccaccggagcggcggactcggctgcggactgcgcgccttggtcctgctgctgggcgtccgtgtcggttgcagtctcggccgcggcctcggttgcggcctcggtgggctgggtctgctggctggtggtgttctcgtcggtcatgatgcccagcttagtcatacaggcgtcacgcgagcggaaccggaatgttgaccatgtcaatcggagccggcaccacagcggcattgaacgcttcccgcacacgctcctcgaatcgcgcgcaatcatcctgcggcaccaccgcggtcaactcgacgttcaccgcatacgattcatcctcctgactgccaccaagctgcgccaggatctgctggaatcgggccaactgcgggtattcgaggcgaacccggtatcgcttggcggtcatgatgcgggcggcgcgggcggctttcatcgccaatgatgcggcggatgagtacgcgcggaccagcccaccggagcccagcagaataccaccgaaatatctggtgacggcaaccacgcaatcggtggtgcccgactgcttgagtacgtcgagaatcggcttgccggcggtaccggacggctcgccgtcatcgctcatgcgttcggacagtcgcccatccgcgcctccgcacacggcggcatacgccacgtgtcgggctttcggatgctgctcacggatcgcagccacgaacgcgagcgcctcgtcgagcgtatcgacatgggcggcgtcgccgataaattcggactttttttcgacgagcgaatcgtgggcaggatcgtcgggcgtgttgagaatcgtctgcatgagcgtgttccggtggtcgactggctgggtgttcgattgagcgcgaggctaggcagggctatcagcgttcggagacgacgacgttatagtcttcgccggcgaagtaggcggtcaggcaggcgatcatctggcgggtgagctccttgaacgcgccgtcggcacgccagccgacgtgcggggtcaggacgatgccgggcacatggcagatggcgtcgtcggcggtcagcggctcatggtcgaacacgtcgagtgcggcgggaacatcgcccttttgcagtcgggcaagcagcgcaccggattcgatgacttcggagcgggcggtgttgatgaacagggtgccgggcttcacatgcgcaaggttctcggcggtgacgatgccgcgcgtggcgttgttcagcggcagatggacggagatgacgtcgctggtttcgatgagcttgttgagatcgtcgaccggagtggcaccggagcgttcgaaatgctcgggcggcacatgcgaattccatgcggcgacctccatgccgagggcgcgggcgatgccggccacggtggagccgatgccgcccagtccgatgatgcccatgcgacggccggcgagttgcagtccatcgccgctggcccacgcccagttgccggccttgacgtccttatcgagttggccaacgcggcggatgagctcgaacagaagggcgaaggtgtgctcggccacggcgtgatcgccataatgttcggcgttgcagacgcggatcttcagctcgcgcgccttatcgagattgaggtagctggcgacgccggtaccgcagaacacgatgcacttgacgtgcccctgcccgctgatggtgcgcagcagatcgtccgaaatgtggtagccgcccaccagcagggcgtcggcatccttcagacgctcggctatggtcgcctcgtcggacgtgaattcctcgaacatacgcacgcgggcaacgtcgtggagcgcggggaactgggccttgatgggctcgatcatcgagtcaagcacggacggcatcacgacgaggggcagatcggtgcgttcgctttgggtttcgtaaatctcggtcatgggctccacattaggaggccggcgggaaaagcgtcaccttgcggcttcccctccttgagaccaagccgagcaactattgctttgccgcctgctcctgcgtgatgttccattccttgacgacgttctggtccgcgcccatcgaatagatgacatcccagatgcgttggcgtatctgagcgtcgtaggcttcgtcccaacatgtgcctatgggatggtcgctggatatcgggcaccattggtagttgccttgatgcacgttggcggtgggcacccaatcgatgcggttgacgcgccacgaccccttgacgcccttcttgccggcgaactggatgcgtgcggtcacaccctgattgttgaccaaggtttccggcgtgttcgccgactcggtgacggcgttgcccagaccgtagataatccacgtgccgttatagttctcgatgggctgcgcacaatggcaaccggcaccgtaaataacgtcgaaggcaccagtgtcggcaagctcatgggcttccgaaatctgccaggaatcggcgtaatcaaggtattcctgcaccgagtgcatggcgatggccaccacatcggcaccttgctcgcgggccttgttggctttgtctaccgcgcgctggatgtcgctgtcgtgattcgggtcgccgtcttcgcgcagacgatccacctgccagtcctcgtcggcggtcatgccgttgagggagaccgtgccggtgaccagacccagcttgccgccgccggtcggggaatcgatgaccaacggtttggtggagtcggcttcggttttgtacgagccggtctgggcgatgccattggcctcaagcgtgtcccacagacgggcgatgccatccgccccctgatcccaggaatggttggtggcgtgtgtgcaggcgttgtatcccacgttgcgggcggcatccgccacttccggcggaatgttgaagatcgggtacgcggcatatgggccgccgcgctgggcgatcggggtttcgaattcgcacacggcgatgtccgaagcctgaatgtactgcttcatcggcgcgaacagcgggtcgaagttgaaggcggtgccatccgtggcgttggggttcgggccttggaaatggctccacaatccctcatggaacaacaaatcgccgttgaccagcatggcgatgcagtccgtatccgggcaatccggtgaattgccgtgatgttcggtcaccggtttgggcgtgttcttcgctttattcaacgcgacgtccgacactccggcgtgtgcggggccattgccgtccgtgcgatgggttgcgaaccatgcgccgatgcccagcgcaacggcgagcacgatcacgaacacgataatcagcgccgcacggttggttcgtgtcgagttggagcgatgttgcccctgcccagcgatatggctcatctttgcccgcccttcggaactcttcttctctctctagggtaccgcccatctcggtcaagtactgcggggagggaggcgatgagcaagcgattggacaagcaatatataaaccggttaatcttcaatcaccattcacgaacaccacgcaaaagtctcacttagtggacatttttctttcgtcgctcggacttttcccgacgtgccgcactcgttcgcccactaaaatggcggtttggaggcggacggacaatggcgtacctccgactccgcttaccacaagcggagaccgcccgtcctcggttatttcaggagttacttaacccggagtttccggaaaacaaaaaagttccgagctttcacccggaaccttaatcggcggagtcagagggattcgaaccctcgagccgtttacacgactaacaccttagcagggtgcccctatcggccactcaggcatgactccacgttacgcaataatgcgcaacagcaaattactgtaccacgtcctgcggatacggcgtgccgaacgacacattattgaacgtccgcgggtgcggcgtcgccggagaacgtaacgataaccgcgcaaatcaccaacgccacaccgacgatttcaccaacgctgggaatctcgccgaacgccagtcccacggccaccgccatggcgggattgatggattgcattaccgaaaatgcgccggatgtggtgcgtcgcagcgtgatctgctccaccacatagggaatgaacgaggccatcagggaaatcacaaacagcagagccagcagcttcagcgagccgccgggctcaagcgcccacgtggcatcggccttggggtgaaccacatgagccacagccggcacgccaaggaacagggactggaccagccagccgatggtcacggcgatgcacagattatccagcgaattgccgccagccgccacgcgccggccggtgatgatatacatgccccacatcgacccgccgatcaaaatcgcaatcagaccatacaaaaacgtgccattgccggacggattggccaatgatatgccagctaacagcaccacaccgaccgccgcgataccgataccgacccgctcgcgccagcttttgccggtaatcaccgccaccgaaagcggtcccaaaaattcgatagacacggcaatgcccatatccatattgctgatggccacataaaacagggtattcatcagcaccagcgagcagccgagcagtacgaccagcccccagctgcgggcgtcgcggtgaaacagttgcgctcgcttcgccttgttccagggcctgcgccacagcagcaacagcaccgccatgaatcccacgcgataccacaccgagtacagcggatcgagctgggtgaacgcaagtttggcgacggccgtagccaaataaatcaccagtgcctcaccaatcacgataagaaccacgggaacacggttgaggataccgaccactgccttcttcatgaggtttacgctactcggagagccgggacagcgcgcattgacttggaaggcgttacggacagtgacgcaatgtggacgattccgtggaatcgcacccaccatgcgaaacagccgcacagtgcgtaaacccttggaattccggcgatattcggcattatgacaatgagcgccgcgtcatgcgcgccacatagtgagcatgacctcgttcggcattcctacaatggtggcatgagcaccgcaccgagacttgaggccgccaaacgcgattggggccacgacgagaccggatgcaccgtgctgcatatcgacatggatgccttctatgcctcattggaggtggcgcgcaaccccgggctcaaaggcaagccggtaatcatcggcaccgggccgcgcgcggtggtgtccgccgcgagctacgaagcccggaaatacggcatcaattcggcgatgccggccgcgcgcgcccatcggttgtgcccgaacggcatttttctgccagtggatatggcgtattaccgcatgatgtcgcaccgaatcatgcatgaggtgtttttgaccgtcaccgaccggttcgagcaggtttcggtggacgagggctatatggatgtgtccgccgcactgctggagtgggggcggccgagcgcgatcggcgcgtggattcgcgctcaggtggccgagcgcttccacgtgacgtgttcagtgggtatcgcctgtaacaaactggtgtccaaaatggcctcgaccaatgccaagccggacggcatgctgctgattcccgcggcccgctcggccgaattcgtgcagatgatgccattgcgtggtattccgggaatcgggccgtctttggagaagcggcttaatgcttggggcgtgcattcggtggctgaattggctcagctggatgaggctgcattgactcgtgccactggctccccggctgcggcacgtggattatgggcggcctcgcacgggttggattcccgcgaaattaccacggtacgcgaggagaaatccattgggtccgaggaaaccttggccgaggatacacgcgatatgcgcgtggtgtgtgggctactgcgttcggcctgcgacgaagtaaccagcacgctgcggcgcaaggggctggtggcgcgcacgctgacggtgaagttgcggttcgccgacctgagctatcagacccggtcttttacgatggagcggccgaccgatacggccggcgtgctgtacccggaatgcgtgcggcagctgaaagtcatgctggggctaccggcctcggcggagtctgccactcccctgcccaaaactattcgcttggccggtatgagcacgtcttcgctcagtaaggcggcggctacggccgtgcagccttcactggatgacatgctcgaagaggccgacaatgcccgcggccagacctcacaggcgcgtttgcatgatgccgaggccgcactggacgctgtgcgccgcaaattcggcaacaaggccgcccagtttggggcgtgaacggctcaacgccacttacgatctcattacgccgtgagacgttcgcaggcggaacggatggcctcgtcggtggcggtggcggagaaacgcaggtaggcgggagcgccgtagaattcgccggggctggggatgatgccgatcttggcgagctcggccatatcggcccagcagtcgccggacttggccttgacccatacgtacagcgcgccggagggcatttgtgccgaatagccatatgccttcagtgcgtcaaccagcgcggataggcggcgacggtaacgcctccattgctcgtgcacagcggctgtgtccttcaggcctgcggccatggcggcctgcactgggccagggataatctggccgatctgcttgcggtattcggccatttccttgaccagccggtaatcgccggcaattagagccgtacggtagccggccatgttggactgcttggacagcgagtagagcaccaggatgccagctgccgaaccttcacacacatgtggattcagggcacatggcgtggcggagagactgaatgcggtatcggaggcgggctcgttggattcggccaccggtgcggcaggcacagacgcagcagatgcagacgcggcaggcgcagaggacgcggctgtattgcggcgcaccgaacgccagtccattaacgcatagcattcgtcggagagcaccacggcaccgatgcgacgggcagcagccacgatgtcggtcagccagtcagcggagatgacctcgccggagggattacacggcgagttgatccagatggccttgacgttcggaatattcacccaggaatcgacgtcggtcacatcatcgactttgaccacggtggcgccggcaagttgggtaccgatttcgtaagtcgggtaggagacagccggttggacgaccacatcgccttcgccaaggtgcagcaggctggccgtcagcgccacggcctccttggaacccacggtgggtacggcggcagcgttgatggatttcagatccaccccgcgcagttcgcggaaccatgtatcgatagcggccttaaggtcggcggtgccggcggcgaccgggtatccatgggcgttgggggcgtctgcgccggcaaccagcgcctgctggacactgctcggcaccgggtccacaggcgagcctacggacaggtcgatcatgccacccggcacggttttggcggtggctttgaagccggcgatacgagaccagtcgtatggcgacgaatatgcgtggaagcccatgagaacccctttcttggacggtatgttcctaagatacgacgaaccctcggccgtgatagaccgagggttcaatccgaactatgcgctgtgtgcagcgcttatccgcaaatcagcttactggttctgcggcggcagcgcggcgacctgttccgggtctttgccgattggaccattggcggaagcgccgcccaaatcgccgacttcagcgaagaagttgacagcggcatccttgtaccaagcccactcgtccggcagatcatcctcatagaagatggcctcggtgggacacaccggttcgcatgcaccgcagtcgacgcactcgttggggttgatgtacagcgagcgggaaccctcgtaaatgcagtcgacggggcactcgtccacgcaagccttgtccttgacatccacgcaaggctgagcgattacatatggcatggaatcctccttaacaaatactgatacaagggtacgcgcctgttgggacgctcctcgctctcagccgttaacggccttatcggtttcggcggacagcgtttcggtcaggtcgcccttgccgaggcgcgcatgccagtagccgtagccgaagtagatggcgaagccgaccacgagccacaccacgaaacgaatccaggtgagcacggacaggttgagcatcaaccagaagttggccacggcgatgaggatcggaatccacgggctgccgggcatcttgaaggcgcgcggcaggtcggggcgcttcttgcgcataatcgggatggagatggccaccagcgtgaaggcggacagggtgccgatgttgaccatgtcggagagcacgccgatgtcgaagaaggcggccacgagcgccaccaccgcgccgacgacgatctgcagagcggccggggtgccatgcttgccggtcttggacaggccgcgcggcagcagaccatcgcggctcatggcgaagacgatacgggtcaggccgagcaacagcaccataaccacggtggccaggcccagcacgatgccgaagctgatgatcttggcggcccagtcggcgcccaccagttcgaaggcggtggccagcgaggggctgtcttgcttggcgagatcggcataggagaccatgccggtggtcaccacggccacgagcatgtacatgacaatgatgagcagcatgcccacgccgatgccgagcggcacgttcttgtgcgggttcttggtctcctcagaggcggtggccaccacgtcgaatccgatgaacgcgaagaacacgagcgccgcgcccgagaggatgccaggaacgccgtacacggatggggtcatgccggtggcgaactgccacaacggctgggtcatcacgccggtgacggcggaggagccttccacggtggaggccggctggctcggcggaatgaacggggtgaagttggaggccttgacgtagaagaagccgacgatcaccacaaagaacacgatggcgatcttgagcacggtcatagcaccgtccacgcgggcgccgatcttggtgccgaatacgagcagcgtggtaaagaacgccacgatgataatcggggcgatatcgatgtggaaggagccgaacgtcaggttggtgttggcgttccagcccatcaggcgcatgaaatcgttgaggtatacgccccaatatttggaaatcacggagccggccatcagcatttccaggatcagatcccagccgatgatccaggccatgatctcgccgaccgtggtgtaggtgaaggtgtaggcggagccggccaccggaatcatcgaagcgaattcggcgtagcacatcacggctgcgccgcacacgatgccggcgatcaggaagctgatgatcacggccgggccggcgtggaaggcggcggcctgcgcgcccaccgagaagatgccggcgcccacggctacggccacacccatgattgacagatcccaccaagtcaggttgcgcttgagcttgcggccctcttcaccggtttcggcaatggtctgttcgacggattttgtacggaacagttgcatagtgctcttcttttttctctgttgtttgcgcaccgaatgcgcacaataccgacaatcgagtatagaagagcccgcgtgtcttgtctattaataagactcagagtccgcaatatatgggattaataacccactccatcaatcaatagcgcgattacagcacaccgacgcagaccggttcgggcaccaagtccactccgaacgcgctcttgactgcctgctgaaccgcacgcgccaaagctgcgatatcggccgcgctcgctcccccacgattggtcaaggccagcgtgtgctgcgtggatagactggccggcgcgtccgcatcgaccttatatcccttatggcagccggcatggtcgatgagccaggcggcggacgtcttggtgccgggagtgccgtcaggcagagtcgcgtcgaacttcggcgcatcttcgggcagggccgccgcttggtcggcggtcagaatcggattcataaagaacgagccgcagctgtggcgattgtagtcgggagcaggcagaccgtcatcgccaacgggaatgccggcggcctcattgagggaggccagacgctccagatcggtcaggatattggcctcgcgcttggcggtggccatgtcaggcaaggcgtagcgagtagggtcctcgagcatgcccttggcggcacgtactgcgagcacggctttgcggatgtcggcggtggccatacggtcgcccacttcgacgccaagcgctttggcaagctgtccgtaacctaccgtgccttcggccgagtgggtcagggcaaaggtgacggaaagcaccacgtaacgtggcgtcgggaagaatcggccggccggccggccggggccggcgtacatgctggtcttcagtgcggagtatcgatagccgaatcgaagatcggcgggtgtgaggtcgcgcgttgttttggtgtctcgatcccagacttccaccgattcgaccgaagtggcgacttcctgcccgtaggcaccgatgttctgcaccacggaagcgccgactgtgccgggaatgccggacagtccctcgacgccctcgagcccgagctctacggtgaaggccacgaaatcatcccaattggcaccggcctcggcattgacatgcacggtgcgatcctcgccctctaccggtgcagcctcgtccggcacagtgatgaggcgtcgggcgtctcgaaccaccacgccgtcaaaaggcttatcggaaacaagcaggttggagccgccaccgacgacgaccaagggcaggcctttggaatcggcttcctccacggcttcgatgagtcccacgcgcgtggtcggctcgatgaaatgggcgatggggccgcccacgcccatggtggtgatgtctgcaaagcttgtcatggcttactatcttagtggcgcaggtgcgatatcgaggcaatcatcggctgaaacggcagaacgcccgcgtctgaacgaaggtggcgcgggatttctgccgttttggcggcccgaaacgacagaacgcccgcgaggggttcgttcagacgcgggatttctgccgtttctcacgcgatgcggatactgattccgcaccctgccactcgcctccggaggcaatacgcaaaaacccggccgaatgggccgggttttgtaaagctgtgatacttgcgatcaacgagtctcgcggtgcacggtctgcttgccgcagcgcgggcagaacttcttgagctcaagacggtcgggcgtgttacgacggttcttagtcgtaatgtagttacgctccttgcactcggtgcaggccagcgtgatgcccggacggatgtcggcgctcttagccattgtcattcacctctgtgttcttaggtatagtgcgcgcccaccggttagcgggcgcgatttgtagcgaggaagaggctcgaactcttgaccttacgattatgagtcgtacgctctagccagctgagctaccccgccagagagccccgagtgagaattggactcacgacctcttccttaccaaggaagtgctctaccactgagctatcggggcgtggcggatagtggattcgaaccactgaagcacgaagcggctgatttacagtcagctccctttgaccgcttgggaaatccgccagtctgtttcccgccgcggtgtttgacctcaacaggcaacttggctatataaccacagattttccaggtatgcaaatcggcccctacgcgaaccttgttttaccgcggaattctgcggttttatcggcgtgtctcacagcgtgttttcagggcccgcttcggccctgcaaacagccccgaccaaggctgcaccccgcacttcacccaatcatttttcttatatggtgctctagaaccttgcaatggcgcggttttcgagcgatgtcgcctgtttgcgcggcacggcgcatgctggcatgctgggcgcatggcttctgatcttgtacatcacggacaatcattcgacgaccagccgctcggattcggcacgctggccattcacctcggtaacggggtcgacgccgaaaccggcgcgatccgtcgccccatcacgctggcgaacgcctacgcgctgccctacgacccctcggacatcaactggtccagttcggacgtgaacctttacacgcgcaacaggcatccgaaccagcgctatctggaagaaaagctggcccgtcttgaaggtgccgaggatgcggtggtgctcgcttccggcgtggccgcgctggccgccacgttcaccacgttcctcaaccgaggcgaccacgcgatcttctccgacaccacctatatcgccgcctaccgcctgttgaaccagattctgccggagaagtacggcatcgaaacctccatcgtggatacctccgatcccgagaacgtacgcgcggcgcttcgccccaacaccaagctggtgcatatcgagacgccggcgaacccgacgctcaaggtctcggacatcgccaccatcgccaaactggcccacgaagcgaacccggacattctggtttcggtggacaacaccttcaacacgccgtacaacgtgcgcccgctcgatctcggcgcggatatcgtcatcgaatcgctcaccaaatacatcaacggccatggcgacgcgctgggcggctcgatcgccaccaccaaggcgcgcacggaccagatccgcttcaccgcgcaggtgaacttcggcggcatcatctcgccgttcaatgcctggctgatcaatcgcggctcggtgacactgccgctgcgcatccgccagcacaacgcctcggccttggcgattgccaagcatctcgaatcgctggatgtggtgcgtttcgtggcgtaccccggtctggaatcgcacccgcaccacgaggtggcggtcagccagctggcccgcccggactccgggttcggcggcgtgctgtcgttcggcctcgacaccaatcatgacgggcacaaccggttcgtttccaagctcaatgtgattacgtcggccgtctcgctcggccatgacgaatcgctgatcgtgttcctcggcgaggatgacgagcgccagcacctgtacccgcctgagttccaccgcggcttcttccgtctggccgtgggtctggaggatacggacgatttgattcgcgacatcgatcacgcgctggtggaggccggattcgaggtgtgagaccgcaccgcgcgcatgatttcggcctcttccgccctgctgccgccgtcagtgagtcacaagatggctcggtgacgacgatggcagggctttttacgtcggcacggggacaatacctggcggtctgccgacgatgacggcacttatcgtcggcagaccgccagtttttggaccgtcgccgacacaaaacgccgatttgccgtcggcaatggtccaaaaactggccctataacgacaccaacgcggctcagcatcggcacatcgccatttcgtggcccactgccgacgctggcctcatgccacggcactcagcgtcggtagagagacaaccattggcacagcgcgacgacgctacgaacctgcgacacggaaaaaaacaacataccgtcgatctattgccgtcttgcgcaaaatgtcttaagccgctcggccaagtcgccgactgagcctcttccatagggaccccaatccgttacccagtgtagatgcggtgcaacgccgaactcaactacgttgcgcgcatgcacccttatgcatagcaggcatggctgggcgtttggtgggagcggttttcggctcccctctccggggggagcccctttccgcctggcaagagaaaaccccgactgtccgtgggaacagtcggggttgttgaagttcgctaggcgactaatcagccgaggatggcgagaatgtcgcgggcgccgacgatgaggtagtcctcaccctcgtagtggacttcggtgccgccgtacttggagtacagcaccttgtcgccgaccttgacatccatcgggatgcgctcgcccttgtcatcacgacggcccgggccaacggccaggacttcaccctgctgaggcttctccttggcattgtccggaatgtacagaccggaagcggtctgggtctgggcctcggcctgcttgacgatgatcttgtcttccaacggtgtgagcttaatcgacactgtgggtcacctcgtatctacttgtagttcgataatgccgcgccagaacgtctcaagaggctgacgatcacttgcgttgtccctttgcgctaggacacatcgtagcgcgattattagcactctgccaactcgagtgctaacgctgtgagagaaaatcgtcgaatcgcaacgctcagttgccgcggcgggcaagaatggagtccaggcctgcgcccaacgaatcggtggtcgccgctggcgcttcgacgtcggcacgttcctcggattcgtggaatgcggctcgctgggcggcgtttgcagcctcgtcatcggcgtccgtatcggcatcatcgcgccgctccggctcagtgtctacagcgtttccggcgctgacagccttgcctgcatcgacggccttggcatcgtccgcggccttgacggctcgggcctcgtcaatcaacttttccgccactgcgggttcgacaggttccgccttggacacctgacgggtcgacttgatctccaagctttccggagcgttgtcggcgttatgttccccacccaaagtgaaggagatgagatcctgcgaggtggacatatcgaagacgtccagtgctcgggcagggcgtacgctgaccagttccgacgtggcatcggcagcggcagcggcatcgtcgcgctcatcgcgctcgtcacgcaccgtaagcgatggttcaactcgaggggcgacggacttgtccgactcaatcgacttgtctgtgcgaacggaggcatcaggtgtggcggaagattcgctggtttcggcagcggacttacggtcggcggattcatcgaccatagcagacggctcggcggcaggcttatcggcggcggactgtgcaatatcagacttctcagactgtttggcgtgctcttccgcggcctgatatgcggcggcggactgacgcaacgccttggccttggcctgctcaatctcggcatcgcgtaacgcgcggcgaatctgccgctgttccatgacctcggtggcagcatcctcaatctgctcggcaggcttctcggcaggcgcagttacggccgcaaccggttcggccttgttcacacgcttgctgtccttggactcggcagacggtttcttggaccagcccgtaccgctatgagcccgctcgtagcggaccaccttgcgctcccattgccgggcctggcgtgaggcattggctcccagcaccagcaccagcagcaacagcacgaacggaataagagcaagcagcggactgaaatgcagggggaacgatacggcaaacaccaacacggttatggcaagcaggcatacggcgagaatctgccggcggcggatggccgcgcggcgcagttcccgcacatgggcgatgtgctcagatgtcagcctcgctgacggtgttgatgctggcattgctgcccctttcgccttatgcggcttgatgtctccgaatcgtctgccgttctctgcatcaacgatatgcagggaaggcgaataacgatcctgccggtgctcgtccacacgtttcatgccgttggccgtacgtacgggcagccatacaacgataataatcgccacaatcaccagcacgacgacagtgctcagtgactcataacccatagagtcaaggataggagacgtgccgacgaactggggctttccgtccgggcgtgtcggagcggaattcttccggtcgacgcttatctggaaccggcggcggcgagtctagcggcgaacccttgccccatatcttcagccaacagcgcaaacgttacgtggtcacgccactggccattgacatacatataccgctcgcgcagtccctcatgatgggctccgaccttacgcaccacagccaaagaacgcgcattatccggcagaatggcgatttccagccgatgcaacgcgggcccgaatgggtctccgagcgcccaatcggcaagcatggccagtgccattggcgcgaatccgcggccggcgcaccgttgatcgacccaataaccaaccacgccggtacgcatggcaccatacacgatggctcccaacgaaatctggccgacgatacgcatctggtattcgatggcgaagatcacgccgacgccatgctgctcgttacggcgctgccgctgcacccattgattgaatgtgatggagccgccatgcatcgggtcaccggattcccaaggtgccagccagtcgttgttgcgccagcgcacttcgttccagccgtcctcatcatccatggtcagggggcgcaggactatcggaaaaccgggatgggtgagacgtggcgggcggatctggtggtccagcttgaacgcctctttaatcgactggaaaactgacacggcctttattgtagccatatgaaggtcttgcgccgctaccgtggccactttcgttttacgatggaaacactagattgtgcggtatgagcgaagtgggcagtggcatgaatatcggcagcgactacagcggcacagagaaaacagagaagacggataaagcgacgctgcgccaccatatactgtctcggcgcaagcgcgttccagcggaagaacgcggagcggccggtgaattgctggtgcgacggttcccagcacacatgattcaggatggtcccacagtggcggcatatgtgtcgatgggttcggaaatcgaaacccggccactgttgcgatggctgcgggctcatggctgccacgtgttggtgccaaggttggggtctgggttggaaattggctggagtgtgctggattcattggaatcattgcgctcgatggatgcagtgggtggcgcgaacaatgccggtagctgcagctctcccagcaccgtccatcacagacccgatgagccaactggcgcagttctaccgcccgaagcgttggagaaggccgatctggtcatcgctccggctttggcagtggacccgcagggcaatcgtctggggcgtggagccggctggtatgaccgggccttggctcgccgcaagcccgcatgtcccctgattgcggtgtgctggccgtgggaggtgttggacattgatttgccggccgaaccacatgatgtgccggccgacggagtgctgacgccggagggatacctgcggcttagctcatcgggcctgttgagctggccggccggccaagatactcggcgcaagccagactgaccaaccagccacgcacactggccgatggaaccagagtggcaacagcaagctggctagtaagaccgtaacgccaatgtgtcagggcggcgactaggatatgaacggttgcgtggcatggcgtttgggccatccgcgagaaatatgactttgttggaggaatccgttgcctacctatcattaccgttgcaagaactgcggctatgacttcaccgaacagcagtcgttcaatgacgacccgattaccgtgtgccccaagtgctcgcaggagcaggtgcgcaaggtgtattccgccgtgccgattgagttcaagggtcacggcttctaccgcaccgacaaatccggcaagtaaggtctgtacacccgcttttcctctgtaaacgacggtgtcgacggcggtatgccgcggatattggcactacgggcactgtctgttgcacgggtttgaagcgttgtggataacttggcaagctagaaccacataggtcgatttggcttgcgcttacgaaaaacttcaggtcaccatggttgcatggtgaccttttcgtttattaagccgcctgcgcgcggctcattgcggcgacggcgcatggcggatgccttgcgccgactcactgctgcgttgtgcgtgggactcgcagtgctgtttgggcttgaagccgtattggccgtggtggagaccgagccgatggtggtggccgcccgctcgattcgacggggtgacattattctggccgccgacgttcagttggctgatatgccggtatctgcggcaggcccgtcttggacaggcaatattgaggatgtggtgggcaaggtagcgcaaatcgatatcgaagcagccgatcccatttccacgcatatggccagagatgcgcccgtagcaccgaccggcactacggtgattgaagtccgcttggccagtagcgtcgacgatgtattggccggcgatcaggtgagactggtttccgccgtcggttgcgaaggtgctgattgcacgctggccgagaacgccacggtgatgaatgtcggcaaaccggatgcgactggcgcattgggaggcaacgaccgactggtgtcgttcgcaatgccgccggaggccgcggccaaggttatggagctgcaacaggccggagcgattatggccgttgtgcggtaggaagcggaatcggccttcggccgatactgtgttttccgcagcctgtcggctgcggaaaacacagtatcggggcgcacagagtgcgccccaactcctactcgcgctcgttaaaaacggcccaatgcggcggcagttcgccgaggatgcgtttgtcgtcgtcggattgccgttgttggtcggtctgcatgtctccgggctcgagtttgacaccgtcagcgtcaaactgctcagtgcccttcatcaccacgcgcttgtgcttgcgcggtgtgcgccgtgtagccgagtattccgccatggttattcaacctcgcgatagatctcaccgatacggctgacgatacggtcgacttccttatcggggttcacgaaggcggcgacactccagacggtcatcacattccagcccaaggaaatgagatcctgtgccgacaaacgatgacgcctacgcgtggattgcacggacataaagttcgcgtcatcggtctgcacggccaaggcaaacggcttgtccttcaatcccaccacgagcggaatcttcacgcccttgtcgaatccataatcaacagcagcgttcagtcctcgcgcgcgcaacctgtcggcgatatcgtcgaacagcacgttgccgcctgccgcatcacgcaacggaagcaccggacggtcgtcaagctgttcggcccacgtcaacatggtcttcaggaaccgaggaccggattggtgcagtcgttcttcatccaaatcttcggaaccaaaggccgacacaatatccaagctgtggtccgccaatgccagggcatccagcaacagtccgcgaccgcctgtgctttcgagcggaccgaactgctgaagcagacgtccgtgcgtggttttcgcatagcacatcgacagaatcacgtcagtggcacgacctccggccacgtcacgcaaggaaaccaaccgcacatggcgcaggaatcggcccatcgccttggatttgcctgccaacgacttcaattcggcacccaagcgtgtgcggaatgcgtcggtcaacatcacgaccacaagtcgatagctggaaggaaccacggcaaaaccggcggcacgttgcgtaatcagacgcaccacttcatcaatctccggctggctggattccaccagaccagaagacataaccggcacaccgctcgcttccacacggtggaatcgcacctcaccggcagccggctcggtggccacatcatagcgaacaggaccatatccctcggattcaaggaatgcggacaggcgcggcgcacggcgagacggggcagcatccacctcgatatgaggcaacgtgtcgatcagctgcttgacgctttcgctggttaccgtcgcgcagtgggcgatcaccaccacctgctgcacgcggccgatgatggacagcaactcgatagcgggaatgtgcgcgcacgcatcgagaatcgccacatcagccagcacacccggctcggtgagtgcggcgagcgtacccggcgcggccaccagaatcggcttggccgcggccagaatctccggatgatcacggcgaatcctgctcagcgacacactggcgcgccctgccagcacggtgtgcatctggttggcttcctgagtgcgggagaacagcatgtcgcacaggcggcgcatggattcctgcgacaccatcggtccgatggagcgcacgtgctccacatcgacctgcgcaaagcggtcggatgcggcctgcagcgcggcaccatcctggttggagatgatggcggacgaacgcacaatgtcctcaaacacggtggtccaccaggccagctgcacttcgccgcgcacctgctccacgctcactcggcgagcgttgagatcggcgaccagttcgttcagtccggcagaggcgaattcctgctccagcaggcaacgctccggcaaggtgtccagtgccttgcgatcatccagcagtgctttcaggcgtgcttccaccttctcgaaatcggcggtttccagattgccaccagcgggtgtggtggaaagcacggtatccagcgcggtcatattgctgaccagcgcctcttgggtggagatgatctcgtcgagcttgctgggcagcaccggccaaccgccgtgaggcacgaactgatgccactgctccccttgcttggcgactaccttcaacgcttcgtgcaagtcctcgacctgcgcgccgacgcgcagcagatccttggcttccttgatgtggcggcggcgctcccagaatcccatcgacgtgccctcggccttgcgctggctcttcggcttggtggcctcgatcatggagctgatgtctcgctcgaaaatctccggctggaacacgtcaagcactcgtcgcagattcttcaaaaccgtaacctgacgctcccactcgcgggtggtgggaggaaccgggaatccgcaggtctgcacggtgcgtgccacctgctcacgggtggcgggcaggaagcgacgcagcaaatcgtccacgcgctggtaggcggttactgcctgttcttcagtggtgatggacgccttgtaccatgcggtgtcttccgggccgatggtgtattcgccgagctcgccggcgcgttccatcttgccgatccatgtgtcaatatcgttggcgatgctcagggcacttgactcgtcaagtcgaacgtgggtggcagggtgcgtcgggagcacggagatacgggccagattctgaatggtctcgtatgcggacacattccacttatcgttgcccccgtgcaggtcgcccagatagcgggtcaagcgcgagcgcacgcccacgagttcgtcggccagctggtcgaatcgctgggtggcgactccgggctggaatccgactgcggcaatcagctgcttatcaagcgcggcgttggcgtgttcatcggatacatccagtacctgcgccttcatctcattggcggaagccgtctggatgaacagacgcttctgctcggccacgccgggcacgtacagcacggaacgaccattcatcaggcagcgcgatgcgatggccacagcctgctccgcggtgcccttcgggaaggtgccgtcgaccacgatgctatggccattggcagcaagtgacgcggcatatcgcaccgtattgtccacatcgccgacttcgtactcggcatgcgggtctacgtcgaaaggactgtattgcggaatattggcatctttgagcgcggtgcgggcggattcgtcgccggcaagcgcgtccaacagcacattgccggtggggccgttctccagctggtcgatgaactgtcggctttcgctgatcatctgcgacgaggggtccatgaagcatccgagcacaatctggcgctcgatggcgaagtcggagatacgctccgacgcttcggacgaaatacgggcgaacatcgcggaagtttcgggagtgccactgtcatagctggcaccgtcaaacagggaatcctcatccaggaacaccccctgctcacgcaatgtattgacgaacgcgacgttcagggccacgcgaccggtgaatcgaatggtggtcgacaagccatcatcctcgatcgtgacgctcaccgggtacaacagcaccggcagcgcgttgcccttccatgtggccacgccgaccacgagcgacaactccgccacgccggaaatcctgcgtttggcggcctggtcatccagcacgcgcccaatatggcgttcggcggccttaagcacacccgtgtcgcggaacaacgaatccaaccggacatggccggaagcgaacagctgggcgatgccggagggatgggcatgggtcatctccagcttcgcggccagttgattcacatcctcgagcggcgatggcggctgcatgctgcggtattggtcacgccagcgacggatgcgattcagaccttccgtgagattctggttctgagtctggctctgggtcatctctcgactcactttccaaccgcttcgcggtattcctgatagcccttgttgtgagacagggcttcgtcaatatcggcctcgccacgggcggcgagccaagaatacatgtcgtcgtacaggtacggattcatggcgaggaacgccagcaattcgggatgacgggcgacttcgaattgaacattgaaatcttgcgtggtttttgcctcgtcagaggtcaggccatcgacttcgactgccggctcctgtgctttcagctcgcccttggccacacgctcgaacaccgagccgggctcgaagaccggagtgtgtacgcccgtggagtcgatatcatatgcttcggataccgactgctgggcggtttcggcagccggctgctggtctgctacgcctgctgcggtggcttcttgatatgcttcggctgcggtccgctgctgatcgtccggtacgtcagctgccggctggtcggtttcagactgggcggttgccggctgagcggtctcaggctgggtgttttcagattgagcggcttcggcttcccgggcggcttcaggctgggcaacttcagcatgctgttcgacagtgtccgccggctgagaatcgccggcattcctggtattcggagcggactgaacgttttcggctgacttgcttgcgccagccgctgcatcggattcaacaaccgccgccgacgccactgccggctcgcttgtgctgggagcgtgcttaacaacggcatgggcgatggcatctactggaacaataccggagatcctgctgtgcttggatgcaggcgttacaatcgtcgactcaggttcggtctgctgcttcggcagtgccacggagttcatggcctgctggtttttgcgttcggtctcctgctcggcatgctgggccaacgcatccgcgaacagatcacggggtatggccggctcatcgtttttcgtcactggctgcgtgatattcagcgagccaagttcaagctcgtcgaccttgcgtcgaacattatccgcgctgaagatggcggtcggctcgccggcccgcaaatcaagaatatcgtcgacggacatatccgccgcatccggctcctgcggtgcttcgtgaaccgcatagccaaacaaatcaggcaccttgaggtcgagcggctttgccactggatcgtcgacacgaatgaagtccgcaggcacatcgccgaactgcatgcgcatgggagacgtcggcaacaggaactcggcattggccggcaagcgcaacaaatcgccattttcccgcaccacatacgatccattggtcgatccaagatcacggaccgaggccgtgccattgctttttaccgtgaacatggcgtgccgtttggacatcgatttggtttgatcggcgacgtcaaggcgggtgttgccatcatcggcaagggggcgtaacggcttacggccgatttccacgcactcccccggcttgacgctgatccggtcgacaccgttgatcttcaccgtccactcgctcaccgtgaccgccttcctggacacactatttgaccacactacgtgccattgtgtcatcttttaccggcttttggcggattactgggcacagaattgacaactttcgctcattgccagctttgtgtttccacgccggatcgcgttctccgcctcgtcctcgtcaactagtctactcagtatgcggaaaccccgcagcctgaaacacaggtgcggggttcctcgaaaagctgtgattgcggcttatgccgcacaaatcacttgagctcgacgctggcgccagcctcttccagctgagccttggccttctcggcatcttccttcttggccttctcgaggacggccttcggagcgccgtcgacaagagccttggcctcggccaggccgaggttggtgatggcgcggacagccttgatgacctggatcttcttgtcgccgacggcggagaggatgacgtcgaactcatccttctcttcctcagccggagcagcagcgccagcaacagcggcaacagcggcaaccggagcggcagcctcgacgtcgaacttctcctcgaaggccttcacgaactcggagagctcgaccagggtcatctcgccgaaggcttccagcagctcatcgttggtgtacttagccattatggcttcctttcaatcttggcggcggacgaagtggtagatccgctgcctaataaaccttattgtttaaattatcgaagcgactgattcatgccgtgagggcgtaaatcaggcagccttctcctgcttttcgcgcagggcgtcgatcgtgcgcacagccttggtaggcagagcgttgaacaggtacgcggccttggccatcgatgccttgatgtcgccggcgaattcggcaagcagctgcgggcgggacttgaggtctgccagcttcttggcgccctcggcatcgtagacagtgccgtcagcggcggcacccttgatgacaagagccttgttgtccttggcgaagtcacggatgaccttcgcagcctcgatgaagtcgcccttcacgaaggtgatggcggtcgggccggagagaatctcgtcgagaccctcaatgcccgcttccttggcggcgatgcgtgccagcgtgttctttgccacggtgtaggaagtatcgcggcctagcttttcacgcagatcggaaatctgcggaacggtaagcccgcggtactcggtcaggtagacggcgtcagcgttacggaattcttccgtaagctgagcgactaccgcttccttttcgggcctcttcatggcgttccttcctaagtcggccgttgacttggagttcggaactttcggccgggcaacaaaaaagccctgcgcacaggcagagcaatataatctcgcgaagcgaccttcgccggcccttgacgggcttatatctctcaacctgcgctggcttggcgaaccaaacttcggaaatgcactcgcgcgcacttcaaccaacggtctgtggtttacggatgattagattacggatggtcagcgacattgcagaattcgggcgtgtcgcggggcattacagcgtggcggcgtactgggctacggacgcggtgacttccttcagatagtcgagcgagcgacgccagtggccgggcacctcgatcgaatggttggcatccgggtattcgtgcacgtgcggggtgagcgcgttggcgcgggcttgatcgtagaacgggtcggcggtgccggcgcagatcagcggtgccgggccggagtatcgggagctggcggcgtgcgactggccggcctgttccgcgcggatgatcgcccttgcttcggccacgctcggggcctcggattcggcgacgatatcatcgccgacagccggcaccggaatcacccgggcggatggatcgaagtcggcgtgatgcagcaccggggtcagcagcacgaacggcagaccgtagtgtgaggccacatgtgggtaggtcatcgtcgtcagcgacttgccgatcagcaacaggcgagggccggacggggtgtcggaatcacggttcggcgagccagctgcgccatcggccagcacggtagcagaatcatcggcggcaacgccatccccggaatcaccggctttacccgcgccggactcgcgcgcggcggccacccagccgtcaatcgcctgattgaggaccggaatcaccgtggacaggtcgtcggaagcgttgcgtacgttcatgcggtcgattcgccagccggcctcgaccagagcctgggccgaccagtagagcagcggacggtcgcagttgtagccggtgccgggcatcagcagtacgcggccgtactcctgaccgggcttgacgacattcttcttccaagaggtgatgctgacttcgacggccggtttcatcgcgcgccttccttccacgggtgtgtcctgcgtgtcccctgagttgttccgaattattctggcagtcagtctactcccggacccgttcacgttgcctccacaagctataatcggccacggttctgattgggtgcgcagcgcctgacgcgcgttgggcaggccgatcagggcgagtcgcaattctcgccggggccagccgcagcattatgcacgcggtgcgcagccccgcataaacccaaggaagtagagagtaaatggagaagttcttccatttgaaggaaaacggcacgaccgtctcgactgagattctggccggcctgaccacgttcttcgcgatggcttacatcatcgtcgtcaacccgcagatcctgtcgcagacgggtatgccgtggggcggcgtgttcctggccaccatcatcgcggccatcatcggcaccctggtcatgggcctgttcgccaacgtgccgtacgcccaggccgccggcatgggcctcaacgcgttcttcacctacaccgtgtgcttcggcctcggcttcagctggcagcagaccatgtgcatggtgttcctgtgcggcctgatcaacatcctcatcaccgtcaccaagatccgcaagatgatcatcctggccatcccggagtccctgcaacacgccatcggcggcggcatcggcctgttcgtggcctacgtgggcatgctgaacgtcggcctgatcaagttcactcccggcgatccgaaggccgccgccaagggcggtgccgttgcggctaccccgggtctggccaacttcaacgacaaggtgctgtgggtcttcctgatcggcctcgtactggccattgtgttcaccgtgatgaaggttaagggcggcatgctgctggccatcgccatcaccaccgtaatcggcatcccgttcggcgtgaccacctggtccaactcgcagtccatcagcgagaccttctcccagctgccgcagaccttcggcgcgatcttctccgccgagggcttcccggcactgttctctgatccgaccaagctgccgctggtcatcgtgaccatcttcgccttctccatgtccgatacgttcgacaccctgggcactttcatcggcaccggccgccgcaccggcatcttctccgccgaggatgagaaggctctggagaacggccacggcttctcctccaagatggacaaggccctgttcgccgactccatcgccacctccatcggcgccatctgcggtacctcgaacaccaccacctacgtcgagtcttccgccggcatcgccgcaggcggccgaaccggcctgacctccgtggttgtggcgatctgcttcgccttgtccgcgttcctggccccggtcgtctccgccgtgccgtccgccgcaaccgccggcgtgctggtgatcgtcggctgcatgatggccgcttccctgaaggaagtcaagtgggacgacatcgccgaagccattccggcgttcttcgccgccgtgttcatggccttctcctactccatctcctacggcatcgccggaggcttcatcatgtactgcatcgtgaagacctgcaagggcaaggccaaggaggttcacccgatcatctggactgtggccgcgctgttcattctggacttcgtgtgcatggcgattctgtaacgctgattgacaacggattagcctttaaggattaatccgccgccatacggcataaaggccgggctctcacaagggcccggcctttgttgttgccacagtgatcaacgcccatgagtaccttcgatgatcatccgccattcttgatgcatgggaatagttgtcaaccgacaactaaacgtacatggcggcagcacgagtgccttattcaacatcgaaatatgcagcgcgaagaagccgaaaaaccaaaaaggcttctataccgaatgaaacggtatagaagccttttggtttgcgatcaagcccttctcacccgagagaagctagagaacgatcagtcctcgaatgccgaaccgttaagcgggaagccctacgggcttcccgtaggtgaggggagcggctatgccgcgaccgatccgtgagagggatttagtcctcgaacggatcaaagtcgcgacggacgcggcgacgcgggcgctcagtacgctcttcgcggtcggcgcggtagtcgtcgtagttgtcgtcggtggcgtagcgcgggttacggtccgagccacggccacggccacgggaaccgccacggcggtcatcacgatcgccacggtcatcgcgatcggaagagcgacggcgacgcggacgatcatcgtcacgggagtcgcgagcatcacggtcatcgcgatcgtcgaagtcacggtcggcagaacgacggcgacgcggacgatcatcatcgcgatcatcgcgatcgaagtcacggtcatcggagcgacggcgacgcggacggtcgtcgtaatcatcctcgaagtcatcggagcgacggcgacgcggacggtcgtcacgatcgtcgaagtcacggtcatcgcgctcggagcgacggccacggccgccacggcgatcgtcacggtcaccacggccacggccgccacggcggtcatcgcgatcgccacggctcgggcgggcgttgttctcctgatcctcgaaaccaggaatggccagggagatcttgccgcgatcatcgacaccctgaacgatcacctcaacggtgtcgccttccttgagcacgtcttcgacagcgtcaatacgctcgccgttggccaggttgcggatctgggagatgtgcagcaggccgtcggtgccgggggtgaggttcacgaaagcgccgaacgacgtggtcttgacgaccttgccgttgtaggtttcgccggcctcgggcacgtgcgggttggcaatctggtcgatgatggccttggccttctcagcagcctcgccaccctcggaggagatgaagacggtaccgtcatcctcgatggcaatttcagcgccggtgtcttcctgaatctggttgatcatcttgcccttcgggccgatgacttcgccgatcttctcaaccgggacggaggtggtgatgatgcgcggagcgaactcgctcatctcggccgggccgtcgatgcactcgttgatgacctcgagaatcgtggcgcgggcttccttggcctgctgcagagcggcggccaggatgtcggcggggatgccgtcgagcttggtgtcgagctgcagggcggtgatgaactcggaagtaccggccaccttgaagtccatgtcgccgaaggcatcctcggcacccagaatatcggtgagggtcttgaagatgtgcttgccatcaacgtcgccggacacgaggcccatggcgatgccggcaaccggagccttcagcggcacgccggcagccaaaaggctcagcgtggaggcgcacacggaacccatcgaagtggaaccgttggaaccgatggcctcggagacctgtcggatggcgtaggggaactcttcgcggctcggcagcaccggcacgagagccttctcggcgagggcgccgtggccgatttcgcggcgcttcggggaaccgacgcggccggtctcaccagtggagtacggcggcatctcgtagttgtgcatgtaacgcttggactgcggaccggacagcgcgtcgatctgctgctccatcttgagcatgttcagcgtggtgacgcccagaatctgggtctcgccacgctggaacagggcggaaccgtgcacgcgaggcacaatgtccacctcggcggacagggtgcggatgtcgcgcaggccacggccgtcgatgcggtagtcctcggtcaggatgcggcgacgcacaatctggcgctgcagttccttgaaggcgttaccgagttccttgtccttctcggcatcgtccatatcggtgaactcgtccgcgagcacctcgcgcacgtgctccttgatctcgtggatgcggtcctggcgcggcagcttctcggcgatggagagggcctcgtccagatccttgtgagcgatctcgtcgatgcgggcgtacagctcgtcggtgtactccgggaagagctggaattccttggtctccttggcggcgatcttcttgagctcgtcctgagcctcgcaaatcaccttgatgaacggcttggcggcctcaagaccaccggcaacgacttcctcatcgggcttggtctgaccctcgtcgtagatgaggtgccaggcgttcttgccggcaccggcctcgatcatggcgatggcaacatcaccgttctcgatcacgcggccagcgaccacaatctcgaacacggcgcgctcacgctcgctccaacgcgggaaggcaacccactggccatcaatcagcgccagacgcacaccggagaccgggccttcgaacggcagaccggaaatcatggtggaagcggaagcggcgttcagggcgatgacatcgtaagcgtcatcagggttcacggcgagcacggtctcgacgacctgcacttcgttgcgcagggtgtgcgggaacagcggacgcagcgggcggtcgatgatacggcaggcgaggatggcctcggagctcgggcggccttcacgacggaagaacgagcccgggatcttgccggcagcgtacatcttctcttcaacatcgacggtcagcgggaagaagtcgtagttctccttcgggctggaaccggcggtggtggtggacagaatcatggaatcgtcgtcgaggtaggcggccacagcgccatcggcctgctgggcgaggcggccggtctcgaagcgcagcgtgcgcttgccaaacgatccattgtcgattacggcctcaacggccttgatttcgggaccctccatagggttcctccttctttaattttctaattattcctacatactgtgctgcggttcggcgactcgcttgaaccgcaactgtcctcttcagcggacgtcacataccttgtttcgactgaccccttggccgtcgttcctcgtgtcaaccccttcattcgggttctcctgtcggccttacctgctggcctatcctctaaccctcttgccgttgttgccgttggctggcgatatgtaaaacgcccgagcaccatcctaggtactcgggcggaagtcttcaattatcgacgcagacccagacgctcgatgagggaacggtaacggttgatgtcaacgcgcttgaggtagtcaagcaggcgacgacggtcaccgatcatcagctgcataccacgacgggagtggtggtcgtgcttgtgctccttgaggtgctcggtcagatcagcgatacgcttgctcagcagagcaacctggacctccggagagccggtgtcaccttcatgggtcgcgtacttagcgatgatttcctgcttttcttcagccgtcagtgccacggcatcctccttatattgctgcgcggtgctaccggcccgatgccggcgcgctctctatccgcgggcgaaatacgccaagggtcaattatacaggagcaccagacaccacgaatcagaccaacgtcagcaggccgccaaacatcacaacaagcaaagcaatcgtctcaatcacaaaaaaaagataaacgacgcccaactgcgcgtcagcacattcaacggcgactcttttttaatcgtcaccaacaatcccacccacagcaccgcgaaaacggcaacgccaataccaactgaaataatgccaagattcgccgcattcgccaatgccgacgactctccgtacaccacatatgtcgcataccaaaaatcaattttcagaatgcgcaggccggcaatgagttgctccgccgccaagccaatcacaaaaaccgcgccccacaagcgccgatgggcgtcaacaaccagcagaccaaggccggaaacggcaatcagcgtcaccgtccaggcaacaaacgcggcgccgcgcggctcaagcgcgctcaaattatcaagcagccactgcgtatcgttcaccgcaatcgcacgcccccaccaatacggcaccacaatggccgcaatcaccagcagcgcataagccagccacaatgcaggatgcgagcgcttacgctcaatatcggccagcgacagcgtcgattcgggaatggacgccaccggatgcttggaaacatcgttatgtttggaaacatcgttgggcatgggcgaaacaccatcggaccgcgtatcgatttcagcctgcacctcaccgctcgcctgctggtcgaccggctgtttctccacgctggaattcaccgccatctacgtttacctcgcgttcgttgttcgacgccacacctgtctgcacaatgcgtcgtctcatgccgcgacgcccatgctaggacggtattgtatcgtgagtgcgccatacgataatgacatggcgccggacataacgccgcaatacctgattttcgctaatcgcaaccatgcttcggcggacgacataagccatacatatgttcataagggcgaaccatatccgaattactcactccgctaacatcaccacataacggcaacatagatacacagccatacttgatatcaggagaacgccgtcgattcgaaatgaaaactgccagccgcccacacaccagctcctttgtttccaaaatcgcacattctacgccgatgtcatgctccaccatgtctcacgccgcggtctcaacataacaggatgggttgtacgaatccacgttgccgagcattcgcacaacccaccattgcgacacatcactgattccgcacattcaatcgctgcaaccaacaggctgcggcgatatttcagcgcgaagagcggcgtatccgaatgacactgatgccagccagcatcagggcaattgcagacagcaccatcggtgttacggacgaaccagttgatgacagttcagatgaattatcatcagcagtagaagactgttgctggccgccatcaccggtctgatcgccgttacccgactggttaccgtcaccggtctgatcaccaccaccaggatttccgccatcaccagactgacggtcaaccgccaattgcgcgagctgcaaactcagtgcacgctgcggggcatccacctcattttgcgtggaaggatcggatgccaacgcctgctttgccttatcaagtagcgtgagcatcttatcccactcatccataggatattccgcagactgcagagagtcagcctgatcaatggccgaacgcagcttagacgtatccacagctttgccgtcagaagtcaacacgtcgctcaagtcatagtaatcaaaatcgacataaccacccgtattctccttggcgtaattgaacaagccgattcgataccccttaaagtgcgacaagctccaatcgtaagtcagcggcccctgctcgtcgccaagcttggaccattgcttaccgtccagactgtaccaatactgaatcgtcaacttaccactcgcattatccagtgtgttgtccgacttgatccacacattggtcgcatcatctggcaatgtcactgtgccgcccgatacaaaggcctcttcagcgtcacgatcaatcgtatcgtcaacgatattaccgtccgcgtccttcacgccattgtcgtagacacgcttgaccacgcccaacgttcgctgtccattttcttgacgcacagcggcataggcaaaactacgggtatatgtagcgaggcctgcggtgtctccatccttcatatgactgacatccatgtgggtttccacagacatggatccgccaaaggtacgctgcgacaaaacgttacgggcggtttcaaaatatgtcaggtcgccataagtgcctttcatatatttggccgtggcggaaaccttgtgcccattggtcaaacgcaaccagccttcacgatcagtgagagaccaatatcggttatctggattatgtccccattcccataccaaatcaagattcgaaccattgggttggtattcttcggcgaccggatattccttctcatcagcaagaccgatcagggaaatatcgtcgatgacgtaatccatgcacgtgccttccgcaccccacgcggtttcgacaatgagtttggaaccttccacattagcgtcggatgggatggagaactcacctgtgatagtagtcgtctccccacgtttcactgttcctgtggccacacgattaattgtgccgtctgcatattgaatcgccacataaaacaggtgggaagtcacagccgatgaatcgacgccgtccatctcatggtcgtatcgaatcgttgcactggcacgatatgtcacgccctgctgcaattttccatccatagattgacccgggccagcgccattgtattcgccacgattcgtcacagcaagactcgtggttccagaaagagaaccatccgtaatcgcggtaagcgtaccattccactgaggggtccacgattcagtcccgttttcgaaatcgccattgtccaccagctcgattccaatcagagaatcgtcaacctgaggaggctcctccagagtccaccaatcctgatcctgataagactgatgaggcgcgtcattatcaaaatcgtccgaattgaccagggaacgctggcgaaccagattctccaaatcagcaggcaaatcaatcagtttgtcgtaggtgtccgacgcgcttacctgattattgtccccaaacacaggccatccgtcatcaccccacgttgcaggaatcaaaccgggaatacgtccggtcggatatgtgtctcggaagaagaatccatgccaagacgtcgtgccatcaccgttgtcgacttcaacaaggctaccttgtgcgaaagcacctagataatactttttggcttcgtatttggagccatcaagcaaatcagtggtgcgcagcagcatcaccgtacgaccgtctttgccccagtaaatcgttggagtatagaaataatcaccgattttgaaagtctgagatccttcaaatccggtaggagtctcaccaagatcatcagtgaactgttcggcagagatgatattctcatggctctccaccaccgtggttaaatcatcggacagcctatattggttgacgccggagataatccaaggactcccttgctcatcaaaatacaatgacggatcatggaatccccgattaagggcaatcttcgtccaaggaccattctcaatatcatcggtgtagtagatataagcgccattaaggttgttcgtattgaataacacgtagaagcggccattgtgatagcgcagcgacggagcccactcgccttcgccatacgagctagctccattgcgcaaggatgaagcatcgctcatagaaatgcgatcatacacgtacgtgactatccaccaattgaccagatcataggatttcataattggagatccgggactgagctccatagtggtactcaccatgtaatacacatcacgaccgtctttgttattcggatcgtccttcgacacacgaataacactgatatccggaacatccgtgttcaacatgggaatggaatacgtgccatcaccgctatcagtcgtggtgtaactgccatccgatggcgttgaagatggcgttgaatcatccgcaaagaccggcattggcgccaaaatcaacccacaagtcgacaacaccgcgatagcactagccgaaattttttgtcgtaaataattcataagtcttttaacctttcatgataagcactcaacatcgagtgcgtattccaatagcatgcccgcacaaatcagcaatgaatgacgataagacattcccgcatatggataagtgatggacattaccactgccaaaacttacgcttgaacaagtaccagttctaggtttcatgtgcggtcatcccgaggctgccgctacgggatgaccgcattaccaagaggtaactagcgcatctcgcgacgcactcgcgctacgatcacaccagtgagagccaagcaagcgacaatcacagcaccaggcaagacagaggaaccggtttgtgccaaatccacgccatccgtgtcatcaacggcatcggaagcattgtcattggagccgtcggcattgccatcagtggaatcatcagccagcttcagaccggcacgtgcactattcaatgcagcaagcgcatcttgaacctgctgttcagtagcggattcatcctgcaataccgcctgagccttctgcaatgcgtcagcaaacaccttccagctctcttccgtgtaatcggaagcgttcaggccggaattctcattcactgcgctctgcaaatcagacttgtccaccggagtcgaaggagtttcatcctgcgactccgtgaaagtgtacgtagtgatgtcgtacagctcatcctgagcattcgcaccaccatcggatttgaaggagaacaccacatgatgcacccctgtcacaccctcaagggtggtcgtgtaatcggcgtactcggatccatcaccggcaggaatcgaaatagaagccacaggttcggaatccggatcatcaagacgaatctcaaggatgcctccggctttgccagctgcagtcacagtcagcgaagaggcgccgttattcccgaaatcgacattcgccaaagacgtccactcaccattattaatattgctgagcttctgaccttcggaattgtctgtagtcatatcgaccacgcgcacaccagaagtcaggtcatatgcgttctgaatgccggaatcccatgcaatggtggaagctggaatgcctccatcttgatacgcgtccagattcttcaccgaagagagaccctcatatgtcattgcaatatcggcaatggaaccatcctcgttaaccgtaatcggatcgagatgagtatttcggtagccatgcgccgcgtcaagattaccgccgttcatcaattcctttgccaccgtttgcgcatggtaggtcatataccactggtcgccaagttgaaccatcgcgtgatgattgttgccgccaacaccgaaatacgtgctcggattcttcagaatctcaccctgataagtgaacggccccatcgggttgtctgaagtcatatacgcgatattgccgtaaccgaccgtgttaccatcaattacgttgtcatggctgaaattagtgcaatacgagtagtaataagtaccacctatcttggcaatcccggagtcctcaaacatggcaggtgcgtctatggcctgagcctcaccttcggtatgcagcatgtcatcggacagtttaataacgcgagccgtgttcggatgttcttcctcgcctgtcggaacaccacctccgtaatacaggtagccctgcccgtcatcatccacgaacaccgcgggatcaaacagccagaccacaccagcggattcaggagtaccgcccttaatcaacagctcaccggtttcgtccttccacggaccaacaggagaatccgaggtcagcacaccgataccgctgccgccattggcgaaatacaggaagaacttctctttaccgttgatggtcttatgagcgacggcaggagcccaggaattgctggcccaggtggccaccccctgttctccagccacacgaatgtaaccctcattacgccaattgaccatgtcatcactggacagaacattgatggtctttacttgagcgaacgaattgtccttgatctgcccagtactgtcatattcatagtcataattcaacgagccatcagcattcacagaagtgccatcacccgtagtgtagatatatacgcgtccgttgtattccatagcccacggatcggcgccataccaataatcgataatcgggtttgaatagtcgccgaaagccttggctgccgttgccgtacccgtagtcggcggcacgaatgaggaaccagaatccgaaccggttacggaaatgtcgtcgacaatgaagtcggcattgctcgtgccatacttgttttcaatcaccagcgagggactggtgaaatcaccactaccacctaacgttccagtacctgaaatttgtgtccactcacccgctttcgccgttccggtcgcaatctggtcacatccggaaccattacccgaacaaacagtgatattgaattcaccgtcttccgtggccttgacccacatacttccggtatatgtctgtcctttttccaccttgccatcaagagactggattgcaccagcatcagaggatgtacgatcagtaacgctcaaggcgccactgccaccatgcacatcatccgcagtgacggcaatggacgatgcggagctattccacaccgttccagacttccaaccattaagatcgtcttcgaatccgccgttgacgaccaattcgacgggttcatcggccgacgccgcagtcactccgatagtcgctggaaatacagcccccatgcaacacagcacggatgcagccgcagcagcaaccacacgaccggttttccttgtttgcaatatgtgaatgttataaaccattcagttccctttcctgaatgatggagggcgactccccccccccatcattttttcttcgccgcacaatcgaatcccacgttggttacgaccacatcgcggctcattgcaaagccatgccagaggaacgtccctcaagggcagccatgcagcagccattatataaatgagcgcatttcactcgcgatcgtccttgataacaaattgataacgatatgcacaatgaaaataagttcacataaacgcaacgcaacacatcaaatatgacagtttcatatgccaattacacactttgcataacatatttcaacaaagaatggagacgtacaagcgaactcatctgatgccaccactcatcgcctataaagctggcgtgtcgcgccacaataacatcacagccgataaaacgacaccccgaagttgagcctcattcaacaatgcggccagcttagacacacaaccaacgcttcgcttcatagcaccgaacattgattccagcacagtcacgaccatcttctttgaaggcaatcgtgtttacgccccgggttctaaatagaagtgcaacaccttgtctaaggttggaagtgttcgaagtttctaacttaagaaggtgttgcactcatgggtcaacagtattcgcacctgtcgtccgaggagaggatcctgatcgagaagctgcattgcgaacagcatctgagcattcggcgaaccgcggagaggatcggccgggacaagtccacggtgtcacgcgagctgaggcgcggcctgtggttcgcgtccaacgagaacgggtcgtaccgtccctaccggccgaaacggctgaagaccgggccgtggacctcgggtccgttctattcggcgctggccgcgcagaggaaggcggacctgcgccggcgcggatcccgcaagccgcgtcgcatggactcggaccggcttcgcgcctgggtgctggactcgctgcgcagggggtggagcccggaactgatcgagggacggttgaaggcccggtacgccggcgacccgtcgatgcggatcagccacgagtgcctttaccagtggatctacgccaagccgcagcgggcgctggacctgcgccagtacctggcgcgcggcaggaaacgccggacgaggaaaaagggcaggaaggcgaaagggccgcgcatcccgatgcgcgtgcccatcgcggaccggcccgaggcggtcggatccaggaaggggttcggccatttcgagtcggacacggtggtcggcgccgcgccgtcgaggcgctgcatgaacacgcaggtggagcgcaggagccgcaggctgttcgcccggctcgtcgacgacaagagcgcgtccgccacggccagggccgaatacgagatcttcaaggacatcccgccggccgcgcgcgtcgaccgcacgtgggacaacggcacggaggcgagcctgcacatgctggtggacgaggcgctgggcatgctcacgtacttcgccgacccgtacagttcctggcagcgtggcagcaacgagaacaggaacggcaggatccgccgctatctgcccaaaggaaccgggttcggggacttggcccaggaggacctcgacgcgatcgtcggtgagatcaacgacaccccgatgaagctcctcggctacaaaacgcccaacgaggtatgggacgaggagatcgccaagctacaatcgaaggcagccagcccgaacacaagcgttgcgcttacaaattgaatccggcccgccgaggcattcgccgacgaactgctataattgcaggaccaacagggggtgttgcacctctaaatagacatcgggcacacggtttgcgcggcggtgagcagtgagtggtgagtattgagcgacgtacggcgactcacgtgcgctcacacagtggtgagcaatccgccgaacaacaccacgagcagggcgatggtttcaatcacgaagtacagaatgaaactcgcccagcttttggtcagtacgttcagcggcgaggtcttccggataatcaccagcagaccaacaaacaccagggcgtatacggcgatgccgatcgccgcccccataatgcccagattcgcggcatttgccagaccggcctgcttgccgtagaccacgtacgtggaataccagaagttgagattgagcatgctgagtcccgcgatgaactgctcacaggccagcccgagcacgaacacgatcagccatggccaggacggcgagacgaccaccgccatcgccaatccgacgtacgtgatcaccacggccacccaaccgaccagtgcgataccttgcggagacactcccccgagcacggccacaatggagtcagtattattcaccgccagcgagcgaccgaaccagtatggcgcgatgatggcgcacagtacggcaagaataatcaacgcccaacgcaacggatgggagcgacggcgctcgatatcagccaaagacaaatcggtctcgggtatggaagcctcggggtgcctggaaacctcgacggtctctactttgccgcctacgatttccgtcgcctcgttaggttcttgctcgttgggttcctgctccatgcaccgcctcgccgattacctgctcattgccatgtattgccatgccgattattgcgatgcctatcttagcgtgcgtgttgggcaagtacctgatgctccctgcggtttcgcgcgctgattggatacagacaggctactgctactgcccgtctgcatccggcgacttgtccgccgctgtatccgtctgttcctcaggcaacgtattggcagcctgttccttacgccgcctgccgtgcagcagggcctcgagcatgtcgacctgacgctccagttcgtcgatacgacgtacctgctgcgaaatcagcaagtcgcgtaggtcattgttctgctctttgcgggagacggggaagatgatggcgcgacgttcgggcgatacgtggaaatcggattcgctgccggtaccagccggaagtgacgattccgccgagtcgcgccaagctctcgctgctcgcgcactctccggaatgtttggtgcgcccgcggctcccgagcggaaaagctccgaatctgaagccccccccccccagcttattttccacgccggctttggcattgccggagttcaggatttcgtcttgcgattcacgccagcgggcaaggcaacgttcgatgcgcttgtacccgattagagccggatccaatccggcttcacggaacatgcgcacgggtgaggcaccttcgttgtagtggactacacagtaacgcttgaaatcatcggtataggtgatgcgcttcgccgtggcttccgccactgccgacaacgacttcagatacttgatctcctcggggctaaaagtccctccaccactggtcatcctcatcccttacactcgttggaaggctcattgcacaccccccttgattatggggtgaatgccatagttcgggatagtaatacttataattcggacatgcctaacccctagtagggtcgtttttatccccgtttaagtggagcctgagtagtggctggacggcaactgaacgataatcagcccacgaatggggtatacagacccatccttcacctcccctacgattgtgttcgcttggcgattgttaccgagcctgcgtgaaacgtttgttgtggcgaaacacaagttattttcgatgcccggccccattacattcaaatcaaaatgccatacattgcccataagattcggagatggcctacaagtcatccgtatgaaatgccgccaatatgacaaatggccgatctgaataatcagatcggccattgttatagctgctcagttacaagcagcagtcaagctcacgcgttgagagcgcgcttggtggaacgggacttgacgaacacggtcaccgcggcacccgcgatcagcagaccgatcacggagaacagcatggttccggcggcaccggtgagcggcagctgggtgatgttcttgacgttggtgacctggaaggtgcccttgttgtccttggacaggttccaggcatccttaccagcgaaggtggcagcagcatctgcggttgcaccggtagtgatcgtgaacttgccaacgaaggtgccgttgtagccagtcgggaccttcgtctcaatcacggtgtaggtggtgttgagcttaagaccgttcagagtgtacttaccctcagcgttggattgcagtgtgtccgtggcgccttcagggtaagtgccatcagcattggcggtcggcagagaatacgcaccgttagagctattgaacttaagcggagtcttcgctttgagctcgtcagcggacagaccgctaacatcgccttcgtacacttggaactcagcaccagtcagagcagcagcgttcttgtcgactttctgccaagtcacggcaccagccttggtggtttcttccttgctgctcttcaggtcgacaacgccggcagcggcgagaacgccagtggcgttgttcacggacggcgcggcgcccgtgatagcagtgccagcgagaatcggagcattgccattccacacgagcttgtgagtgtcattatcttcgacgaccagctttccactctggtcgacaatcaagtacagaccaccctcagcgaaggtgaaggtctgggtcttgccaccgttagaagccgtcggggtaatgtccgtgacagccagatccttaagcgcgttcacaaaagcggtggtctgcgcggcggtcagggtagtgttgcccagccaggcccactcgttcagggaatcacccttggtctggtcgttgtaaccagcagcagcgaaagcagcatccactgcctcaccggagaccaaaccctccagctcaacgccagtgttgccatcagacacatacttggcgagctcaacgtacttgaacatgcgcaggttagcctgcaggtcagcggtgtcaaccggcttggtgtagaactggtttgcatccgtggcgttgactgtgatagtcgtgctggagatgttggcctcagccgcgttggcggtggtggcgccgaaggccatgccaccgagcagggtggccgcagcagcggcacccgcgaaaagcttcctcaacttcatgagaaaccctctcttccttattgtgattgattttcttgcaatcgcggaggctgcagacccacagcaaggcctccgcaatccgcaaatccttattgttttttcggggagggaagccttcatcgactcccctcagtccgccttcggcggccagctcccctcagcgagggaagccaaaaccacctcaagtttcttgaaatcagaccagctgacgcttacgccagaccgtgtagcccgcagcagccagcagggccagcaggcccaggccaccgccgaacaccatccagtcacgaccagtcgtgccaccggtcagcggcagactggagatagccacatacttgttcgtgaactgtgccgactccgtattcgttcggtcggaatcgttctcgccgtactcgtaagagacaacggcatccgtcctggagaccgtgaccttgacggtcaccttatcgttgtcatacttccaaccggcagcaggcttttcggtgtcctccgaagcctcgaacgtgtagaccaaattgtcagcaccggtcggaaccctgaacttcaggtccccattgccgaagccaaccgtcgcgctcgcgccgctagcagtcaattcgtccttggacacagtcgtagtcagtccattgttggccaagccggtaacgtcagcgcacttaccagcattcgcatccgtgctatccacacacttcaggttgaagccgaagtccgaattagcagcatgtccctgcacaaccttcgtcaccttgacatccgaagcgggcaaggtcacgtaagaaggcgtgttggttaccgtgaaggcaccggattgtgcggtcaaaccttgtagcttgaggtcagtcttatcaaccttggagtcatagccttcaaccttgacctcggaaaccgagtatgtgtgcccctcagggccggcaggcaccgtgaactcgtgagtccagttgccggcggcattcagagttgctgaaccgttggcataatcctcgccgtcctgcttgagctggacctgcacggaatcattcgcgtgattctcgttgtcgtcggaccaagtcttcgtcaccgtaatcttggagaccggaagggtgatggtcggcttctgcgggtaggcggcggtctgcggatcgctcgtcgtcgtgccgccctgcgaggaggtcaccacggtcttgtagtcgacagtggcgctggagttgtcgttcgtgtagaagttgttgtcgccggaggcattggcatcgtccttgtggttcttaacagcctcgtcgaacgcagcctgcgtcggcttgacattgaagctcaccgtgtaggtgacgccgtcctcaagcgtgtcgtcgttggacgtgaccggccaagacacggtgccatcagccgcaaccgtcgcctccggggcgtcagcccacgccgtggtctggcctttccgggtcttcgtgtacgtgaagcccgcgggctctccattctcggaggcgctgtcggagctcacgacccagctggacagcctgtcgtgaatcgtcacgtcggcatactcagccgtcttggtgatctcctgataaatggactcgaagatgttgttcagctggccggcatccgtggcggccttgtagtagctgctggtctcggcgcggtcaccgaggttggcgttccaagactttccccacaaatgctcactgctcgttgcagtggcatccgggtagttgctggagatgccgtgcatgtacttgttcaggttgctcgaggtgtcgccggggttggcaccgctgacgacgccgatcgagtagatggtcgtcccggcgtccttcaggctcttcgccttgttcaccgcggtggcggcgacggtggggtcaaacccgctgccgtggttcggctcgccgtcggtgaagaagatgacgaccttcttcgcgttggcgcgaggctgatacgttagcgccgcctgggcgcggttgaaggcgtagtcggcggaggtcgcgccggacgcgctcaggccgttaaccgtgctcgtcagtccggagacgtcgtacgtcaggttgctgacgatctgcgtgtagttgtaggaggaccagccttcgcggtaaaagtcattgccgacgctggtcttctcggtgccggcgaacttcaccagggcgatgcggttccgctggctctggtcggtaatcttcgcgttctctgcagccgtcgcattgatgaatttattgaccgcggtcttgagcgagtcaatcttcgtaggctggttccaaccgctagcgatcttttcggccatcgaaccggacacatccaacaccagcacgatgtcgagtggctggttcgtcacgatctcgcccgtacccgcgctcttcgcaccggtgacgttcaacgccaccgtgtacgtgccgtcttcattggcggtaacggtcttctcgcgggccggagcagacaacgtcggatcatccggcacgccgtttgttccctcggtggaaagaggagcaggcgcgctggcggccgccttctcatcggtggtctgcgattgtgtcgtggaggcattcccatcgtccgccatggcggtcgcgctcacaccggcgacgccaccgagcatcgccacggcggcaacgatcgccactaaccgtttgcctttcctgcccgccgcggcccctaccgctgcgaaccattctgcaattctcttcataaccttgcctgtctcttacgatcacgtacgccaaaacccggcgttacgcttataaggcgttacggtattaagcaaaaagcacgaatgcgtacacccgggtagagggaattttttacccgacactgaaaagaaccttggaatttttgaaaagtggcaccctcgtcatccaccctgcgataacgcacttttcttctcgacggggcgtgccggtcccaccatctgggaactgaggcggatttgccgccgctgcgcgggggccggagttactgacgaccgtcagtatgccactgctccgcatgtgtgcagtatcacataccgctacgcatacacggagacatactacatgcaatttctgtgaacgcaaacatacgactcaccaaggccgtgttctgttgcgggcggtggtgttacgggcaatgttgtgggtagtaccctagccacaaacctatatagtggagcggatgacgggaatcgaacccgcgtaatcagtttggaagactgaggctctaccattgagctacatccgcgttaagcgtcgcttttggcgacttgagttattatacatatttcttcggggatggcaaacgcgtgtggctgcagcaggaccagccaatctagttgatggattgcggctttgccgaggactcccctcagtcgcctacggcgacagctcccctcaaagaggggagctggaaaccgtcgaaatcacaaatggatgagctgggactcgtatggttggaggtcggcgcccatcgcattcagaatcacgaaccagcagttttcgggcagcgagtcgagcttgtcgatctggttcttgagcaggcgcacgtcgcggctggtgagcgcgccccacaggttaaccatgatggagacgttgtacagcatgtagcactcgggggcctcgggcgctattccacagaaatcgtcaccaccgcggaggcaatcgaaccatcgtggctcagggaaatatggatatgcggcatcgaccccgcaccgatagtcgagcgctgcgccgaacgcgcattccgccgctcctgcatcactgcataaggcccgttatcggaagcagaggaataagcagaggaatagcgagcgccggcagccgaattcgcgtaatcagtttggaagactgacgccgcccccttacccagagacacatgcggcacaccacgggaatcgtccaagatctcgatttcaggccacgggaaattatcaagcgtgaacggatagggggcatcgccaagataatcgcaccaggctttgaggaacgcctccttgcccgcccatttggcggccagatggacggcctccccgtcattcttctggcgcgcgcggtcggatgcctgccgcacctcacgcacggagaacagcgcacgcatgcgagaccccggctccgccaactgttcggcgaatgcggccacatccaccacgtcatgccccaaaccacaagtattcatgcttcctattgtgtaccgcttcgcgcgtaatctctacacctcatcagaattggggcctgatttccatttcagggggaaaagattcactatgctggatgacctcgcgcaataccgcaaacatcttgggctggctgcctagccgtccaaaaaaacatccgcgccccgccccgaaggtctatctccgtttcgaggggcggattttgaccgttccggaggtctacttccgtttcaaggggctggtcatcctccataccacgagtatccgcagcataacgccaacgccattccgccgtttttacgccttgtctacttgggtaacagccccttgaaacggaagtagacctccggcgaatgccaaatcagccccttgaaacgcagaaagcccactccgagggaggggctttcgtatgttctgcatatttctctcactgagtttgtgccagcgagaaagctccaggggaaactcccctcacccgcttcgcgggagctcccctcaaagagagggagccgagatccggtgcgctactggctcccatcaaccgaggggagccagaggaatcaggcctcgtagtagccgtcggcaccgaggcgggcgtccgggttgaggagcatcgccttttcgacctcgtggtggtcgtagccacggtgatcctcgcggaagcgacggttgtcgatcggctcgtagagcgcggcgcgacccatcatgccttcctcaaggtgacgctggccggcggccaggcgggcgttggcacgctcacgccaagcttccagtgcggcctcaccatcggccttggccacggccgcctcgaaggcacccggatggaccagagccacgaagccggaaacatgtccgaagccgagcgaggtggccagaccggccttgaccgggcgaccagcggtctcgcgaccgaactcgtcctcaccaccgccgatgcgcaggggcttcctaacccagaccatgtggtcgtcgcgctggagcttcggatccacgcagtcgagcgccgcgttcgccggaatcacgccggacttgaacagctgcgtcagaccgttgacctggaagatgcaggcaccacccttggcgtggccggtaagcgtcttctgcgagatcacgaacagcgggttgccgtcggtgcggccgatggcgtgggccagcgtgttgtgcagctcggattcgttcgggtcgttggcgttggtggacgtgtcgtgcttggagaccacggcgatgtcgtcggctgagacgccgagcttagccaggtcgtgcacgagcttggagtccttgccaccgaggccggcagccagggcaccgaggcccggagccgggatcgaggtgtgagcaccatccgcgtaggagtggatgaagccgaccacggccgcaaccggcaggccgagcttttcggcgatgtcaccgcgggtcacgaggatcgtgccgccgccctgggattccaggaagccgccacggcgacgatcgttcgcgcggctgaagaagcgcgcgtcgatacccttgccatacatttcctccgagttggcggtggcgttcatgttgccgaaaccgatcacggattccacgccgatgtcgtcgatcgcaccggtgaccacgaagtcggccttgccaagggcgatcttgtcgacgccctcttcaagggagacggccgcggtggcgcaggcggagaccggctgaatcatgttgccgtagccgccgatgtaggactgcatcacgtgagccgcgaccacgttcggcagggcttcctgcaggatgtcggtcgggatctcgtggttgaggaagcggtcgaggtacagcttgcgcatcgacatcatgccaccgaagccggtgccctgggtcgaagccaccagcgaggggtggatggactcgaggatttcggccggggtgaagccggcgcccaggtaggcgtccacagtggtgacgatgttccacagggcgatcttgtcgacgtcgccgaccatcgaggcgggaatgccccatcgggtcgggtcgaagcccttcgggaactggccgccgactgtgcgggtcatggtggcgcggcgcggcacgcggatcatcgagccggcgtggcgggtcacgttccattcgccggattcctcatccggggcgatggtggtgtgagcctcgtccaacttgacgtattcggcggcgacttcgcgggtgggcacagagaaggtgacgtcgtggtcgaggaagacctcggcttcctcttcgtcagcaccgtccttgtagtcgttgcccatgccttcctcgaacgggcggatgccggagcgggccacgacctcgtcgtggtagcgctcggcgatgtcctcttcgggcacgaggttgccgtcggtgtcgtaccagccgggcttcgggctgtcggcccaagtcagcaggcccatgttccacgcgagttcgagcactgcgccggcgctgaggtcgacggtgccgtccgagtggatgccgagctcggcctgggcgcgcgtacgaccggagccccacgggcccagctcaccgacggaaacgatgacgatttcgtcttccggcttggcagtgacgttggtccaatcgttcaagtcgaccggagcctgcttggtgacgatcggtgtgggcagcgccttgatttgctgcccacgcgaggagtcggacagtccagtggactttccggcgacggagccatccgtttcctgagacgaggccgcagcagcttccttctcggcgtcggccatggcctccgcacgcagggccttgatgtcgatgggctcggagccgaggccaccggtcaggtccacatcgagcggggccttgagggcctgctcgcgcgattcggcagtgcacaggtcgagcagcttggccgcaatctgtgcggtggagtaggtgcggatgccgtgacgctcaacgacggcgaccagcgggtcgttaccgaccatcaggccggtgccacgcacccagccgatcttcgggtgagcgaaggtgacgcggctcgaccacaccttttcagcgcgggcacggttgacgatggcgtcaaaggcgctcttgacttcgccgtaggcaccgtcgccgccgaatacgccgcggttcggggaaccgggcagcaccacgtggagcttgtgctgcacgttggtgtcggcaccgatgtggctgaagccggcgatggcgcgttccacgccccacagcatcagtcgggcctgcgattcgaacaggtcgccggagtcggcgagcgtgccatggaccggcggagcggcgaacgggaagaacagagtcggctcccacgcgggcttcagaatcgtggtggtaacaccggaggtcttcttctgctcgtggcccacccagtcgaccagtgcgtcgacgtcgcggtagctggagaggttggccggaaccagccacagcttggcgttgccggtagcgtgctcgcggtaggcctgcttagcccaagccttaatggacggcttgaagctgtgcgaggtggccaccacagtggcaccgcctgcgagcaggccttcgaccacctgagcggcaatcgagttcgggctcacgccggtgacgatggcgatatcattcgcgtaacgggaggcgttcttgttggacgcaacctgttcgagggcctcggagccggccttctggaaggcggccttgagttcttcgctctccgactcgttggcgaaccactgggcttcggcggcgatggtcttgccaaggccgatgaagctgccgttcaaggcggcgggatcgttgtcgtagtaggcgcgggcgaggtcttcacgggcggaggcccaccgatcatcgaagaggatggccttgttggcgtcgaagcgcggagcgacctgcttgggccagtcggagccaagttcggcttcaaccgcggccacgacggcggcgttctcgtcctcggattcttccggagccggagcggccacgccgagctcgttcagcacgaagcgggcggtggcggcgagcacgccgttggaaccggtgaccttctcggcgaaggcgtcgagcgcggcggaatcgaccacagcgccaccagcggcaccaccggcggacggcagggccacggcaacacccttgagctgggcgacgacctcaacggccgcatcaatcagcttgtcggcttccggcttgttctgcacggcggcggtgggcagcttggccaggtcgccgccacgggagctggcaccctcgcgagtgtcgagcagcagtgtggcgagcacgctggccacccaaccttcaccgagctgccatacgttggtcacgcggtcgcggatgtactgctgcttgacgccggcggcaccgaacagcgagcgcaggcggtcgcgcagcgcctcggatagcacggcaccgaacggcttgtagttcggggcggccttgttgacgatttgggcgagcttgtcgagcgtcgcttcagcagcaccgtccacgctggcgactcccagctcggaactgatgtccatgagcagctggttgcggcgagaagagacaccgttagtcagggtgtcggtggtgtcgttgctgccgatctggtcgatgcgcaccttggcggagtaggccatgagcacgccgatggcatcggaagccttgaagggcaggtcggcgacggcggcaccggacggcgcgccggccgcggcctgccctgattgcaggccgcgcgaggagtcggacagtccagtggactgtccggcgacggagccatccgttgtctgagcagcctcagtcacggcatttgccggagcggcaccggaaccgagctcggcaacggcggaaccaccggcaggagcggtttcgaccggggccgaggccgcagcctcttccggctcatcgtcgggaaccagcgaatcggtgtcggtcatgtagacgcggccttcatcgcggccgacgttgtagacgaccgtatcgttgccggcgaactcgggcagatgcagggtcttggcaccgaggttggccagggtcggggcgttgccgaggccgacttcgacgtattcttccacgccgaggccgccctgttcgcgctgaccgaagagcagcgcctgggtttcaatccaacgcaccggggaggcgaactgccaggagagcagttcggtcaagagcagacggccgagcttctggtcgtcatcggcgtaggaatcccacacggccgggtcgtcgagcgcggccttgatacgctcggacggcacgacttcgaggatcttggcggcgaattccttggtcatctcgaacggggtggccaccaggttcgggatgtagcggtccaccagacggccacggtagtcgatgtaagcgggaagcagcgcgtcgagcttgtcgcggaattccggcacgcccttgcgcagcagtgtggagtggaacggcacatcgatgccgggcaccagcatgaacgcgggcttgccaccgaatgcggccacgcggcgggcggaatcggccttcagagccttgagtccggcgatcgtaccggcgatggcgtactgctggccggcgaggttgtagttcacgatctccaggaattcgccggacgccttggccacggattccacgtattccttgacgtgcgcgtcgtccacaccgaactggttcggacgaagggcacccatgcggtagttggagcgaccctgtgcgtcacgctcgatgaggtggtgcatggtggaaccacggtggaacacgagctccagcacggtttccagcggaatcacgtcggcgaacgcggacagcgcgttgtattcgccgagcgagtggccggcgaagtaggcgggccagatgtcggcgccggcttcgcgcagacgagcggtctgggcgaaggccacggtggcgagcgccacctgcgtgaactgcgtcaggttgagcaggccttcggggtggcgataggtcacgccgttggcggtgagctccttcgggttatcgcgcacgaggcccaggatcgagaagccgagcttggagcgggtgagcttgtcggcgcgcttccacacgtcgcgggcggcggcggacttggcacgctcgtccagaaccatgccctgcttctggatgccctggccggggtagacgaaggcggcgcgcggcgcgcggaccagtgcggtgccgcgggagacgagctggccgtcgatacggcaggtgacttcgagggtcatgccgccgtggcgcaccttgccgacgcgctcgacggagatttcgacggtgtcgtcaagctgaaccatgccgtacatgttgtaggtccagccggcaatctcgtagtgggcacccttctcgtccagcgcctgcacggcgtgctgggcggtggcggacagccacatgccgtgcacaagcggagcggccaaaccggagatgcgagcgccacgagtggaggtgtggatcgggttgaagtcgccggaagtgcgggcgaaggcggtcatgtcgtgtggggcgacgaccttcacgcggcgcagcagacggcgcggcgtgggcgcgatctcctcgtgctcggcgtcgccgaactcgggggcgtctgccggcaaagcatcggagtagacgcggccgcgaatcgcgaaacgctcggtttcgcgggcaagcagcgtgccgtcggcagcggtgtgggtcacgtggatggtgaccacgcggccggaggcggactcgaagtaatcctcagcccaagacttcagggtgatggtttcaccggtgtgcttaagcaggtcctcctcgttcacctcaagttcgatgaggtggtcgaggtgaacggcgttgagcaggccttcaatcaccgggtagcccttgacgtacacggagccgagcgccgtgtaaatcgccggccaggccgggccgaccagcgcatcgggagcgatgcggctgggctgcagggtcgtcggcagagcggcgccggtggccgcttcgtggtcgaagccgaggttggcggagagggtgtaggcggcggtggcggtagcaaacggacgctcgtcagaggtcttgccgtcaagctgcggcatctcggtgagcttgtcgccggtgatggcggtgttgccgatgcctgcggtggcggcgagcatcgcgtagacgtccggaatcaggcgttcgcggtccacgaccggcacacggccgggctcggcgccttccacgatgagcgggatgacgatatcgcgcacggcgtgcttggaggtgccgccgtccgggtcgttgtcccagtaggtgtcgaggtggatgtccagatcgtacttgccggccgcggcgtcaaacgcgcggatctcgtagtactggtcgcccagggcggtgccgtaggcggggttgtcggtgatgtggccgacccaggagatgttcggggacttgcggatgaagtcctcggcgctggtggcctcgccgagtgcggcgaaatcgtcgttctcagcggcatcggcggcctgctgttcgtcctgcacgcgcttgatggcggcggtttcgaagcggccgaggatgtcggcgatcggctcgtcgatggtggtgatgccggccacggagatcgggccggggatggcacgcacggaatcggcggagtagcgctggtcttcggactgccagagctggtcctgaccccaccaacgcagcaggtcgttgtcgatgacgggcacgaacggcatgggcttggggtattcgcgcacgagcaccgggaaccaagccacgtcggccggaaccaccttaagttcggcggtctgcgggtaggccagtgcgagcttttcgagtgcgggggccggatcggcgagaatgtcgtcgtgggtcagcaggtcagcggcagctgcctcttcagcagaaacgccatcagcggcgaacagcttggaggtgaattcgccggagtccgtgtcgttcacacgggcttcgatgcgctgcagcaggtgctggaagcggtcggcgtaagtcgggtcggcccacgggaaggcgagttcggcgaagcgccgcgcccactcaaggtaggtcatggaggccaggtctccgaagtaaggcttggcggtcttgttcagggcttcgatgatttccttgcggcgggagtcgagctcttcggggtgcttcatgacgcgcacgagcagacggccgcattcggcggagtcgttctcgagctcgtaaatgtcggcgtgcaggtggctcaggccggaggacatgccgccgacggacttgccggacggcacccagtgggcggcctgcggggcgaacacgtcgtcggacttggcgtcggccggaatgccgggcgtcttgacgagcagctgcttgacttcggggctggtgtgagcctccttggcggtcatcgcggcggtaccgataagcacaccgtcgaccggcatgtcgggcaggccgtaggcgtgggcccactggccggaaatgtagtcggccgcgcgttcgggggtgccgatgccgccgccggcgaccagcacgaggttgtcgcaggcgcgcacttcggcgtaggtggcggcaagcaggtcatccagcgcttcccagctgtggtggccgccggcttcaccgccctcgacctgaaccatgatggtggtgggggccacggccttggcgatgcgcacaacctggcgaatctggtcaacggtgccgggcttgaagctcacgtacggcaggccgtcagcctgcaggttcttgatgagctccacggcttcgtccagctcagggatgccggcggagacgaccacgccgtcgatcggcgcgccggatgtgcgcttcttgggcacgatgcgggaggagccgaactgcaggttccacaggtaacggtccatgaacatcgcgttgaattcgaccgtgcggccttcctccagctcgtcttcgagggcagcgatgtggcggtcgaatacttcggcggtcacctggccgccgccggcgagctcggcccagtagccggcgttggccgctgcggccacgatttccggttccacggtggtgggggtcatgccgggcagcagcaccggcggcttgccggtgagcttggagaacttggtgaccagcttggcgccggccggggtgttgatgacgcgcggggcgaacgccttccagttctgggtgcgctcaggctcgctttccagcatggagagcgtggagcgctcggccagcgtggtggcttcgaccacgccgatgccggtgccctgcaccacgttgccgatcagcttgccgagcgtgttgccggggccgaggtccacgatccacagcttggacgggtcggcgtcgtcgaacagcgccttgacgcgggcgttccagtccacgtggttcaggagcacttcctcggcgagtgcacgggtgcgcttctggtcgaagccgcaggcgccggcccaggccacggtctgttcgacggcgtcggccatgagcggcgagtggaagggcagggtgacctcaaggtattcgagggtcgggttgaacacggtgccgccgtggagcttctgctcgcgcagcttggcctgatgctggtgttcgcgctcggcttcgagggcgaaagcggccaggtcttccgggtagccggacagcacgtggtggttgtcggagttggtgacggcgatggagatcgggccgcgagcgttgttgacgcgggccaccagagcctcaacctgttcgcgggtggcgcccttgacggagagcatcgggctggcttcgccatacttggggttcaggcccagttcgcgcacgcggcgggttccggcggcgccgatcagggcggccacggccagaatctcgttgagggtcttgccggcggcctcgatggagccggcggcctcgatggcgcgggtcatgtgcacggcgagcacgccctgggagtggccgagcacggcgagcggcttggcctgggccacgctgtagccgaggtgttcgaggtcgagcagggcgccgagctgggtcagcgccacgccttccacggacgcggtggcgtcggctgcggcgccgaggcgtgccgggttcggggcgaagccgaacaggtcgaccggacggccggtggtggccagcaggtcggcggcgaccggggtgagcagtcggccggctgcggcgacgtggccgcgcagggcctcgtcaaggctgggatcggtggtctggtctgccagggctaccggccacggggtggactggccggcgaaggcgagcgcatggggctcggtggctaggcgattgaggaagaaggtggtcattgctttccttacttgtgtttggttgacgtcttcaaaaatcagaggggctggttgccgtggtgtttggtggtgcgcttgacgcgccgcttggtggcgagcgtggccagcgattcgacaatcacctcacgggtctgttcggggtcgatcatgccgtcgatctgcccgatttccagtgacaggttcgcattgacggtgctggtctcgtactccttgatgtacttggcccgcagcgcatcgacgtcctgtccggaggccttggccttggccaggtcgtggcggtggatgatgttcaccgcgccggccgcgccgagcaccgcgatctgggaggagggccacgcgaagttcaggtccgcgccgatggccttggatcccatcacgatgtacgcgccgccgaacgccttgcgcaacaccacggtcaccatcggtacctgtgcgttggcgtaggcgtagatcaccttggcgccgcggcggatgatgccggcgtgttcctggtcggagccgggcttgtagccgggcacatccacgagggtgaccacgggcaggttgaacgcgtcgcacaggcgtacgaatcgggcgactttctcggacgagtcgacgtccaggatgccggcgagcacgttcggctggttcgccacgatgccaaccggcttgccgtcgatgcaggcgaagccgacgagcgcggaggcgccgaacagttcctgcacctgcacgaattcgccgtaatcgacgatgcaacgaatcacttcgagcatgtcgtaaggctgacgttcgttggtgggcacgatggtggcaagtcgcttggcggtctcgcgttcggcgcgggtgacggcgtatgcgtagaccggcggcttgctttcgctgttggacggcaggtaggcgagcacggtgcgcgcatagtcgatggcgtcggattcgtcctcgccgaggtagtgggccacgccggacacccggttgtgcacttcgccgccgccgaggtcggccatggagatggtctcgccggtcgaggccttgaccacgtccggtccggtgacgaacatgttcgagttctcacgggtcatgatgatgaggtccgtcagggccgggcagtagacggcaccgccggcgcaggggccgagaatcaggctcagttggggcacgaagccgctggcctcgcaagtcttgcggaagatgcgaccgtactgggtcagggcggccacgccctcctggatgcgggcgccgccggagtccacgatggccacgatcggcactttgaggtcgatggccatgtccatcagtcggcagatcttctcgccttcggcggtgccgagggtgccgcccttgacggagaagtcctgggcgtagacggccactttgcggccgtagacctggccgaagccggtgatgacggccgcaccggcgttgccgccggcgatattgccgccctggaagcggccgatctcctcgaacgtgccggtgtcgaagagcaggtcgaggcgttcgcgcgcggttttcttgcctttggcgtgctgcttgtcgcgggcgcgctcttcggcggcgcgggccagttcggcggccttgaccacagcggtgcgcagcggctggtgggccgaaggctgggcggcgttggcggccgaggccgccgccgcggccttcacggcctgcgaatccatgatgtcagtcattgccaccctccttcttggcgtcggtggccttatcggctccttctgacgagggagctgtcgacgcagccgcctgagggagagatcccggcgcagccgcagcagccttggccttgccggcgttcacgtccagcgtgaccagcgtgtcgccggcctccacgccgtcggccgggccaacgaaaatcttcttcacttcgccggcggccggcgcgtacacgtagttctccatcttcatggattcgagcaccaccagaaggtcgcccttggccacttgctggccttcggacacgttgatgcgcgtgaccacggcctgcatcggggaggcgatgacgccggatttggcgccgtcgttggccgcagcggcactggaggccacgttgtgcagtcccgcaccgcgcaacggctgggtgggtcgcttggcaccgcgggcgcgggccgagccggtgatgttctccacgatgtcgagtggcacggtgagcttgacgcggcggttgttcatctcgatgacgaacgtctccgacttggacttgtcgggcgcggccggggcagcggcacccggggcggcggccaaggaggccggctggccggaggcggcggaagccggtgtgcggttcaggtacgtgcgctccagccacttggtggacacagcgaacgggtggccatgctcggcggtgaagtcgtcgttgcggaagatttccttgaacagcggaatcggcgtgggcacgccttcgatcacaagctcatcgagcacgcggcgcacacgggccacggcgtcgagacggttctgggcggtgacgatgaccttgcccatcatcgaatcgaacttcggggagatggtgtcgccctgttccacaccggtatcgatgcgcacgccggggccggccggccactggatcttctccaaggtgccggagccgggggtcaggttggtggccgggtcttcgctggtgatgcgcagttcgaagctgtggccgcgcagttcgggggcgcgggtgagctcgccaccggcggcgatattgagctgttcgcgcaccaggtcgaggccgctgacctcttcggagacggtgtgctccacctgcaagcgcgggttgacttccaggaagtacaccttgccgttcggggtcaccatgaattcgcaggtgcccaggcccacgtagccgaccgtggtgaacaggcggcgggagtattcctcgagcgtgctgatgatttcctcggacaggaagggcgcgggtgcctcttccacgagtttctggttgcggcgctgcagcgagcagtcacgggtggagtacacggtgaagttgccgtgcgagtcgcgcccggactgggtctcgacgtggcgtgccttgtccacgaacttctcgatgaagtattccttcagatcgccgccttgcagcgcgtcgtggttcatgtagaagcggcgcagctcctcgtcgtcatgcaccacggtgatgccgtggccgccaccgccatcagtgcgcttcatcatgatcgggtagccgtgggtgtgtgcgaagtcgagcagcgtgcgcacgtcggtcaccggttcggacaggccgggcactggcggcactttggcgcgtagggccacgcggcgggcggtaatcttgtcgcccaaatccaccagcgcggtgtggtgcgggcccacccagatggcaccggcatcctcgaccttctgcgcgaagctcggcacttcggaaaggaatccgtagccggggtgcacggcattcgcaccggtcttgtgcaggatgtcaatcagcagatcttcgttgaggtacgtgtccttgtaggtgtcgccggagagcaggtatgcctcgtcggccatgtccacatagcggctattgcggtcctgttcggagtagacggccacggtggagatacccatctccttggccgtgcgcaccacgcgaagcgcaatctcgcctcggttcgcaatcagcagttttttgacgatagaagccatagtgtcaaattgtgctctctatatagaggagagggcaagccgcgttcacacaaaagctttcacgcccttttgtaggctacgaacaaacgcgcgcgtaggttccggcaacgcaaccgttggcgccggctatcaaaaacgttgcaaatccgccgattgcacatccttgcgcgccgactcaagaaattgacgttacggttgtgttcgtcaacttatgacaaatcgaaatcgacaattttgtaaattggtacgaaaccgcacgaaatcgaacacctctacgatggcaaccgtaagttcgggggaaggctcatctgcgggcgaacggaaggtgaccggaccggcatcggtccatcgccgcacgattcgcccgcacagggtcggattcatttgggaccgtccaccatatggacggttcggactgtcggggataccgcacgacccgccggaacctcccctcatccatcgcataccgcccgccgttcacggcgatatcacgcaacataggggtcattgatatgcagacttcacacaccaccgcatccgctgcggccaccacatcgctcgcccgtcgtatcgtcgccgcatcctggaagccggtgctgttcgccgtgctgatgtggctgtccgcggccgccggcgagattccgattccgggcacgccggtgccgatcacgctgcaaacgttcgtggtgatgctcgccggtcttatgctgccgtggcgtcaggccggtgccgccgtcgccacctatctggcggccggtgcggtcggcctgccggtgtttgccggcggcacctccacgctggccctggtcggcccgagcgccggcttcctcttcggcttcctgccgggtgtggtggccatcgccctgctgcgcggcaagtccgacacttcgtccttcgcggccgccgcgcgcaccgcgggccgctacctgctggccgcgctggtcggcggcgtcgtggtggtgtacgccttcggcttcgtcatccagtccgcgctgaccggtgcgccgctcgccgccgtggccctggcctccatgggcttcgtagttggcgacgccatcaaggccgtggtggcctctctggccgccgccggcctgtccaagctcggtcgctgacctgagctactagctagctactggccggctattacagcactcccacatcggcggtgcggaccgtatggtccgtgccgtcttgtgttctcaggatcagtgaggcgtcttcgttgaggccgatggcttcgccggtcagcgtggtgccgtccgtgaagtgcgcctcgacctgacggccgcgcgcccagcacaccgccttcacctcctcgcgcaacgactcggcctggcccttcgggtcggcgatgaacttcaccaaccgctcgcggaagccctcgacctgacgttcggccaccgcatcgcgcatctcgccgaacgacggcagcccggagacatgcagctgcagcgaggtcgattgcggcgtgggcagccgacaggcgcccaaggccaggttcaggccgacgccgaacacgatgacgacgtcgtcatcggcatcagcatcagtaccggtaccggacgacggcggaatcaccagttccgagagcagcccgcccagcttgagcccgtggcagaacacgtcgttcggccatttgagttccagcgagcagtccggctggttcggcgcggcaccgtattcctcgatcatgccgttcagggcgtccagcgtgaccagtccggcgatcatctgcagccagccattgacggattcgtcggtggcgatcgcgcgcggaatgcgcacggcataggacatcgtcgagcaacggccgggctgactgacccacttgtgaccattgcgcccacggccggcggtctgccggtcggcggccaccacggccaccgccagttcgccatcctggtggtcgggcaacgtcaacgacccgtcgccaatcatctgtacggccagcgcgttggtcgaatcggtttcgtccacggcgaccacatgatctgcgacggctgtagttctgggtagctgcggcgttgcagctttcaacgcaatcatcatgggcactacgttacctcgattttggcgcgatatgcccgcgttattccatggaaaagcgcgcaaaatcaactattttcacccacatagcccatgttaacgttcacaacttcggaaattccgcattcgccgaccccacgcatgcacccggccgtcatattggcttgcgaacaatggcgatgcccggcagacatcgaatatcaaccgttgacctgtgcggctaccatatattgtcatgacgtcaccagccaccgcgaagcttgccgccgtatccagccgccagtcccacccgcatcttgcgcgcgcgggcgctgccgcgcgctggacactggccgtgctggccggcctgtggcttgcactgtgcacggcggtcggcccgctgtactgggacgaggagaacggcaccctcgcccattggaactgggccaataccgcaatattcgtcgtgtcattcctgatatatctcggaatcatcacgctgatggtgcgattcgcagcaggccagcgcatactgccgagggctatcggcgagcgactacgtcaacatcagcggaatagcgaaacatcacggcccgccgccgatcagcaggccagccaaccagccaagacccgtcgtaccgttcgcgctatcgtcacgtccaccgtcactgttctggaccgctggatcacacgcggcacgaaccggttctggaagcttatgctggtgttttttgtcggctggctctgggtgccgaccactctgctggccgcattcggtgcggacctccgctcacagatccgtgaattcagctgggcctggaaccagtggaccggcctgaaacagccctatatcggcttcttctccttcgtgccgatggacatctaccccactgcgcactacatgtggccgtccgatcccacgtatctgaccgaccagcacaatgtggtactcactgtgttctatggcgcgatggtcacgtttgcgaggcatctgaccggctcaaacgatgccggtatcgtgacgttggctgccctgcagacgctgttcgccgtgttctgctgcgctgccgccgccaatcgattcctgaaccggccttggataggaaaaacggcaacggattccgccgctcccccacaggccggaggattggctcgattcctgattctgctgttctttatggtctgcccgctggccgtgttttccactatctccatcaccaaatcgccgctgttcgcgttctcgttcgtctggtggttcagcgtctggtatgaactcgtccagacctggcaccccgccggcacccgcaaacatcctcagacctctgccatcgccacgcccgtccacttgccgcgtcacagtttcatcgcctttatcctggccacgtcggtaatgctgatttccgcgaaatatgcgtggtacatcatcgccctacaaatcgtgctggctctgatcgccgaccgcaagcgctgggcgacttacgtcgtggcgctgctcatccccaccgtactgattcacggcggcatctccttcgccatctcctctggcgcgatcatcggcggcgacccaatcgaaagccgcggcgtacagctgcaaatgatcgcccgcgtggcccagcgcaatccggacggcatttcagacgaagccaaaaagaacctcgcgcccgtcttcaatctcgatcagatggccgacgcttactcccagcaggacgccgacccggtgaaatcctccggcattcaggccaagaaggtcagctacaagtggcgcacggtgacgcccgaggatatgaccaatttcaacaaggcatggttcgaaatcgtcaaggacaatccaatcatcgcgctggatgcgttgctggccaaatgcttcggatacttcaatgtgaacgatcagccgtacgtatcgatggattattacgtgaccagcgattacgtgcagaaaaactccacatggatcaaggattacaaccatgactggcgtgagcacatcgccggcttcactcgcgtatggggcggtattcccgtactcggctggcctacgcacggcaatttctacgtggtgatgacattgctgatcggcgcggccgaggtgattcgccgacgttggctcaccctcatgacccatattccgctgctactgctgatgggcgtgatgatcaccgcgccggccaataatttcgagcggcacatgttgccggttgcgtttgtattcggattcgtggtgctgacgtattggcgagagtctttggctgaaaggcaacgccaatcagcgacgctacactagtgactatgtcagattttctcgaacttcttgctgccgacgttgccgattcgtccgcacccggcatcgccgcgaccaaccgcgtacgcaccgtgctgttcgagtgcctgttcaatcatctggccgacgaacgagtggagtccctgttcaccatcctcggcttcgagcatgacttcgattgttacgccatcgccggataccctgcccggtccgccgcacgtacggccaaggaaatcgagaaaatcgtagccgatttcggcggtgtgtgtctgaccgccaagcgcccgatcggcaacagcaccgccgtagtggcgttgattcgtccggtcggtgcggccacgccggaaatcatctgcaataccatcgacccgtcgttcgccgccgatcggccaatcgccttgggtccgcagcgtaccggtgccgatggcgcgatgcgttcgattcaggccacgctttactgtcttcaggccgcgccggctctggccgccaccgtgcagccatcgccgcgcccgttacgcaccgacgacgccctgcccgaacgtgcgttgatcggcgacgcggacgcccgtgacgaactggtccgcgtggtctacggaagcctgacagcagcaggcccggatgatccgacgctgctcaccgtctccacattcctgaagttcggcggttcgctcgagaccacggccaaggagctcaacgtacatcccaatacgatccgctaccgtttgaagcgcgccgccgaatccaccggctgggatgccaccgacccgcgcgaggcgtacgtgctgatcaccgccatcgcgctgggtcgtgtggccgaagcgcagcggaccgcagcgtagtcgggcagaagcataaccagcagaaccgtagccggcaaaggccatagctgaccgggcataaccgtccagcccgacagcctagcgggccgaatcaggctgcctgaatctcgtgtacgccatcgtgcagtaacgcggccaaggattcttgagtggctaacacttcgtccacgaatccaccggcggacaggctggcgatcacgcgaccggactcgttgtccacaatcggtacaccaacggcaccgacacccaacgtcacatcctcatccgacagtgcatatccacgttcgcgagtcaagcgaatatcctcgcgcaactgttccacactgaccagcgtgttctcgttatatgccgggaacggcgctcctgcaagatagcgttcggcatcggcatcctcgaaatacgccaaggccacgcggccggccgcgccagcatgcagaggcagcacgcggcccgggcgcaggatcagcgaatcgatggcatgaccttgcgcgcattccacgcataccaattcagtgccggagaccacactgaggaatgaggtcatgccggtttgcgcggtgatggcatgcatgaccgcaatcgcaggctgccattcggtacgagacgtgcgagcggcatcagccaatcgcagccagtccagtgataatgagtagttgccatccgtatccgttacggcccaccccacatcgaccagtccatccagcacgcggtatacggaggatcgcgggatatcacaggcgtcggcgatatctgccggagacaggccattctccgccgccaatgcgtccatcacacgactcgccttgtctaaagcgcgggtcggttcacgtttgtcttccgccatcgccgacgttccttccccccctgacttatccctgactcatcgtattcaactgttcaggccaagataatcaccactgtatccaaggcctcgcgacacctcgcggccggcagtctgcaccaattgcaccatgtcttgagccgatgccgttgccggtttcccatctaccagacaggccagctcaggttccaaggagcgggaaaggctactcagggcgattgccgcttgaatctctccggcgtgattgaataccggtacgctgatagtcacggagccggccatggtctggccgacgtcataggtgaagccgcattcgcgtatatgacgagcctgtcccattgctgtggcacgcatcgtggagaatgtgccgccgagctcgttgttataggcatagtgttccaacagctgctcgtagcgagccgggggaagccaggccgtcagtacatgagagggagcgctcatgctcagaggcaagctattgcccaccagctgtgcatagctttgcaatgcctcacgggtgcgtgtctcgatgcacaccgtgcgcaatcgcctccgaacgaacagaccccagatgccgaactggccgcgatgggcgcggaaggtacggcgagcgatctgctgaatgtccagtctgctttcgatttggccgccgatacgtacgcaatcgatgccaagccgatactcgccacgattgatgccgcgttccgcccaaccgactgcggcgagattatccagcaaacgatacgttgagcttacgggttcaccagtacgttcgcttatggtttttgcggtgcttggccccagttccgccaatacatcaagtactgccttggatttcaccaatgcatctacgcttcggtcatcacggcttgacgccaccatgcgcgtcacctcctgacctgtttgttgatacctcagccatcttaccgggtattcagcgggttgccgcccaaaacgtactgggccccggcaggagtatcccgtcggggcccaagaggtttctggctcccctctttgagggggagccgtccgcgcggcggaccggggggcccgggcgtcgggctcccacggttgtatttcgtcaagtcggtgtttcgtgtttagtcatgtatttttttcgggtttagattgactataaagaagtagtacaaacacgctcttgagttctcaaaccaccaccacaccagccagacaggaaaccaaccagaggaaggaacccgccgcgctgagcggcaacaggtgaataacttacacgcatgtccggattcacgcaaatcaaggcacgcaaaaacccaaggaatcgttgcaatcacacggttccctcggcgtgtcgcaaacagcctatttgcgctgttctgatatcagaataatccgttttgcattgccgatgcgtaacaaattcatgtgttcaacggcgtgtcgcaagaattcgattgcgtgaccatccaggttcaccttctcgcaaccggtcatcgcatatgcaaaaagggacttccctttacgggaagtccctttcagtagctattgaagctcgctagcctcaggccagggtgttcgggtcaaccggaacgcccgggttcatcgtggaggtgatggttgccttggtcaggtaacggcccttcacggtggacggcttcagacgcttgacttcgtcggccacagccttgaagttctcgtccagagcggactcatcgaagctcatcttgccgatgaggaagctcaggttgccgttcttgtcgacacggaactcgatcttgccgcccttgatgtccttgacagccttggtgacatccatggtcacggtgccggtcttggggttcggcatcaggccacgcggaccgagcacacggcccagacggccgaccttgcccatcatgtccggagtagcaaccacggcgtcgaagtcgaggaagccgccctgaacctttgcaatcaggtcgtcatcaccgacgatgtcggcgccagcctcggtagcctcggtagccttcgggccacgggcgaacacgaggaccttggcggtcttaccagtgccgtgaggcaggttgacggtaccacgcacgagctggtcggccttacgcgggtcaacgctcagacggaacacagcctcgacggtctggtcgaagttgtaggagggcatgctcttgagcagagcgatggcctcgttggcggtgtagaggttgttgcgatcgacgcgctcagcggcttcgcggtacttcttggaacgctttaccatctgtccttctccttatcagtccgtaaccgtgatgcccatcgagcgagcggtgccctcgatgatcttcatgccggcctcgatatcgcgagcagacagatcttccatcttgatctcggcgatttcgcgaacctgcgccttggtgacagagccgaccttgtgggtcagcgggttctcggtgcccttctcaacgccagcggccttcttcagcagagctgcagccggcggggtcttgagcacgaaggtgaaggaacgatcttcgtaaacggtgatctcgacagggatgacctgacccatcttgtcctgcgtctgggcattgtatgccttgcagaagtccatgatgttcacgccatgcgaacccagagccgggcccagcggcggggccgggttggccttgccagcctggatctggagcttgatcagcgccgagactttcttcttgggagccatattatggttcttctttctataacgcggttcgaatggtcgccgtcctcaggttcggctgtctgccatcatgctcggtcttgactcattatttatccgtgcatgctgcaggcaatcggcctgtggtcggtctcctcccgcaacttatattgctgtgctgtgctagcgagtctcctctccagacacaagctttcctattatgcaaatccacccggacaacacaaaaagcccgaccacgatggtcgggctctgcaaagtttgggagttaatctagcttctgaacctggtggaagccaagctccaccggcgtatcacggccgaagatggacacgagcacggtgagcttctgagtggtgggctccacgtcggaaacaacggcggccatggtggcgaaaggcccatcggtgacggtgacctgatcgccaacggcgtaggagacctcgaccctgcgcttcttggcggcggcgggcttgtcgccggcggccttgagtgcctcggaagcaatcatcggagccatcatcgccacgacttccttgcgggagagcggcgccggatccttggtcgggccaacgaagccggtcacgccttcggtctcacgaacgatacggcgggcgttctcatccggccacatacgaatcagcacgtagccaggaacacgcacgcgggtgatgaccttcttgcccttctcggtgtgcttctcgacttcttccatcggcacctcgacctggaagatctggtcttccatgccgaaggaggcgacgcgggactcgatgttggtcttcacgcgcttctcgtagccggagtaggtgtgcagcacgtaccacttgccatcaagggaacgcagggacttggagaattcgtcaacggcctgctgaccggcatcggtctcctcggcctgctcggattcgttgacttcttcctcgtcctcatccagagaaacggtctcggtctgagtggaagcaacgggagcggattcagtcgccgccggagcgtcggactcaacatctgcattgtcgacggatgcgtcagattctgcggaaaggtcagcgaccggttcgaccggggcagctgcctcatcggcagcagcttcggaagcctcgacaacaggctcctcagccgggacggcgtcgaggttctcgagattcagttcatcactcatgcgttgttattcaccttaggttgtgcggatcagccgaacacccacagcgtggccttgcctagaccgaagtccatgccagtcacgagggccatcagcagcagcacgaagatgaatacggccagagaccagaagaacagttccttggcggtaggggtcacgaccttgcgaagctcgtcgatgatctgcttgatgaacagaccgatacgcatgaagacattcggcttgactgccttttcactcttgctcgtcttagccattccgtacctcgcgtcagctgcttgattattagaaacttggcagggaaggcgggactcgaacccacaacctacggttttggagaccgttgcgctaccaattgcgccacttccctaggtgaaaatccacctcggcatgcgttccgtagagaacgcttcgccacggcgaaaccgccaagtcgttatagtaacggctccggtggattatcgcaaatcgcgtgtcgcgcgcgtggcacgcgactcttctcagttagcccattccttgaatcgacgcatgccttcggctaggtcttcgtcagccagtgcgtaggagaaacgcaggtaaccgggagcaccaaaggcctcgccggggacggcggccacgtgggcctcatccaacagtgcggcggcaaagtcagcggacgtatcggacactgtgcccttgggacccagcggcttgccaagcaaagcggtgatgtccgcaaaagcgtagaacgcgccggtcggagtcgggcagttgacgccctcgatatcgttcaaggcggtcacaatcgcacggcggcgcgcgtcgaaggccttacgcatctcgtgcacctcatccagcgggccggccacagcagccaaagcagcacgctgggagatgttggccacattggaggtcatatgaccctgcagcttggcggcggccttggccacctcaagcggagcgaccatccagccgacacgccagcccggcatcgcataggtcttggccacgccgttcagcaccagcaactgcccgcggcattccggcacggcggcaccgatgtaggtggtgtgcgcatcgtcatagttcaggtgctcgtagatctcgtcggagataacccaaatgtggtgctcgacggcccaacgaccgatcgcttccacggtttccggcttccagacggctccggtcgggttgttcggggagttgacgatgattgccttcgtatgctcggtacgggccgcttccagcgcctcaagcgagggctcgaagttcacgtcggcaccggcgaatacttcgaccggcacaccaccggcaagcttcacagcctcggggtagctggtccagtacggagcgggaatgatgacctcatcgccatcgttgagcaagatctggaaggattcatacacggcctgcttgccgccgttggtcaccacgacctgatcggcattgacctcatagccggaatcgcgcagcatcttagccgcaatcgcttcgcgcagctcgggcaggcccggcgtaggcgtgtacttgtaattcttcgggtcaaggcaggcatctgccgcagccttgaccacgtttgcgggggtcgggaaattcggttcacctgcgccgaagccgacaacgtcaagtccggcggccttcatggccttggccttggaatcgacggcgagcgtagcgctcggtgccacagtgttgatacggtcggaaagagtctgccattgcgccatagtcatggctcccatgctaaacctacagcacgaaaaatcgccagagccgcactatggtgatggaatctgtcgtgtgacagattccatcagtcacacgagcacgagattgtcgcgatgaaccagtgggtgggcgtactgggggccgaggaaacgcttgagttgggcggtgttacgcccgagcatctgcggaatttcttcggaatcgaagccggcgaggcctcgggccaggtgttcaccgctttcggcatcgatccagaccggatcgccggcggaaaaatcgccatgtacttcgagcgcgccggccgccagcagcgaggcacgcccgccgcgaatcgcctggccggcacccgcatcgaccacaatcgtgccgcgcgggtcggcggcgaagccgatccacagacggcgtgaggagccgcgggccttaaccggtgcgaacacggtgcccaccggatcgcccatcatcgcagggcccgcgttcgaggcgcaggtgagtaccgtggggatgcccgagacggccgccacgcgcgcggcctcgagtttggtgaccatgccgccggtgccgaccttggagccggagccggagacttggatgtcgcccagcgcatcaatcacgttgggcacatattccacacggcgggagccgggctgcgagggcggcgcagtgtacagcgcgtccacgtcggtcagtagcaccaaggcttcggcccgcaccaggttggccaccaacgcggagagtcgatcgttgtcgccgaagcgaatctcgttcgaggccaacgaatcgttttcgttgatgatcggcaccacgccgaggtcaagcagacggtccagcgtgcgttccacattgcggtactgggtggcacgaatcgtatcttcggcagtgatcagaatctggccgacgcgaataccgaatcgaccgaacgcagtctcgtagcgggccatcagtagcccttggccgacggctgcggtggcctgctgagtggccacgtccaccggccgcgagtcaaagcccagaggcccgaaaccggcggcgatagcaccggacgagaccagcaccacacgtccgcccatcaatcggacctgagccaaggccgcggccaacgcgtcgagcttgtccgggtcgaggtgaccgctcggctgggtcagcgagctggagccgactttcacgacaatggttccggctgcggcgatcatgcgccgcacctcggcctgactcggagtgctcatttattcctcggtttcaccatcttcgctggactcaccgtggccgaacaggctggtttcgtcatggcgatcgtcgtcaacggtcgggtcggcccagtggccggccttgcgttcggccatcatcgcgtcgcgcacggcggcacgggcgtccatcatctcgtggtattgggcacgacgttcggcgttggagcggcggtgcgtgcgcgggtccagctcttcgagacgcagatccttgcctcgggcaccgaggttggagccgtcgagcatttcggcaccagcggagatggtcggatcccaatcgaattcgaccatacgggcaccacgaccgatgcgcacttcgtcgccggggtgagcacccttgcggcgcagctcgtcctccacgcccagcttggccaagcggtcagccaggtagcccacggcctcgtcgttgtcgaagttggtctgcatgacccagcgctccggcttgacgccacgcacctcgaagaacacttcgccattgccgagttcgcggcgctcgaccgtgaactcaagcgcactgccgccctcgtcagcacgacgcggacggcggcccttggtctccaatggcttgatgaccacgcgagcctcctcttcggcctgctcgcggttggccacttcctcacgcatctcgtgcaccagcgcagacaacgcgaagttgagctcctttagaccctcgtgcgaggcagtggagatctcaaagaccttcagcccgagtttctcgaactccggacgcacgaactcagccaattccttggcctcgggcacatcgatcttgttcagaatcacgatgcgcgggcgttcgggaatcgggatggcacccaacggcagctcgagcttgtcggcgtagagcgccaactcgttttccagcgcgtggtagtcggacatcgggtcgcggtccggttcaagcgtggcgcaatcgatcacatgggcgatgatttcggtacgttcgatgtggcgcaggaactccagtcccaggcccttgccttcggaggcgcccggaatcaggcccggcacgtcggcgatggtgtatcgagagtcgccggcgataacgacgccgagattcggcaccagcgtggtgaacgggtagtcggcgatcttcggcttggcggaactcatcgccgcaatcagggacgactttccggccgaggggaaaccgaccaacgccacgtcggcgatggacttcaattccaaaatcacgtcgcgctcttcaccgagttcgccgagcagggcgaagccgggggcgcggcgggtcttgttagccagggcgatgttgccgaggccgccggcaccgccttgggcgacgacgcagcggtcgccctcgtggcgcaggtcggcgagctgcgcgccgggatgcttggctttgccctgttcgccgcgcgcctcaaagacgacggtgccgcagggcacgggcagaatcaggtcctcgcccttggagccgtccttattgtcgcccaaacccatggtgccgctgccggcgacacgatgcggcatgaaacgatagtcgagcaggctggtggcgttacggtcggccacgaacaccacggaaccaccgtcgccgccattgcccccgttcgggccggccaacggcttgtatttctcacgacggatgccggccgaaccgttgcccccatcgccgcccttgacatggacggttactcgatccacaaaatcactcatattgattaccttacaaaaaagccgcgtccttacgggcgcggcttgaaaaaagcttgacgctatatcgctcaggcgatgacatcgacaaccttgcggtcgcgacgcacaccgaacttcacggagccatcggtgagggcgaacagcgtgtgatccttgcccatgccgacgttgtggcccgggtggaagttggtgccacgctggcgaacgatgatgttgccggccacgacggcttcgccgccgaacttcttcacgccgaggtattgcgggttagaatcgcgaccgttgcgagagctggacgcacccttcttatgtgccatgattcatggtcctttctataactcaggcaatcgccgtgatcttgacgatagtcagcttctggcgatgacccttacggcgagcaacaccagtcttgttcttgtacttctggatgctaatcttcgggcccttggcttcgtcgttcacaacctcagccttgacggacaccttggccagatcggcggcggcaagggtgaccttgtcaccatcgacaacgagggagaccgggaattccacggtatcgcccttcttagcgtcgagacggttcacgaggatgacgtcgccaacctcgaccttttcctgatggccaccggccttcacaatcgcgtacattatcgttccttttatgttttggaaagctaccttgcctaacacgcaccgagcttgcggtcagacaccgagtttcgaatctacaccaccatgcggactaaatcaaatgatttttgcccgcgtgtcaagcacgacacacctgttactcttccgccgtgttgttggcagcgacggcagcggcggcaatctgagccagtttggctttgacgtcggcgctggaaccagccggttcgggagcgggagcggtgccgcgaccgtgcttgttggttttgacgaacgggtcgccaccgcgaagcgcgtagggatcgtcgtagtcggccgaaacggtcggctgatcatgcaggatgaaaccacggcccttgcaggtcgggcattcctcggagaacgcctcgaccagaccctggccgatgcgcttgcgggtcatctgcaccaaaccgagcgaggtgacttcggccacctgatgcttggtgcggtcgcgtgccaagcattcgaccaagcggcgcagcaccagatcgcggttggcgggcatgaccatatccacatagtcgatcatcaccatgccaccgatatcgcgcaggcgcagctggcgggcgatctcttcagacgcctccaggttgcaacgcgtcaccgtttcttccaaggacttgcccttgccgataaagcggccggtgttcacgtcaatggtggtcatggcttcggtgcgatcgatgacaatcgagccgccggacggcaggtagacctgacgctccatgcccttacgcagctgggagtcgatggaccacttgtcgaacacgtccttgccttcatgctcggccgggtcccacttctccagcttgtccttcaagtcgggggccatggtgtcaaggtattcctcgatacggtcgtagaccttgtcaccttccacgatgagcttgctgaagtcgtcgttgaagatgtcgcgcaccacgcggatggccacgtcgggctcgccctgcaggagcttcgggcgcttgccgtgccagaattcctcgcgcttggcgttgatgcgctcccactggcggaccagtgattcgagatccttgacgatggcgtcttcggatgcgccctcggctgcggtacggatgatcacgcccatgtctttcggggcgatcttggagacgatgttcttcagacggctgcgttcgcgctccgaaagcttgcggctcacgccggtcatgccgccggatggcacgagcaccaggaagcggccggcgagcgtgacctgagaggtcaggcgggcacccttgtggccgatcgggtccttagtgacctgcacgagcaccgggtcgccggacttgaacgccagctcgatgcggcgcggctggccttcgagacgagcggcatcccagttgacctcgccggcgtagagcacgccgttgcgggcctggccgatgtccacaaatgcggcctccatgctgggcagcacgttctgcacgcggccaaggtagatgttgccgacggtctgtacttcctgaatgtcggagacgtaatgctcgaccagaacattgtcttccaccacggaaatctgggtgtgatgttccttctcacgcaccaccatcaggcggtccacgttctcgcggcgtgcgaggaagtcctgttccatgagctggctctggcggctgcgctcacggcggttgtcacggcggcgctgcttcttggcctcgagacgagtggagccttccacatcagtgatctcgtcgatgtactgctgcttgcgggagcgtcggaccagcggctgttcgctgttctgactctggtcgtcggtgccctcgccgttcttgccgccacgacggcggcggcgacggcgagtgacggtctgctcctcatcgtcctcatcgcgatcacggtcatgatcatcgcgatcgtcacgacggcgggaacgcgtatcttcggcatcgttctcggcggtatcgtgctcgccgttggcaccggtttcgccgcgtgagccgcgacggcggcgacggcgcgaacgggtgcgggtggcgtcggattcttcgtcgccctcctcttcggcaatcggcgagtaggcgatatcgtccagctcgaggtcttcctcaatctgctcgacttcggcggctgcacggcgctcctgggcgttcaggcggcgggagcgacgggaacggcgggagtccgaggtgtcgtcggcgtcgaaatcgtcgtgatcggcgttggtatcgccggacgcggcgtcacgggaagcgtcacggtcggcggaggcgcggccgcgatcgtcgcggcgacggctgcgcggctgggcatcgtcatcgtcgtggctgcgcgagcggcgggagcgacgagacgggcgttcgtcggcgtcaacatcgtcatcacgagtgtcagcggtatcgtgcgcatccacggcggcgggcagtaccggttcctggaagagcagggacgtcatcggcttgccgcgacgcacggcctcgtggccagagggcagggattcgaccgcgtcgaacaggcgctcatccggggtgtcctcgtgcgtatccgcaactgcacggcgagaacgacggcgaaccggccgatcctcgtcatcatcatccatatccatagacgcacggcgagagcgggagcgaaccggccgatcctcgtagtcatcatcgtcggactggcgggagcgagagcggcggcgaaccgggcggtcctcgtcgtaatcgtcatcgtccacaaccgaacggcggcgggaacgtggggcgtcatcgtcatcgaaatcatcggcactgacagtgcggcgcgaacgatgaggacgatcatcctcgctatccgagtcggccactgcggaagcggcgcggcgcgaacggcggcgggttggacgttcggcggaatcctgggaatcgctggattcatcggaatcgctggaatcggctgacttggaatcggccgcagtgccggcatcgggaagcgcgggggcttcgaacagcggggcgcgttcctgcacttgcagttccagagaagcgccggcagcaccggtgccgcggaccacgcggcggccgccacgacgacggcgaacaggttcggcgggctgggaggcggcggcaggcgcagcgttcacggctgcagccgaatcggcattggatacggttgaattatcggttccgtcgttgacgaaaccttcacggttgtcagtgggcacaatgctcctcgcggcgcgctgcatcacgacgcctatttccaggcctatacgcttgtctcacaccacgctctcaccgtggccgcacgaaaacgcgccgcgtaaaggcaacttcgtctcaagtctgtcctgcgggtggcggacaccggcgcttgcgttgtctcattctcaagagccgcaaggggatcgacgccatctcgcacgctgatggttatgcagaaccaccatcctttagtatgccacatattttgtgcgggcgtggcccggcgaggctgacgttctctcggctcccctcccccgcggtgacagctcccctcagggaggggagctagagaggtgtcagaccagccagtcggtaaggattgcggccatggcggtcaggtcggattcaggcacctgctcgtcgtgcttgtgagccagcagcggatcgccggcaccgaggttgacggccgggataccgagctgagagaagcgtgccacgtcggtccagccgagcttggccagcgggtcgcggccagtgcgctccttaaccagtcggaccagatcctgggcgagcggggcgttcaggcccgggcgcgcggaggggctttcgtccttcatttcgatgccgtagccctcgaacacgccgccggtagccacatgctcgccattgccgagttcggcaccggcgtccgcgcccatcatcagagccttggcctcggccaacgacttgtccggggcgaagcggtagttgacgtgtacgcggcattcatccggaatgacgttcgtgcctttgccgccggagatcagcgtggcgttgaggccctcgcgataatcgagcccgtccacgttcacggtggccggctcgtaggcgttgagtcggttcagaatgtcggccgccttgtggatggcgttctcccccatccatgcacgggcggagtgcgcggccacgccgtgggttacgacgtcgaagcgaatcgtaccgttgcaaccgccctcgatgccgctgttggtgggctcgccgatgatggcgaaatcgccggtgatccaatcgggatgggcctcgacgactttgcgtaggccattcttttcggcgacgacttcctcatggtcgtagaagacgtaggtgaggtcgactttcggggtggtttccggcgtgcggccgtcgagcgtggcggcgaggtagagcatcaccgcgtcggaggccttcatatcggtggcaccgcggccccacagcacgcggtcttcgggatgagcgtgggcgatttcttcgcgaatcagcgaagcgccgggctccagccactttggtgggaaattgtcgatgaccggcacagtatcgaggtgcccggccaagatcacacggctcggcttgccgaagtcggtgctggccaccactgtgtcgccgtgacggcggacggtcaggtgctcttgctcgttaaggaaggcctcgacctcgtcggtgagggggccctcgtggtcggacacggagaagttctccatgatctgggtgagcaggctgttcagctgctcggcagtggatgcggtgcggttcaattcaagcgtcatgtgaacagcgtaccgcgtgggcggcgggcccagcacactcactacatgagattttgcggccgaatacatttttatgtgccacactggggtggcgaaagggaggattatgccaggtctaatcagcgccatgcaaggcttctgcgttatcggcatcgtaatcgcggtgggatatgttgccgcacgaatgcgaatcggcgggccgtccgctcagatggtgctcaaccggttctccttcttcgtatcgagcccgtgcctgatgttcgcgattctctccaaggagccgattttcgacatcttccacccctcgattatcgtggcgttcttctccgccgtgctggtaggcgtggtgtttttggtgctcaaccgtatgttcttccacctgaatgccccggacgccaccatcggtgccctgaattcgctgtacctcaattccaataacatcggcctgccaatcgccacctacattctgggcaatccggctcttgtggcaccgattctggtcatgcagcaggccatcttcacaccggtgggcctgacagtgctggacgtgaccaccaagggcaaggtctccatcaaggaaatcgccaagcagccactgcatcagccgctgcttatcggctcgctgctgggcattgtggtctctgcgatttccgctaaaagcggctggttcccagtgccgaaattcattttcgacccgatcgacatgatcggcgattcggctgtgccaatgatcctgatggcgttcggcatgtccctgcacggcaccaagccgctacagcagaagggcgatcgcccggccatcttcacggtcgcggtcctcaagaacatcatcatgccaattatcgcgttcctgctcgcctacttcgtgatgggcttccgcggctccgagctgtacgcctgcgtggtactcgccgctctgcccaccggccagaacgtatacaactacgcggcccgctacaacgtgggtctcaccttcgcgcgcgacggcattctgatgagcaccatgaccagcccggtgtttatcgcgatcatcgcggcgctgctgtcgtgatgggtgcgcagagaagcgttctcaatagtatccgtgcgcgcaaatgcacagatatcgcacaaacgaacatttgctcatccgcatatttgcggtgatttcagcgtttctacgttcgatttgcgtatacgaaagtacgcacagttgttattgagaacgattcgctgcgcagctcggctcagtcatcagcccgataatcggtcagattcaagctggccgccacatgattggacgcgaacgcgccgatggaaaccagcgcatagcacaacacaagcccgccgaagaagctggccagcgtggccggttcggtcatcgaagcggcgaacagaggggccataagcagcatggaacagccgccggccacgatcaccacgatgttgagcggggtgagtacctcgatgaatcgcgcacggttcaaggtcttgacatcagtgccctccaacaccagcatgcgatattcgccggcctgatcgtacacgctgccggcctgcatcacaccggagctgaccgcggcaagcacagcggcgaacacgagcgtcagaatgccgccggtgccgatgtcgcgaatgaacacggtgaacgggtcgttggcgtcatcgaccacggcggccgatccgaagaatccgcagatcgacgtgatgccggcgataaacacggccaacgcaatgccggacacattgcgccaggcgcgcttagggttgtcgagaatacggcgcatggcaatcatcgtggccgcatccttggggcgcttggccttggccctggcgcgagcggtgatcacccacgtgccgataagattcaccagcgcgaagcacagcagcatgaaaccgatgatcacgccgtacatcaccgcctggccggcctgagccagcatggccgggttcttgaagacgatcatggccaccaccacgactaccacgaacagcaccatacgggtgcctgagggcaatgcggtggcggtgcgcgaggtgacacccaatggggtgattgccacgcggcgcaaggtgaccagcgacgatatcagcgccaagatggccacgcccgccaaggtgattaccagcgccagcgggccgacccatagctgttcgaaggtgaaccgctgctcctggaagggaatcagcatgactgccggcatcagggcgcaatagccggcaatgccgataagcgcgccgatcagcgcctgtccggcggcgtcaagcgcggtgagacgcaccacctgaccggtggtcgcgccggccagacgcagggcggcgagacgggcgtcgcggcgggatgcggccagtcgtgcggcggaaccggcgagcgccacgaacggcacgacgagcagcatgcaggcgaataccgccaacgccacataggcggtggagaattgggccaggctcgtcgggtcgctgatctgccgtttccacgcggccaccgtatcgggccggcaggcaccgaagtcgaacgcgcaggcgacggtatgatcggccgaagcccgccagatgaaaccgtgtacgccgccgagcacggtgaggaagatggtggtggctgcggcgaaggcgatgattgccagcatcgaggtgtggccggcgctgccgcgcaagccggggcggtgaaacagccgccagagggcgaacgtgctcatcgcgcgcctcctgcggtggtttcgctcccgccggctggagctgccgagcgtagcgaggctgagggtggttcagcgccctcgggccacccccagtcagcctgcggctgacagcccccgccagcgggggcggagttggggttggcgtctgtctggtgcagacggccgtcctgcatcattacggtacggccgcagaacgaagcgacgttggggtcgtgggtgacgacgaccacggcggaaccgttgtcccgcgcggcggccatgagaatgcccatgacctcgcggccggtggcttggtcgagcgcgccggtcggctcgtcggcgaagaccacggcaggtttgacggcgagtgcacgggcgatggcgatgcgctgcatctgtccgccgctcatctcccccggccggtgcgtggcgagcgcgcgcaatcccatgcgttccagccacaggatcgccgtgtcggtggcggtgcggtagggcatgccgtcaagcatcatcggcagggcgatgttttcgaccgccggcagttcgggcagcagctggccggactggaagacgaagccgaagtcgttgcggcgcagtttggtgcgctcggcgtcgctcatgcggctcaggtcggcaccacggaagatgacggtgccggcggtcggcttaatgatgccggcgagcgcgtgcagcaaagtggatttgccggagccggacgggcccatcacggctaccgtctcgccctcccggagcgtgaagttcacgtggttcagggcgagcgtgtgcatggtcggcatggcgaagccgggctgggctggctgggatggctggccggcctgaatggcacccggtccggccgcagcgggattcgccgacgcataaccggctcccgtgccggctggcatcacgccggtgacgccgtgcccggcctgtgcgcgggccatgctggcggtgtagtccatgaccaggtcatgggcctcgatgaccggggcccactgctgggtgtgcgatgccggctgctggaactgttggggttgctgagactgctgaggctgagccgccggtcccgacgccggctgaggctgctgcaattgcgatgctgctgtgttcatactcccgagcgtacggagcgaacgcccagccgaccatcgggctgcggtatgaacctttctggatcaccggcccgctcctcatccgcaaggattagagatacgcaaatgattaatgaccggcaaccactattcggtgccggtcattatgagcattgcattcaggcgctacgcgcattattgcgcggtagccagctcgtccaggcgggcggcgaagcggggccagtcggtcttcatagcggtgaggagcttgcggttgggcacgtcgtcaatcgggacccagcagatttccatgctttcgtcgtcgtttgccttgggctcgacggtgtggccgggcttttcgaaggcaaacacggtggtgtaggcccacgggccgtggtcctcgcggtaggagccgactacctcgatgtcttcgggagtgatgttggcttcctcatagctttcgcgcagcgcgccctcgatgggcgattcgccgtccgcggtggcaccgccgggaataccccacgtgccgccttcggcgctccacgcggcgcgatgttgcatgaccacgtgggtcaccttgccactcaccgggtcgcgacgagccagcagaataccggaagcaccgttggtgccccaatgcttgcggccgcaggcgcagtccacccagccatcgccgggctggtgtacgttttcgaccggcggcagaatgccagcgtgctggttgcccgatgccttgctttccggttccagttcaccacggccgacattccacaggtcagtccacgtgatgcccagttcgccggccagatgccgggccagcggcaagctgaggccgatgatgccgtgcggatcgccctcaatactgtcgatgaacgcaccaccgaagccttccagcgtgaacgatccggcgacttccagcggctcgccagtggcaatgtaccgttcgacgtcggcatcggtgaattcgccgaaatggactttggcgtggcttgcgccgcgcacggtacgcccggtcgcgaaatcgatcaggcagtggccggtccacagttcgccggtcgcgccgctcatgcgcttcagtcgttcgcgggccacggcttcgctgtgcggcttgccgtagcattcgccgcccaagaggaacatcgaatcacagccgagaatcagcgggccgaccgtcgcctcggtcagtcccggctgtccggcaatagcggtggcgatgggttcggtgacggtcggcatatcgatgccggagaagtcgcgcgtggtggcgatttccgccttggaatagtcaatgggcttgccagcggcggcttcacgcaagtcttcgacggcagcttcgcgttccgaatccttgatttccttggccttgagcgggtaggcgatcacgcggtcaccggtcgcagcggcggcagtatcggccacatcacgatacgcacgatgaacggcctcggccttggccgcggccagaatcatcacgcgctgcttgatgctcaaatcgtcgacggtgacgccttcttcacgggcggccgcttccagcgcagcaggctcatccacatgcgagacgcgaattgtggggcagatacccgccgaatacagcacgtcacggcgaggcttggacttggaagcaagaattagtggaatgggcatgacttaagtccttatgctcccgctggcgggagctgtcgaacgaagtgagactgagggtggtctctgccggtatggcggaccaccctcagaccgcctgcggcggccagctcccgccagcgggagccttctcctcgacttagcgacgctcgatttcgacgccggcggtgttgatgggcaggtgaagcacacgccaatggccggaagcaagctgctccgatgcgatctggtcgatggcttcgcgggcgttgccgtaatgcagcacgagcacgcaggggccggcaccggagactgcggcggcatagcccttggagcggaagagcgcaatgagctcggtggacggcggcatcagggcaccgcgatacggctggtgcagtttgtcctgcgtggcggtgaacagcagcgcgttggactgggcctgagcggccgcaagctcgtcggcgaacgccgattcacgggttccgccagagcaagcgcacgtatcggcatcctgagccggggcagcggcgacgccggacttgccctgctgggcggcctgagccagcaccacgggattcatcgcagcgggcagcagccccacgcgagacacgttgtagacggcgtccttgtatggcagttccctaggcagcgcctgacgggccttctcagtggacagctcatagtcgggcacgaacacggcggcggtgatggacgggtccaccgggtagttgacggcgtggaatccgccgtgcagcggttcaccaccaggaacggcgaccgagccgacgccttctgcggtttcgaagtcccaagagacggtcaggccaccgaacacagccggggccacattgtccgggtgtccttcaatctgggcggccatatcgaagacggccggacggttgaggtcaccggtctgggcgaaggccgcggcggcggcgatgccggccacaatggcctcggcggaagagcccatgccacgagcctgagggatgttgttggtcgcttccagcgtgaagccgagtcggccgaggccgaacgtggcacaggcacggcggaaggtggagaccacgaggtgggtttcgtcgcatgggagggcgtcggcaccctcgccgtggatgatcacgtgggcaatgccgtcgttcgggtcgtcgttgagcgtgaaagtgagctcgtcatggtagtcgagcgccagacccacggtatcgaagccggagccgaggttggcggacgtggcgggcacgcgcacgtgaacgctattgcagattggattcatggttgttccttaaaaaggagctccctcatcagagggagcttgggtattcagctttcaccgttcgaccgcctcatcagagggagcttaggtcttgtcagtccagcacgcgcaggatggacgggtcgccggtgacgaagtcgagcgcctgcacggccttgacggtgttgcgcagggtttcctcgtcggtcaggtgggtcacgacgcgcaactgctgaatctcgccgtcgtagccgggatcggtcatggtgggcttcaggtcctggttcacaccgttgatggagacaccgttcttggcgaactcagcggcgatggcggccagcacgcccggcttgtcgtgaatcaggaagcgcacggcgaatgcagccttggaggcggtaatcggagccttcggcagattcttgtacagcgggatggacgggccggtgcagccagcagcaatgtggcgggcttcggtcaccacgtcgcccacgacggcggaggcggtcggagcgccgccggcgccacggccgtagaacatgaggtcgtcggcggcctcggccttgacgaacacggcgttgaaggagccgtgcacggaggccagcgggtggttctcgtcgatcagggccgggtagacgcgggcggagacgccggcctcgccgttctcgaccacggcgagcagcttgatgaccttgtgctcggcggtggcggcggcgatgtcgtcggcggtgatcttggtgatgccctcaacggacacatcgtcgatggtcacggaggtgtggaagccgagggtggccatgatggcggccttgttggcagcatcgtagccttcgatgtcgccggtcgggtcggcttcggcgtagcccttggcctgggcgtccttgagcacgtcgtcaaactggagacccttggtggtcatctcgtcgagaatgtagttggtggtgccgttgacgatgccgagcatgctggtcaccttgtcgccgaccaaggactcgcgcagcgggcgcaggaacggaatcgcgccacccacagcggcctcgaagtagatgtcgacgcccttggcctcggcggcggagtagatctccgggccgtacttggccagcagcgccttgttggcggtgaccacggaagcaccggattcgatggcggcaagcacgaacttgcgggccacggtggtgccgccgatgagctcgatgacgatgtccgagttggtggccacgctcaaagtatcggtggtgacgatggactggtcgatccacgggaacttctcagtttccttcgggtcgaggcaggcgacgccggtcagttcgaccgggcggccgatacgagcggacagttcgtccttctgctcgacaatcaggcgggcggtctgggagccgacggtgccggcaccaagcaggcctacgcgaatcggggtttcgttgttgcgagccaattcagggtccttccaaaaagttttctatatcccaccgctattttacggattatttccgacagcagaccgaaagtactcatcaaagctgacggtccttttcgtattatgacggatttggccgcacattacagactgtcaggcgctcgcctctgcacgtggatcactcgctgacgtcgaggttgagtaggtcgtctacggtctggcggcggagcatgacgtgcgcaccggactcgctgacagcaaccaccgccggaatcagcgcttggttgtagttgctggccatggtgcggccgtatgcgccggtaaccggcacggcgagaatgtcaccgcgcttcaaatcggcgggcaactgcacctcgtgaaccacgatgtcgccggattcgcagtgcataccgcacacacgggcaagcatcgtttcagcggaaccggtgcgattcgccagacgcgcggtgtagtcggcaccgtagagtgccgggcgaatgttgtcggacatgccgccatccacagacacatacacgcgctcggcaatcgggttgccgtcactgtctttggcatcggacaagtgcacgtgcttgatggtgcccacgcggtacagggttacgccggcgggcgccacgatgtagcggccgggctcgaagctgatggccggggcgggcatgccgagcgcacggttggtgctgttgaccgcatccgccaagcgagtgagttccacgtcaatgtccattgaatcttcgccatcggtgtaggccacggagtagccgccgccgaggtcgatttcgggcaggatgtaggcgtcggtggcccacagggtcttgcgcagcagcatcatgcgcttggccgcgtgaatgaaggcgtccgcatcgtggatgttggagccgatgtgcgagtgggctccgaccagttcgagtacgtcctggttggcgaggatggtcttgagcacggcgatggacggaccgtccgcaatggcttccatcgcggcggccagcgccttgtctgtgtcggagacttcctcgtggctcaggtcgtacgggtacttgacgtcgtagtgcagctcgcgctctgatttctcggtcttttccgcgccattttccggggaatgcgtcgcagagatacgcgcgttggtagcggcaggcgtcacgtctttgaggtcgttcagcacgtcgagcacggcggcgtcggccccggcggccagcagcggcacgccgaacttctggtcctcgtgagcagtggagatgtactcgtggccgccggcgtggacaccgacggtgacgcgcagcatcacacgggcgcgtttgccgagcttgcgggcgatggcagcaacgcgctccggctcgtcgggctcgtcgatcacgattttggcgaagccctgttcgatggccagcgcgatttcctcatcggacttgttgttgccgtgcagcaccagacgacgtccgggaacgccagcggcgagggcgattttcatctcgcccatcgtgcaagtgtccacaaacatgccggcctcggtgaccaatcgcacgacttctttggacaagaacgccttgccggcaaagctcacgtgcgtagtggaggtgttgaatgcttcggcggcagcgcgcacgaagtgcctagcacgtgcgactacttcatcagtgtcgatgagatagagcggcgagccgaactcgtcaagcagcgattcggcggtacgaccatgaaattcgatggagccttcggcattcacagccgtagcggccggccaaattggagaaatgggcataatcacatcttttcgggggcggtgacgccgaggaggtcgaggccgttggcgatgacctgctggacggcgtcattgagcttcaggcgggcggcggcacgggccggctccggattcttggcgatctccaaggccttgcgagcctcgtcgtcgccacgggtttccggatcggtcagggccatcggcaccacgcgctctacgttgtaccacttgtgataggtggcggccagctcttcgagataacgggccaccttgtgcggctggcggtcgtcggccgcagtggcgagcacgctcgggaattgggcgagggcggcgagcacttcgccgtcggcctcggtgtcgagcagggccaggtcggcaccctcgtagctgatgccggcggcggctgcgttgcggtccacgttcttggagcgggcgtgcgcgtactgcacgtagtacaccgggttgtcgttggtgtgcgaggcgagcagggccaggtcgatgtcgaagttctggttgtaatcggagcgggccagcgagtagcgggcggcgtccacgccgaccacggagaccaggtcgtcgatggtcacgacgttgccggcgcgcttggacatgcgcacgggcttgccgtccttcatcacgttgaccagctggccgatgagaatctgcatgttcttgccgggctcatcgccgaaggccgcgcacatggccatcatgcggccgatgtagccgtggtggtcggcgccaagcatgtagatggccacgtcagccgggttttcggcgcgatggcgcttgtcccagtagtaggcgatgtcggcggcgaagtaggcgaactcaccattggacttgatgatcacacggtccttgtcgtcgccgtgcttggtggattcaaaccaagtggcgccgtccttgtcgaagatgtcgccgcgggacttgagctcttcgatggcggcgtcgaccttgccgtcggcgtacaggctgttttcatggaaccagacgtcgaagttcacgcggaagtccttcatggacttctgaatctcgtcgaacatcatcggtacggcgcgcttgcggaattcctcgcgcacttcggtatcggcctcgccgagcggttcaccgtcgtcgttgaggccttgatcctggtgggccagtgcggtcaggtccacgccgtcggactcggcttcggcctgaacacgggcggcgatctcgttgatgtaggcacccttgtagccgtcgcacggggtttcggtctggtagccggcctcacccaagttattggcctcggcccaagcggcgaccagcgacttggcgaagcggttgatctgctcgccgtggtcgttgaagtagtattcgcgcaccaccttggcgccgttggcctcgagcacgcgggccatggcatcgccgacggcagcccaacgggtgccgccgatgtgaatcggaccggtggggttggcggagacgaactcgagattcagggtctggccgcccagatggtcgttgcggccgtattcgttgaccttgttgagatgcttgtcggtgtcggtcacggcaccggcggcgagtacggtgtccaccacggcggcggccgaggcggagtcaagcgtgatgttgatgaagccggggcctgccacctcgaccttggcgatgccgtcggcttcagcgagcgcggcggcgaacggctcggccagatcgcgcggcttcatgccggccttcttggccagctgcatggcgatgttggaggcccagtcgccatgcgcacggtccttcgggcgcatcacggcgagcttgtcgacgggcggaatcagctcgtcggtcaacgcgccggcctggccggcggcgacgaggttgtgggcaatgctggaaatcagttcacttaaggcttcaggactcattcttctaaggatactgagaacggcgacacttgcgccctggtatgcctatatgctgcccctgctggcgggggcaagcacacagccgaaagataccaagcgaaaaagggtaggcgacaatcgccggaatcgttggaggctcgccgaaaccgctatacataccgtcggtcggtatctatagtgatctgcaacatcaagcacagtagggaggccaccatggcacgtaacgctcaccccgaggtgacgcgcacccgcatcctcgacgccgcacaacggctgttcatggcccagggctatgagcacacctccatccaggacatcgtggacgagctcggcgacctctccaaaggcgcgatctaccatcacttcaaatccaaggaagccatcctcgaagagctcaccaaccgagacaacaatatgcaggacgacttcaacgaatccgtcatgaatcgcactgaccttaccgccctcgaaaagttccgcgtgctatggcggcattcgatgaccaagcaagaccacgtgcagatcatgcgagccgccatgccgatgctgagcgatccggtttcgttcgccgcgaatatgcaggtatggagcaagcatctgcccgaacgcttcctgccgctgatcgaggcgggcgtcaaggatggctccatccccaccgagtatccgcgcgaggccgcagagctgctttcgttgctgccgaattattggctgatgccgtatttctacccggtgaccctgcccgaaatggagcatcgcatccgctgcttggccaccatgctcgacgcgatcggcgtgccgattttcgatgacgagctcatcacggtcgccgcgaagggcatgatgacgttcgcaggggagccggagaaaggctcagaatgaatagcacagtgaaacccgagaatgacatcgccggcaccgccacccaacgcccgctgctgtcccgcgacttcgtgctgctggtcgccggacaaggcatctcgctgttcggcaatgtgatgctgcgattcgcgatgtcgatgtgggtgctggacgaaaccggctcagccaccatcttcgcctcggtgctggccatctccatcgtgccgaccatcctgctctccccgttcggaggcgtgctggccgatcgcgtcaaccgccgcaccatcatggtggcgctcgacgccatctccgccgtgctcgtgctggcgagcgccatcgtcttcgccaccacgggcttccatatcgtagccatcgccaccatgcaggtgctgctcgccgtgctcggcgccttcgaaaccccgaccgtgcaggccgcactcccccagatgttccggcagtacggcccggccaccatgcgccaaggcatggccgtgatcaatcaggtccaacaactaagcagtctgctgccgagcttcctcggcggcgtgctgtatgcgatgttcggcatccgtctcatgatgatcatcgccatcgcaagcttcgccggcgcagccgcgctcgaatgcttcatccgcctcagtgccccggatcgcggcgacgaggagctgcccaccccacttgaagacctcaaggcaggcgtgcgattcctcatcaaggaccggccgaacgtgttcagactgctgttgttcgcggcggcgctcaactttgtgcttatcggctattccggcgtcggcttcccgtacacgattcgtacagtgctcggcttcgacgccactgtctacggcatcgccgacggcctgatcggtgtttccggcgtggcgggcgcattcatcgccggcctgttcgccgccaagctcacgatgcgctggctgccggggctgatggcgacgcttacgctggccatggtcccacagggtattgtgttcctgctgccggtcgacgcatggaccaaactcgtggtgctgatcgtattcacctgcggcacgatggtcgccagttgcttcacgaatctcatcgccgtgcccgccatccagctcagtacgcccgaggcaatggccggcaaagtgatgtccatggccgcggccgtgagcatgtgtgcccagccgctcggccagatggtgtacggctgggcctacgaccaaatgccggtcgccatcgtgctgttcatcaccaccgccctgttcgccgtgctcaccgtgctgatggttccgctcgccaagcagttcgaggactgacgatcggcgcgcacgccacatcctgccgcccggccataattgaatcaccgcacgaaaaggcacgaaaaggcacgaaagaggtacctatggccacgctcaacccccaatcattggtcacgttgtggcagatcgaacagtatggttcgttctccgccacggccaaggccacgggttggtcgcagccggccatcagccagcagatcaaaaagctggaggcacagtgcggttcgactctggtgcaacgcacctcgcatggtgtggaactcaccgccaccggttcgatgctcgcccgccacggcgaggccatcgccgagcggctggagcgggcggcccgtgaggtcgaggattatcggcatcatcggtttgctcacctgcatttggtggctccaccatcaatctgctctactatcgcggcccgtaccgtggtcaagctcagtatgttcacggacatcgagctgagcctgattcagatggagccgccggaggcgatcggtctgatttcccaaggcaaggccgataccgccgccgtgttccgctacagcagcatcccgaacttcctgcacatcggcgacgacctgaccttccattcgctgggttacgatccgatgcgactgctggtgcgccgctccagcggcatcgccaaacgattcgaggagaccggcgaacctgtgccgctgtccgccgccaaagacgagcattggatcgccggctgccccacctgccgcgcaaatttggtgaaactggccacccgtgccggattcaagccggatatccgccactgcacggatgattactgggccacgcagaacctggtcgaggttggtatgggcgtctcgctggtgccggcgctcgatacgcatatcaacttgcagggcgatctggtggcctgtcccattgccgacgattttgcggcgcgcgaggtcggcatcgtgactcgtgccggcgaccatcgccccgcgcttggttcattgctcgaggagctcgagcgcacgtcactcaaatatttgagtgccaagtagtcgcacagcgataagcaagcttgcgagcgccatcacgatttcggggagccagaccgttgagcagcccttctgcaccgggaacaatgacatgttatgagcatgaacaacattccccagtcaacgactttgagcaacacaaccgccggcacctcttgctttgatgccaatcacatcgacgtgacgaccatcgaggatctggagcaggtcggttcggataaatggacccgttaccccggctgcatcggcgcattcatcgccgagatggattacggtctggcaccgtgcgtggccgaagccatcgaagaggccaccgaacgtggcgcgctcggctacattcccgacccgtggaagaaggaggtcgcccgctcgtgcgccgcatggcagcgccgctacggctgggaggtggatccaacgtgcatccgcccggtgccggacgtgctggaggcgttcgaagtgttcctgcgcgagatcgtgcgcgccggtaactccatcgtggtaccgactccggcctatatgccgttcctaagtgtgccgcgtctgtatggcgtggaggtccttgagattccgatgctgtgcgcgggcgccggcgagagcagcgggcgcaatgatgaatggctgttcgatttcgacgccattgagcaggcgttcgcgaacggctgccatgccttcgtgctgtgcaacccgcacaacccgatcggcaaggtattgacgcgcgaagaaatgctgcgattgtccgatctggccgccaagtacgacgtgcgtatattctccgatgagattcacgcgccgttcgtctaccaaggccacacgcatgtgccattcgcctcaatcaaccggcagacggccatgcaggctttcacctccacttcagcctcgaagtcgttcaacattcccggcaccaagtgcgcgcaggtgattctcaccaatccggacgatctggaactatggatgaggaacgcggaatggtccgagcaccagacggccaccatcggtgccatagccaccactgcggcctatgacggcggcgcggcatggttcgagggcgtgatggcatatatcgagcgcaatatcgcgctggtcaacgagcagatgcgcacgagattcgccaaggtgcgctatgtggagccgcagggcacgtatatcgcgtggctggatttctcgccactgggcatcggcgacccggccaactatttctttaagaaggccaacgtggcgttgacagacggccgtgaatgcggcgaggtcgggcgcggttgcgtgcgtatgaacttcgccatgccctacccgctactggaggaatgcttcgaccgcatggccgccgcacttgaggcggacgggttgttgtagaacagaattgcggctcccctcaaagaggggagccgaggaacggccgaattagtcgaagtcggcaccgagggcttcgagtttgccgcggaagtcggcatagcctcggtcgatcaggctgatgccgtgcacgtccgaggggcctgacgcggccaaggccgcgatcagatggctgaacccaccacgcaggtccggcacgtcaatgtcgcgtccggtcagcggggtcggtccgaagatcacggcggaatgcttgtagttgcgctgccggaaacggcacggcagcgagcccaggcactcgcggtacaactggatggtggcacccatctcgaccagcggcttggtgaagccgaaacggttctcgtacacggtctcgtgcacgatcgacaggccgttggcctgggtcagggccaccacgagcggctgctgccagtcggtcatgaacccgggatgcacgtccgtctcgatcgccacgggcttcaagtccccgcccggatgccagaaacgaatgcccttgtccgtcacctcgaatttgccgcccaccttgcggaacacgttgaggaacgtgatcatctccggctgggtggcacccttgacgaaaatgtcaccgtgcgtggcgagcgcggcggacgcccaggacgccgcctcgatgcgatccgtcagcgacgtgtgcgtgtacccctgcagttccttgacaccctcgatgcggaaggtgcgatcaacgtccacagaaatgattgcgcccatcttctgcagcacgcacaccagatccatgatctccggctcagtggccgcgcccgacagttcggtcttgccctcggccagcacggccgccagtaaagtctgctcggtggcgcccaccgacgggtagggcaggtggatcttcgcgccgtgcaggccgttgggcgcggtgatgtggatgccgtccttgtgttccttgtccaccgtggcgcccagcttgcgcagcgtctccagatggaagtcaatcggacgtccgccaatcgcgcagccgcccaacgcgggaatgaacgcttcacccaaacggtgcacgagcgggccggaaaacaggatcgggatgcgcgacgaaccggacagtgtatccacgtcggccacatcggccagctgcacacgcgaggcgtcgatggtcacaatgccgttcgcaccgtccacatccacgtccacgccgtgcagacgtagcaaatcggacaccacatgcacgtcacgaatctccggcacgttcttcagcaccgacttgcccggtgccagcaacgcggcgaccatcgccttgctcacgaagttcttcgcgccacgcaccttgatcgtgccattcaaaggcttgccgccctcgacatgcaacacgtcatccggattctcagccacgccactctcctcaatcaatcaagattcaaaaaatgctaccgtccagtttgccataagccatgtgccgactccgtgaaatgcaccccagccgaactttgatcaccgtgcacaacggatcccatacccccgtcgaatcaaaccgataacgtgatcttcctcacatttgccgccacggcgttctccatacttctacgctacgattcagggcaatggcatcagacgccatgtccacaagcaaaggagcattcatgaccacagtcgccgtcatcggctgcacgcacgccggcacgttcgccaccacctcgattctcgccgaacaccccgattggaccgtccatgttttcgagcgcaacggtacgctgtccttcctctcctgcggcatcgccctgtgggtgggcgaccacgtatccgacccgaagaaaatgttctactcctcccctgccgctctggccgaagccggcgcgaccatgcatatgcgcaccgacgtgacgtccgtggacctcgacgccagaaccctcacctaccgcgcgctggacgaggccggagaccccgccgaacagaccctcgctttcgacaaactggtcgtgaccaccggctcgcgcccggtcatcccgccgatccccggcatcgacagcccgcatgtgctgctgtgcaagaactgggatcacgccatcgccatcaaggaaaaggcgaaaaccgccaagtcggcagtggtgatcgggtcgggctatatcggcgcggaaatcgccgagcagttcagcgtcaccggcgtcaagaccacgctggtcgacggccttgatcgcccgctggccaataatttcgataagaccatcaccgatcaggtggcggccgcgttcgaggagcacggcgtcacgctcgcgctcggccagaaggtggtcgagttccgcgacaatgacgacgacaccgtcactgtggtcaccgaaaagggcgagtacacggccgaaatggcgattctggccgtcggcttcctgccgaacaccgacctgctcaagggcaaggtggacatgctgccgaacggcgcgatcgtggtcgacgactacatgcaggcgtccgcgccgggcgtgtacgccgccggcgactccgccaccgtgttctacaaccccaccggccagcacgattacattccgctggccaccaacgcggtgcgccagggcctgctggtgggccgcaacatcgagacgccgaccgtgaagtacatgggcacgcaggccacgtccgccgtgcagctgtacgatctctcgctcgccgcctccggcctgacccgcgccggtgccgaacgccgcgggctcacggtccgcgagacctcgctcaccgaggattatcgcccggacttcatgctcaccaccaccccagtcacgtcgattctgacctgggacccggaaacccgcaaggtcaagggcggccagttctgttccaaggccgatatctccggcgcggcaaacgtgatttccatggcgattcaggccggcttcaccatcgaccagctcgccaacgtggacttcctgttccagccgaacttcgacaagccggtctactacgtcggcgccgtggccatgaaggcggcggccgagtaagacggctgtacccaccgcaaaaagaaaccccggcgtgatgggcgccggggagagaaaggagagaagaagaagaaagaggttaagttatgcagcttgttcggccgtgattacatataacaacaccagtttcaatgcaacgtgggcactggctgggaattgtctgggaatcacggcccgtacaggctgtttcttgttttggagccgatttaccggctcgccttgatcttgtgggccagctcggcgtcccacatcgcgccggttgcggacatcaccgaatccgcgccggcgtttctgtatgcctgatagtcggccggcgaaaccacgccgcccacgccattgatcttgaaatcaagaccgagcttctcgcggatcgcggccagacgggcgaccatgtcgaggccggcaccacgaatcgcattgccacacacgccggagcgatcacggcctgcaccgggcagggcctgattgccattggcatcgaccagtttggcggaaatcgtattgatggtgctgaatccctgcacagtgccgtggcccacggtggaacgcaccatgagttcaaggtcgccgtcgctggggatgtaggcgagcttgaccatcagcgggatgtcgccgatctcctgcttcacggcctcggtgatgcggcccacgagcagcggattgtggcatagcaggcggttgtggccctcgttggggcagctggtgttcatcaccatgagcttggcaccggtttctttgaccaggcgggcggtggtggcatggtcggcgatgtattcctcctcgctcatgccctccacacgcgagccttggaagctcgggaccagcacttgaccggggccggcggcctcgatggcggcgcgcatgtccggctgccaggcatccgggctctgcgagggcacaccgaagctgttggagatggaaatcggctgttcatagttggtgtcggccagcacgccttcgtccagttcggcgctgcccggcgtcagtgaaccgtccgccgacttggggtgtacggcgagcacgttcgggaacgggttgcagccccaggcgcgcgaacgcacggttttgtaggtcgccagatcgaagcccatgcggaaggcggccgtggtgaaacggctgttgagcagcgggcctgcgggaatgccgaaaggcagattgaccggctggcccaaaaaggtggccaaggcaccctcggaggcaccctcgctggtggttccggcggcatcggcaccgttgccatccttcagcgcctcggcgaacgcgccgaacggcccttgctcatagttgtcttcgtaactgcggctgacatcgtaaaacggctcaaaatcactcatgcttcaacgataagccaacctgcatgcgcacacgcacactcaacccatcatcgcgccgacaaacgaaataatggcgaaagcggcattggctaccacaaagatgatgaacgtcggagctgcccagccaaagtacgtgtctggaatactacgattcgtacggtgatattggcgcaaacttaaatagtgcaaacacaccctagaagagataggagggaatggcactttctcgcgttgttggtggaagtatttgggatgctaagcgagttgccgcattggaaccagacgattgcgtgaagtgaccctatacgtaaaaggtctcactggcaagagccagtgagacctttgtctgatgcgatgcgagcgacccaataatctcaatcagacacagagccaacggccctgggcctgcaattatggactcgcctttcggcgaggctcaatgctggcctcgctgctgtcgcagctcggcacagggcctgctgaaagcccaccgggctttcagcaggccgatcgcggctaaataatgccgcgatcggccaacggccctgtccagtctgcgtcctcaggctcgcgggcggactcgattctttcttcggcccagtgtttggcggggatggtcttgggcttgaaggggaacttttcggcgcgcatcttttcgtaggcggcgatgtcgtcctcgtgctgcagcgtcagatcgatatcgtcgtagccgttcatcagacgccaacgcacgtaatcgttgacctcgaacggcagggtcacgtcgccgcaagtgacagtgcgggtctccagcgagacagtcatctcacgaccaggctcttcctccagtagcttccacaggagttcgacggactcctgcggcataatcgcggccagcacgccgttcttggcggtgttgccgtagaagatgtcggcgaagctcggcgcgatgaccacgcggaaaccgtaatcgtgcagcgcccacacggcgtgctcgcgggaggagccgatgccgaattcggggccggcgaccagaatctggcccttaccggcgtattccggcttgttgagcacgaagttcgggtctcggcgccatgcgtagaacagggcgtcatcgaagccggacttggtcacgcgcttcaagaacacagcgggaatgatctggtcggtatcgacgttggagcggcgcagcggcacgcccacgccggtcagtgtggtgagtttttccataacaattttcctttcggggatctctcccccagtcagtcttcgactgacagccccctcgtcagagggggctcatgcgtattgactcagagatcggcgggggacgagattgtgccgcggatggcggtggcggcggctacggccggcgacgccaaatgcgtgcgcgagcccttgccctggcggccctcgaagttacggttcgaagtggaaatcgagcgctcgttcggtaccagcttgtcggggttcatgcccaggcacatcgagcagccggcattacgccattcggcaccaaagtccttgaacaccttatcgaggccttccttctccgcctgcagacgcacacgggaggaggccggcaccacgagcacgcggtgaatgttctcggccttgtggtgacccttcatgatcgcggcggcctggcgcaaatcgtcgatacgaccgttggtgcacgaaccaatgaacacggtgtccacggcgatgtccttgatcggcatgcccggcttcaaacccatgtatgtaatcgcacgttcggcggcggcacgcttggtggcgtcggcgatcttgtccggctccggcacggaggcggtgatcggcagaccttggccggggttggtgccccacgtcacatatggaccaagcttggtggcgtcaatatccaccaccttgtcgaatacggcatcgtcatcggtcttcagcgtcttccagtacgccacggcctgatcccacagctcgccttccggcgcgtgcggacggcccttcaggtactcgaacgtggtctcgtccggcgcgatcatgccggcacgcgcaccggcctcgatggacatattgcacacggtcatacgttcgtccatggtgaggttacgaatcgcctcgccacggtattcgatcacgtaaccctggccgccgccggtgccgatcttggcgatgatcgccagaatgatgtccttggccgtcgcgtccgcgggcagcttgccgttgacgttgacggccatggtcttgaacggcttcagagacagcgtctgtgtggccatcacgtgttcgacttcggaagtgccgatgccgaacgccagcgcgccgaacgcgccgtgcgtcgacgtatgcgaatcaccgcacacgatggtcatgcccggctgggtcaggcccagaatcggggcgaacgcgtggacgatgccctgatcggcgtcgcccagcgggtgcaggcgcacgccgaactccttgcagttcttctccaaagtcgtcaactgcaacgcgctcgtctcatccgggttcgggcgatcgatatcaacggtcggcgtgttgtgatcctcggtggcaatgagctgatccacgtgacgcggcttgcggccggccaagcgcaggccctcaaacgcctgcgggctggtgacctcatgcatgagcatcagatcgatgtacagcaaatcaggggctccgtcgctgcccttgcgcaccagatgatcggcccagaccttctcggccagtgtcgttcccatagtgattcctccaaaaaattccgcgcgaggtattgtgttcgcgccttgttcgtggtattagcctatgtgcttgcgatgggcccggccatgagcatgccggatattgagatacggtcaaatgatggcctcaatatgactcggacccgactcgaacatgacctagtcatgactcggttccgctccagacatgtctcttcggcatccacgaacgccctttcaacttcatggccaccctgtgagacacttccccgatttgccatttcactatgtgagatggcataatcgcccttattatgactgattcccgggaagaaccattgaacaacagcttgaccaagtccgagccggttgaagacaccaccgccaaggacgatggggaaatccattccggcgttggcgtccttgataaaactgtaaagattcttgacgcactggaatccggcccgtctacgctgggccagcttgtggccgccaccggtctcgctcgaccgaccgcacatcgtttggctattgcactggaacgccaccgtttcgtactgcgcgaccagcatggccgattcgtactcggctcccgtttcgccgaacttgccgccgcagcaggcgaggatcgtctgctgaccgccgccggcccgatcctgcagaccctgctcgatcgcactggcgagtctgcgcagatttaccgccgccaaggcgatcagcgcgtgtgcatcgccgctgtggaacgcacctccggcctacgtgattccattccggtgggtgccatgctgtcgatggaagccggttccgccgcccagattcttctggcttgggaggattccgaccgtctgcaccagggattgcgccacgccaagttcaccgccaccaagctggccgccgtacgcaagcgcggctggtccgagtccgtgaacgaacgcgaagagggcgtgtgctcgatttccgccccgatccgcaacgcctccggccaggtcatcgccgccatctcgatttccggcccgaccggccgcatgggtgccgcccccggacgccgctatgcgccgctggtgatggccgccggcaagtacctcaccgaggcactggtcaaagccgttcgctgaaacataccagtcaatccaaccgatagcccaaccggcagaaatcccgcgtcacaacgaaagagacgcgggatttctgccactaatcgtccaacacagcggaaggccaccgaaacctcgaatacttcgcgccgctttccgcctctatcaggaacagttacctgaataaaccgggttacctgaataaaccggacagttgactccatagcgacggcttgcgcagcaaatcatcgccctcgccctcgccaggcgcggtctggttcaccgcataggtataggcgcgtttggaactgggcttgcccaccagttcgccaaactccagcaattgcgtacgcggctcgtaagggtgacggatatcaaattcgatcaatcgcgtggcgcgtttggccggagccggtccgtacgtattgaatccgcaggttggcgtagcgataagcaacagaccctcatgttcgccgacgaaaccgttgcgatgatcatgaccagctacgacgccgaaatacccctcgcgcagcaattcgaattcgtctgacgtatcagggcaggatatgccttctcccagatatccgccgggctgggtttgcaattcgtccagcacgtagtaggtatcggcgtgcgaacgatagccctgcatggcaaacgccgcgttggccgccaccggcttcagcacgttgtaatactcgggcatcggcatgtgctggaacaccattgatttcgcaccgatacggtcgggcacggcgttcaggaaggcgagcgctgcgggcgatggtgtgccgaagccgccgccatgcacgtaatcaccggagtcaagaatgaccagacccagcacattgcgcgtatggtcaacgtccataaccggcagcgcgaaggtgcctggttcaccggaaccagtggcaccagacagcgtctgcacagcaccacccgctccacaggtgtatgcaatctggttcggcaaggtctcactcggcggattgacacaaccggggaactcgcgatagataccgtccagttccgcattgcttagcccgcattggaaatcatggttgccatacgtcacagcccacggaatgccgcgcgccgccaacggctcagtgaactggccaatggccttgcgcaccagcgctcgggtatggttcagcgcggattcggcaataggttcgtcacaccagcgacgtttacggaatgaatcggcgaacgccggatcgtagccggcgatctggttgccggagaaaatcaccagatcaggccgtgtggcatcaaggctggcctcaatcagggtgatggtgtctttggagactttcggcccatcctgaatgtcggcaatctgcagcacgcggaacttgccggaatagtggaattgcagtcgtccgagacgcgcagagatagagaccggacggccgtcttcggcatcggccggcttgatacgaggtttcgacgacatcccctctggcgtacgctgtgtttccgtcatgccctccactgtacacacaaacgaaaaggcccgccggagcgggccttttctacaagttcaactactggagcagaatctctgcacaacatcatcgttgtaacggtaagtctttccaatgcccgtccaacgtaacagtcctcgtgaccatacactatttgtgggctctgctctgttcagttgttcttgtacctcataatctattcatcactcccgtttctcgcaacctgcagagagtcgttgtgcgttttttatcacaactgttcaatcgcactttctggctatcggaaaacgagctgaaccgttcacatcgaacccgtccgatgttcgatttcgttcgtttcaccgccgctcacggcgtgtcgcgagcgacgctagcacactcaaaaccaaccaacaccgaactaacatgaacacccgttgaattctggcgcgttcagtcgttttccggccacgccaaagcttacgatataagctatggcacagatatttgacgcaccctcgaaggcaattctgcgcagccaaatcgcagagcatattgccgaaaacgacaacaacgaccgccgcgtcgatcaggaaggcgaggcaccgctgcccaaggaccgtttcttcgaccgcgagctcagctggctcaagttcaaccagcgcgtgctcgaatgtgcggagaacgaagacatgcccctgctcgagcgcgccaacttcgccgcgatcttcgcctcgaaccttgacgagttcttcatggtccgcgtcgccggcctgaagcgccgtatcgactcgggcatcgccgtgccgtctgccgccggcctgagcccgcgtcagcagctgcgcgcgatcagcgagaccgcacaccgtctgcaagacgagcacgcacattacacgatcgacaccattctgccggaattggagaaggagcgcatcgtcctgctgacgtgggacaagctcacatcctccgagcaggagcgcctctcgcgctactaccgccagcaggtgttcccggtcctgacgccgctcgccgtggatccggcccacccgttcccctacatttccggcggttccatcaacctggccgtgatcgtggagaacccggcctccggcaagtcgcacttcgcccgcgtcaagatcccgggcaacctgccgcgcctggtgccggtggacgacatgaccgatgaggagtccaaggacgagcgttacggcttcatcgccatggaaaagctcatcgccgcgcatctggaatccctgttcccgggcatgatcatcaaggaggcccgctccttccgcgtgactcgtaacgaggacatcgacgtggaagaggatgacgccgagaacctgctcaacgccatggagaaggagctgctgcgccgccgcttcggaccgccgatccgcctggagatcacggacaccacgagccccttcctctcccagctgctcgccgaccagctcggcgtgagccaggacgaggtataccgtctgcccagcccgctggacctgaccgtgctctttgagctcggcagcgtggaccgcccggacctgaagaaccgtccgttcgtgccgaccacgaaccgtcagatcgccgaggtcgagtcctcccgcgcacaggatattttcgctgccatccgcgagcgcgacatcctgctgcatcacccctatgactccttctccacttccgtgcaggccttccttgcgcaggccgccgcggacccgaaggtgctggccatcaagcagaccctgtaccgcaccagctccaactcgccgatcatcgacgccctgatcgacgccgctcatgccggcaagcaggtgctggctttggtggaaatcaaggctcgtttcgacgaggacgccaacatcgcgtgggcccgcaagctcgaacgcgccggcgtgcacgtggtgtacggcatcgtgggcttgaagacccactgcaagctcatcgaggtcgtgcgtcaggaagcggacggtctgcgccgctactgccacgtaggcaccggcaactacaacccgaagaccgcgcgactgtacaccgatctgggtctgctgacctgcgacccggtggtcggccaggatctgactcgtctgttcaaccagctctctggttacgcgccgaagtccagcttccaccgtctgctggtggccccgcgtaccgtgcgcaccggcctgattcagcgcatccgccgcgaggaggacgccgcccgcgccggcaaggaggcctggatcaagatcaaggtcaactccatcgtggacgagaagaccatcgacgccctgtaccgtgcctctcaggccggcgtgaagatcgacatcgtcgaacgcggcatctgcgctctgaagcccggcgttcccggcctgtccgagaacatccgcgtacgttcgattctcggccgcttcctggagcactcccgcatctacgccttctgcaatgcggacggcccgcagatcggcgagggcccggcttccggcccggaggtctacatcggttcggctgacctcatgcaccgtaaccttgatcgccgcgtcgaggctctggtgcgcgtcaccgccccggagcagattgacgagctcatcaagtacgtggacctgcagatggccgactccaccatgagctggcacatgcagcccgacggcacgtatgtgctgcacaccaaggacgacgagggccgcccgctggtcgatagtcaggaatacctgattcgcaagcaccagcgtcgccccaattcacacaactgatttcactcgatgctccctgtcagcgcaagctaactgagggtggttacgatgcccggctcctctttcgagaggatgccgggcatcgttgttcagcgcgcaaaaactacgtagcagcggtccaacgtgacctacaatacaagagatgggtacgaacagtatgagacgaatcgtggaagccgccggcggtattctgtaccggtggaaggatgatgccgagccgacgcaggcatcgtctccatcagcgaaatccaatattgccaccgatggcaccatcatcgcgaataccgcggattctgacggcaaggccacggcagcacacggcgcatcggacgcggctcccaccccggacccgacgcaggccgacagcccggccgcggtggacaacgtactcaaccgcatcgaactgtgcgtcgtgcatcgcccgaaatacgacgactggagctggccgaaaggcaaggtcgacccgaacgaatcgcaccggcatgccgccgtacgcgagatcggcgaggaatcgggcctgtccgtggaacttggcccctatctgggcgacatcgagtacccgctgtccgaagaaggcagcaaacagcgccataccaaggatcggtcggcggataccaagcatatccagttctggatggccacgccgatcagcgccatcgacaacctgcggcgtacccatgcgtttggcccggtgcatcgggcggacatcggcgaaatcgacgaagttttgtggctgacgccggccgaggcccgcaagaagctcagccattccaccgataaggacatcctcgcgctattcgttgatcgggtgcaggagggcgcgcttgacgccgtgccggtgattatcgtgcgccacggcaaagcggaagcgcgcaagctgtggaagggttcggacgcgaaccgtccgatcacgccgcgcggcgcggctgcggcatacgcgctgaaccgcgagctggcgtgtttcaatccgacccgactggccacgtcgccttgggtgcgctgccaggagacgttggagatgttcgcgtggcagaccggacgagacatggttcatctcgatccgctcaccgaagatgcatacgccgctgcgccggacaccgcatgggagtgtctactcagcgaaatcgagttcgcacttgagcgccgtcagcccatagcgatatgcatgcaccggccggtgattggtggtatgttcggacacctgcgcagcatgtgcgttgcgccgtctctgagcaaacgcctgatcgccaagacaccgttcatgccgaccggcacggcggtggcgctgttcgtcactccgacgcctcatggtcccaaaatcatcgatattcagaaggttcaaccgcttgtctactagacccgcatttcctgattcatccaactcctcggccgctgccgctgcagctcatgccgcgcacaatggtgccgccggcagtctgggcccgggcttcggctcgttgcgtgcggccggagcggcattcggacctgctcgcatgggttcttcacgcccctcgcgcccggctcagctcgacccggctgtggccgatggattggccggtggcatggacccgcaggcgttgagcgagatgagtcatctgtctgctgccgcattgctggatcgtgtgcgccatagcgaagacccggcggttgttgagcgggtgctcacgttggtggagacggtcggtgtggatgaaatcgctgaactatggagcgatgccgagccggattcgctgcctggtgtgctgtggcgactgtatatgttgcgtacgtggatgcgatcgaatcgcgactcgatcgcgcatctgtggcgcttgggtgagccggtggccactaccgcctccgccatcgccggcgtggatcaggctcccagtgaagatgacatcgtgcgattggccgattcgattctctccggtgcttttgtgggcgattttgccgtggcgcttgagcgcgcggcggcgtttaccgatgtggtggcgttgggcttgcgcgtggaggcgcggcgcatggtgacccgggccgaggccaacggcgccttctcctcggatgccgatgagaaggccgtgcgcaccaaagccgcccgccttatgcacaccgccggcagcctcatggccaccgccaaggatttccagcacggtgccaacctctggcgtcgcggacggttggagtagccctgctccaggctccctctgatgagggagctgtcacgggcgatgcccgtgactgagggagagacccaccaaccgcaccccaacaatcagctaccagccaacaccacacctcccccggcgcggcgagccccatcgcaagctatactaagtatccgcgtcggaccgtgcttaagccccgggctccattttttgccgccgcgagcggcccttgcgccgacaggcgctttcgcggttcggcgcttcttttcttttacccgattcacgccccgaacgttgcgatgggcacgaccagtatgccgtcattgcggcgataggccttcccacctcggccggtaaggaacatcatgaactctggttcgcgaacttgggccatggggttgccacagattttgtcgcggaaggatttgagcttatccgcattgtcatcgttcaccttaaggtcactgagttttatttcgatagcaccccacctgccgtcagacaactcgataatgacatcaacttcaagccccttgtcatcgcggtagtaggcgatgcgattgttcgcgcccggcatggccgacagatatacattcaaatcacgaatgcacagcgtttcaaacagatcgccgagcgtctgtgtatcgcgcatcagagtattcggcgcggcacctaaaaccgcagcaggcaacgaaggatccacgaaatatcgcttgggcttggttcgcacacgactctttgcgcggagtggcggttcccaaccctccaaatccgtcagaaggtacaagtccttgaacatttccaaatagctcttcaccgtctgcgtatccggctcacgccgctcatcgccatatgccatatccgcagccagcgtcgcatattttggtgcctgcgagatgttcacggcaagagctcgcatcaaagctcgtgcagtttcaggattcttcttcatcttcggcacgctgatatccagcacacttgcgatatattcgcccgggatttccaaggcgaattcatcgtctagctcaagattcgcgggccatccgccacggcaacaccatctggcgatgtcttcgatactcgtattgcattcggcaggctcgaatttcccctcgaacaaatcggataggctgaccgcgcccgtggattctccggattcagccaagctcatgggccacatgcgcagacgagcaatgcgaccagtgccgctgtgatgaatggcgtcacgatcctttggaatagccgaacctgtaagaatcagctgccccttgcggttcgcattgtcatctatatggcgacgagcggcatcccaaatttgcggtacatcttgccattcgtccaccagatggggctcctcccccatcagcaccaatgcaggatcggtttgggcggccgcgaaaactgccacatcatccagacgatcaacgcttcgagaccgggagagcgcggtccatgtcttgccgcaccatttcggcccaacgatttccactgcaccgaacgccttgagcagtttacttaatctgctatctaccacgcgtgaacgataatcaggcctggtcaaggtaccatcgcgaccactcaaatcgttcatattgcagcctttcccagttctatcgttctaacaatatagattttacaccagtttcattcccgattttacacctatctcattcccggttttacaccagtttcattccctgttttacaccgtgttgttttttacgctttaccctctcagaggtatcagaggcagatctcggcacggacagggcattgtcctgctgcaactggcctatcgcagcaaaaagtcgaatcacccacaaatccaatccgataagcaagccgcgccattaccaattcggcaggtcggcaaacttggactaggctgggaatcatggaactccatgttttgaatcatccgctggtcgagcacaagctcaccgtgctgcgcgacaagaacaccccctcctccaccttccgcgagctcgtctccgaactcgtgatgcttgaggcctacgaggccacccgcaacctgtccgtggtggccgcgccgatcgagacgccggtcgccccgatgaccggcaagaagctcgcctccccgcgcccgatcatcgtgccggtgctgcgcgctggcttgggcatgctcgacggcatgacccgcctgattccgactgctgaagtcggcttcctgggcatgaagcgcgacgaggagcaccccacccagcaggtgacgtacgcgaaccgtctgcccgaggacctgtccggccgccagtgcttcctcatcgacccgatgctcgccaccggcggaacgctggtcgccgccacgcactacctggccgagcgcggcgccaaggacgtgaccgcgatcaacatcatcgcggcccccgaaggcatcaagtacgtcgaggagcacatcgacccgtccatcgacttcaaggtcgtggtgtgcgcggtcgacgaacgtcttaacgacaagtgctacatcgtgccgggactcggcgacgccggtgaccgtctctatggcgtaattgactgatttccctggctcccctccccgaggggagccaacataacggaacatctatgcaaatcgacattattgcgccggggcgcgtgaaggagcgttaccttcgcgacgccattgacgagtattccaagcgactttcgcgctactgcaagctcaacatcattgaagtggcagatgagaaaacgcctgaccatgcctccgaaggcgttgaccgacagatcaaggccagagaaggcgaacgcatcgccaagcatctgaaggacggcgcgtttgttattgcccttgccatcaatggcaagcagctgtccagtgaagaattggccgccaaaatcaacgaccttggattgcgtggcaccagccatattcagctggtcatcggcggttcaatcggccttgacgacgcgattctgcgtcgtgctgattttctgctgagtttctcgaagatgacgttcccgcatcagcttatgcgcgtgattctgctggagcagatctatcgcgcttataaaatcaacgctggcgagccgtatcacaagtaaaacgccatacctcatggggcgggaaatcccccatggggcggtaattgccccatgaggcggcaaaatcctcatggggcggtatgccaaaatggcttaattccgcggtttcacatattcttcaaaccgccccatgggcaagttaccgcccgatgagcctgtaaccaccccatgggcgcatcaataacgccctcaacctcacactgcgtcggggacgaacgcttcgaagatgtggcggtcgaagtagggggcgcactgggcgagttcatcgctgctgcgcacggtccatgaaaccggcatcgcacccatcgaacgagcgagcttgacttgcggcgaagcgccaccggtccagtcataagccacgaaatcaggacgagacagccagtcgaacgccagtaagccggcggcccattcagccgcaccattcttgctcagcttcgccggccagctcagctgaccgcggcacacctcagggtgatgctccttgtaccaattcaccgcgcccgggtggaaggattcgatcacgtacgggccgtcatacgcctcaagcaaggcgtggcccttttccatgagctcttcgctacgctcatcccaagccctgttgttgctgaacttgtattccacaatcagcggagcccggccggccaccacgtccagcacatcggagaacagcggcacatgctggtagtaccccttcggcgcggcggacggcgtgaccaccagcggcgggttcgcgtcggcacccggcaacggttcggccttcaaatcgcctgactcgccgttcgggaagagcggaatacgggcgagttcgtcgtaagtcaggtcttcgatgcggcgcggatcgccggccacgcgcaacaaatcggcgtcatggaccacgaccacttggccgtcgagcgtaagctgcacgtcgagttcgatgccatagccagcctcgcaggcggcggcgaacgcggccagcgagttttcgggagcaatcggaccggtcatatccgcactgccgtagccggccttgacagccatgcgacgggcaagcgacacataatcatcgttttcggcgatggatcgctcagtggtatcggcttgggcgctaaccggattatccccaccataatcagcgatatcgatatagccgaccaaaccagaacccgcatcatgcaagccacgatgggcataccatacctccggaatggagggcacgaaattacgacgcttgtcattgaacgtgcgcggggccacggcccacacggcagcaccggcggcggccacgcctgccagcgccacgtttctccagagcttcgacgacattggaatccttcctgttgggctgcctctagcctaacgcttctgccagccattgtggagtggttggatcatccggtttcagcgcgcggtccaggtggttggcgcgcagtggctcccagctgaaatctgccagcagatcggcgggtttgcaaggaattggagtgggttgcagacgcagcagccaggcgcagtatccgatgatttgctcgggggttacgttgcgggcgcgcaaggctcccatatccagcgaacgttcgcgcttggctaaacgccggccggccgcattgtcgataagcggcaggtgcgcatactcggggtgctcggcgagaggcttttccgtgttgccgcattccggctcaaagccgccagccaacagacactggcgaatccacatttgcagcgcggtggagcgcagcagatcacggccgcgcacgatatcatcaacacccatatcgaggtcatccacgaccacgaccagttgatagccgaacagtccatcggctcggcgaatcacggaatcgcctacctcgcgggccaaatcgtagtgctgtggactatagacacggtcgttaaagcatgcgacaccatcaacgattccggcatcgccctgctgttccggcggcacggctcccgacagcgcagcggaatcgtcaggcactgtacgttgcttttctcccgctgccgattccggcatggcgatacggatggaatgctggtcgccgcgaaccaaacgggcacggacctcgtcgggatggtcgtgcagcaggcggcggcacgtgccggggtacaccatgaagccgtcgccctcgttgggggccgaggcggcgcgaatgtcagcacgcgagcagaaacaggggtacagcacaccttgcgagcgcaggcattcgagagcgtattcgtatcgttcagtgcgctgggattggaacatcggttcgccatcccagtcgaggccgagccaatgcaggtcatccatcatgagctggtccgcaccggcgaccacacgcggcttgtccacgtcctcgatacgcatcagcatgcggtcgccacgcgagcgggccgaaagccatgcacccaacatggcgtacacgttgccgatatgcatgcgccccgacggcgtcggcgcgaatcgtccagtcactggccctcctcgtatgaagttcagcaccatggtagcgaaaaggctctcctcctcagaggagagccaatatagtgaagctcgccagcccgaactcccctcagtcagcttcgctgacagctttgctcagagaggggagccagtgattgtcacttgtcttcggtgacgttgtccacgctcacgtccggattgtcggagacaatctggtcgctcgcccaagcggagagctccagatgttcgccgccggtctggtcgacgagcacggtgtcaccgtcgtggaccttgccggccagcagcatacgggccagctggtcgcccacttcggtctgtaccaggcggcgcagcggacgagcgccataagccgggtcgtaaccggtgttggccagccattcgcgagccgagtcggtgacgtccagcgtgatgcggcgatcggtcagacgctgggacacgccagccacctggatatccacgatgccgccaagctcctcgcgcgtaagcgggtggaacatgacgatgtcgtccagacggttcaggaactccggcttgaagttcatgtggacagcgtccatcacggcctttttcttggcgtcggcgtccatgtcctcgttcacgaggaactgcgagccgaggttagaggtcataatcaggatcgtgttcttgaagtccacggtccttccctggccatcggtcaggcgaccatcgtcaagtacctgcagcagcacgtcgaagatctccgggttggccttctcgacctcgtcgaacagcaccacggaatacgggcggcggcgcacggcctcggtcagctggccgccctgctcgtagcccacgtagcccggcgccgcgccaatcaggcgcgagaccgaagccttctccatgtattcggacatgtcgatgcggaccatggccttctcgtcgtcgaacaggaagtcggcgagcgccttggccagttcggtcttgcccacaccggtggggccgaggaacaggaacgatccggtcggacggttcgggtcggagatgccggcacgcgaacggcgcaccgcgtcggacacggcggcgatggcttccttctggccgatcacacgcttgccgaggtagtcctccatgtgcagcagcttctcgttttcgccctgcatcaggcggccgacgggaatgccggtccagtcggagacgatctcagccaccgagtcggcgtccacacggtccgggaccatcggctcatcggccgggttggccgcgctggcatcagcagattcagcatccgcgctctccgcggcggcaagctccttctgaatggacggaatctcgccgtacagaatcttcgaggcctccgccaagttgccttcacgggtatacttatccgcctgcacgcgcaggtcgtcgagcttggcacgcaggtcgccgaccttgttgtggccagcctgttccgcatcccaacgcgccttgagaccgctgagcttctcacgggtgtccgcaagttcggcttgcagcttgcccagacgctccttggacgcaggatcctcggccttcttgagctgcatttcctccatttcaagacgggtcaccttgcgctgcagctcatcgatctcctcaggcgaggagtcgagctccatacgcaggtgagcggccgcctcatcgaccagatcgatggccttgtccggcagctgacgacccgaaatgtaacggttcgagagggtcgcggcggcaaccagcgcgtcgtcgccgatcgttaccttatggtgcgcctcgtaacgctgcttcagaccacgcagaatggcgatggtgtcttccacgctcggctcacccacgaacacctgctggaaacgacgctccagcgccggatccttctcgatgttctcgcggtactcgtccagcgtggtcgcgccgatcaggcgcagctcgccacgggccagcatgggcttcaacatattgccggcatccatcgagccttcggccgcacccgcgccgacgatggtgtggatctcatcgatgaaggtgatgatctgaccatccgcattcttgatttcgttgaggacgctcttcaggcgctcctcgaactcgccacggtacttcgaaccggccaccatggagcccaagtcaagggagatgagcttcttgccttgcagggtggtgggcacgtcgcccgccacgatacgctgggccaaaccctccacgacggcggtcttgccgacgccgggctcgccaatcagcaccgggttgttcttggtacgacgggagaggatctgaatcacgcggcggatttcctggtcacgtccgatgaccgggtccagcttgccttccttggcggcggccgtcaggtcggtggagtacttctctagggccttgtacgagccttccgcgtccgggctggtgaccttcgcgccaccacgcacgccgggtacggccttgcgcagggaggctgcggtgacgccgttcttctccaagatttcggccgactggttcggcttgctggccgcgatgccgataagcagatgttcggtggagacgtattcgtcgcccatctgctgcatttccttctcagcctgggcgatggcggcggtcagctggcggctggcctgtggctgcgaggtgctggatccggatgcgctcggcagcgcgaccaaagcgttgcgcaccgccgcgccgatggcctgcgggtccccgcccgcggcctcgatcagagagcgcgccacgccgttttcctggcgcagcagcgcatccatgacgtgcagggtctcgacctgcgcgtttcctgcggcggacgcactctgaatcgcgtcgccgacggcttcttgggccatagtggtgaacttctgttccatatcgtattcctccatatcatgcggtctgcgcagtgcggctcgcgggcttcgaaagccctgcgagcgttgcgacagaccgcagcttgtcgttgtctgatatggtcaaccgacctggaacccattctattcccaaaacttgagtgcatatgactcaagttttggattttggtggggagggtgactagtagccccctctgatgaggaagcttgggcagccgctacttcagtgcgccgacggcggattcggcggcggcgaggacttcgccggagagaatcgcctcggccacgccctcaatctgcggggtggtccaggtatcgcgtacgtcggggccgatttcgttggcgtactggcgcaccacgcggtatacggcggcgcccgccgcacccggacggtacggcttgcggaagtcgaaggagcggcaggagcacagcagttccacggccagcacgcgcgcaaaggccggaatcgaccggcgcagcttgcgggcggcggcccaacccatcgacacgtgatcttcctgcatggcggagcttggaatcgaatcgaccgaggcaggcacggcgttacgcttcatttcggagacgatgccggcagcggtgtattgggcgatcatgaaaccggagtccacgcccgggtcaccagccaggaacgccggcaggccgcggttgcgcgccacgtcaaggaagcggtcggtacgacgctcggagatagaggctacgtcggcggtcggaatcgccaggaaatcgagcacataggccagcggcgcgccatggaagttgccgttggactccacacggccgtccagcgtgacgcacgggttatcgatggcggaggcgagttccacgcccgccacggaggccgcgtattccacggtgtcgcgggcggcgccgtgcacctgcggggtgcagcgcagcgagtaggcgtcctgcacacgcacggtggagcccgggcggccggcctcaatcagaccagagtccttgagcatgcgggcgatgttcgcagcggaatcgccttggccgcgatgcgggcgcagcgcctgcaagtcggcggcgaatacgcggtcgttgccgagcatgccttccacgctcatcgcggcggcgacatccgcggtcttgagcagcaggcgcagatcggtgatggccatacacaacatgccgagcatgccgtcggtgccgttgaccagcgccagtccttccttctctttcaaatcgacgggcgtgatgccggccgcacgcagcgcttcgccgccgccgatcttgaggccgtcagcgttgcgggcctcgccttcacccatcgccaccaaagcacaggctgcgagcggcgccagatcaccggagcatccgagtgaaccgtattcgtagaccaccggggtgatgccggcgttcagcatatcggcgtagacctgcgcggtttccgggcgcacaccggtgcgtccggtgcacagggtgctcaggcgcagcaccagcaggccgcgcaccacctcacgctccacttccggtccggcaccggcggcatgcgagcggatcagacttttctgcagctgcgcgcgctgttccttggggatggaagtggaggcgagcgcgccgaatccggtggagatgccgtaatgcggcacggtgtcgtcggccaaatgatcgataaccgcgcgactcagcgccatctcatgcttcgattcgtccgaaatcgccactttggcgccgccgcgcgctacggcgataacgtcctcgatgctcagcgctccaacacctacggtgaccgtctgctctgccatgctcatacctttctatatacgtgccgcattccgcatatacggcatatgcggcacatgcttcgccggggatccgcgactgcccgcattcgctcaccgcacctgcccaccaacagcaggcgacgcaaacgcgaccaatcgctccccgagtaatcaaaccttggccatttcacctcagtcggatgcccgccataagccacttcgtccatcttgtgtctgaaatctcagacatgtaaggtgatggaaatatgagccatgcctcgcagcaatacgccttcaccgagccacgtaccgtcaagcgggcgcaggtgaagccatcagaacgggaacatcagacatcatcatccgcgccacgtgtctcgctggctccggcggccgaccgtacgctcgacatcctcgagttcatcgcgagcaatggtcagacgcaagccgccacgctcgctcgcgaactcggcattccgcgctccacggtgtaccaattgttggagattttggagcgtcacggactggtcacccgccttgccgagcagcgcgcgtacggcatcggactcaagactttcgagctgggatcggcctattctcgccaacatcgtgtatcgcaggtcgcgcatccggtgttggcgcgtcttgttgacgagaccggcgaaaacggacatctggccgtgctgcacggcaacgaaatcatttatgtgattgaggagcgcgccgcgcatcgcccgccgctagtgtcaggcgtgggcgtgcgcctacccagtcacctgaccgccaccgggcgggccattctgtccgcactcccccgcaatcaggtccgcgcgctatatcccaatcgtcaggcgttcaccgaccgcaccggcatcggccccaaatcgcccaaggagctggaggcaacgctcgccgaaacccaacgcaccggttttgccgaggaacacggagacgtgacgcccggctttgattcatacgccgtcgctgtgcgcgactacaacgactttcccatcgccgggctggctctcactttcgtgagcggatcgctgcgccccgaacaggagcggtcgcttaagaccaagctgcggcttgccggcacggaactgtcccggcgtctcggcgcggtcggcagtttgacatgaggattcgcgagatcatcgtgctgggctccttcgccccgatcacgattttctcaactaagttcaccgattcgctgaccggcaacgccaaactcgccggcttctcgctgacagtgacggccatcatcagcctggtggtgatgaccgccctgcacgcacttctgccgggagcgtaaggcgcgttcttggttccctcagtcagcttctccgcctggacggttcccctcagagaggggagccagaacgagtcacgcccgaacgattacgttgcgcagatcaccgatgccttcgacgtgcacgatggtctcgtcgcctgggtcgaggtggccggaggcgttcggggtgccggtcatgatgacgtcgccaggcagcagcgtggagaacgacgaaatggcggcaatctgctcggggatgccgtgaatcaggttcgcggtggtgccagacgccatcggcacatcctcgccgttcagcgtgaaggaaatcttggcgtccttccagtcgaggtcgtcacgcatcacgatccacgggccaagcggacaggaggtatcgaagcccttggcgcgcgtccacgtggggtcgatgccctgcagatcgcgcaacgtcacatcattgacgcaggtgaagccgagcacgtaatccatcgcgttctcgacggtcacgttcttggcgatacggcccatcaccacggccacttccggctcgaagttcatgtccttggagcaggccgggtacacaatcgggtcgtcggggccgattaccgaggtggacggcttggtgaagatcaccatgtcttccggcgcgtgggcgatttcggagtggccggcctcgtgcatgaactgggcgtgggcctcatagttcttggccagaccgtaaaccttggaggggatgaccggggagagcagacggatgccatcgccgtcgaccgggtaacgagtgccggtgggcttgacctggtcgccggccagcggatggccgtccagttcgatgaggtagtccttgccgtccgtttcgtccttctgcacgaaggcgtagcgcggcgaatcattcaaagaaaaacgtgcgagtctcatgcctgtaagcctactccttggcggttccttccgcagaagcatccgtccaaggagcaagcagaccggccttcaatcgaccaaaacgcacgttcgctgggattgctacttttcggtccaggttttgtcatacagcgactggccgctttgcgtgtgcatgatgacgcgcaatgatgccttgccgctggaggtcttgcacatcgagcccagcagattcgcggtggattgataggtgctgtccatagcatccagtgaggaagcggcggtatcgcctagcgaggcatagctgtcgtcgagcacgtactcgtacaccaaggtgtcaccgtcgacacggtagttgaaggtgatgccggtgtctgcaaacgtatccgcttcggattcaatggagtccttgaattccaaagagtcgacgaaatcctgaatcgaatcgtacagcccataatcgccgtcggttagatcgtcatgggtttcgcccaacgtgtcgtccagcgcatcgtcaagattatcttgagctttgctcttatcgctgctatcaccgttgcccgaagaggactgactatagaaggaatcggttttcgcctcatctatagccttgctggtgtacgagacaccgccgacgatcagcgcgatgaccagtattacctgtatcaccatgcccgccgcactgatgatgatgccggcgatggccaagcccttgcccttgccgccctgtttcttaatctggttgaggcccacgatgctcaggatcagaccggggagtgagacaaggaacgagcagataaaaccggcaacagccaggccgttgtacttctggttcgcttcaggcggcacactgccgtaagaaccagaccatcccggctggccgttcggttggccgccttgcatatacgggttatagggcgtttgcggaggcacggccccgccgcccggatataccggagcactaccgctgccatagaccggaggaaccgatccgcctgccggagccgcccccggatagggcgaattgggcgctgccgatgcgggcgcgggcgcagcggcaggagtcactggtggcaaagcctgcgtaggcggtaccggctgattggccggcgcaaaaggctgggtgggctgctcggcaggtgtaaacgcctgcgtaggctgttcaacaggagtgaacgcttgagtgggctgctcgcccgctgcgattgcttgggtcggagcattgttggcggcggttcccgtttccgccgtcatcgcatttaacggctcagtcggattggcgtcagcttgctgccacggcacctggctgttcggattgacattcggatcagtcatgacatgcactccttcaactgcatcgcaccccacttgcgagatgcgcccctcgtcttacgcgccacattgtgcgttacagacaactgtactcctcgtggcgagccttaagcaccccaggaaatttggcttccaaaaacacaaaagcctgaaaccggctattgcctcagcaatattcagtcggtttcaggctcaatcgttaatcctctggcgaaacgacggtctacttcttcagtagcggtgcgacttgctcctcgtaagcggtcagggcggtgtcgatcacgttgtgcatgtcgtagtacttgtacgtgcccaggcgaccgccgaacacggtgttcggctcggccttggccttggcctcgtactgggcgtacagtgccttgtccgcatccgtgttgaccgggtagtacggctcgtcgccacgctcggcgaaacggctgtactcctcccacaccacggtcttgttcgggttctgggcatcgtggcgctccgggttgaagttcttgaactcgatggcgcgggtgtagggtacgtccgcgtcggagaagttcatcaccgggcagccgaagtggtcgccttcgtcgtagcgtacttccttgaagtccaccgtgcgccacttgaggtcgcccagctcatagtcgaagtaacggtccaccgggcccgtgtacaccaccggcacgcccgcggccttgagcgcggccttgttgtacggctgggactcgtcgaagaagtccacgccgagctccacggtgatgcgcgggtcgtcgatcatgcgctccatccacgcggtgtagccgtcggcgggcaggccctcccacgtgtccttgaagtagcggttgtcgtagttgaagcgcacgggcaggcgcttgatgatgtcggccggcagctcggacgggtcggtctgccactgcttgccggtgtagttcttgatgaacgcctcatacagggggcggccgatgagctgaatgcccttgtcgttcaggttggccggatcggtgccggccagctcgcccgcctgctgttcaatcagggccttggcctcggccggcgtgtaatgcgcgtggaagaactggttgatggtgcccaggttgatgggcagcgggtagacctcgccgtcatgggtggcgtacacgcggtgcacgtagttcgtgaagctcgtgaaacggttgacgtaatcccagacgcgcttgttggaggtgtggaacaggtgggcgccatacttgtggatttccgcgcccgtctcctcgtccatatacgagtaggcgttgccgccgatgtgatcgcggatatcgatgatgtgcacgcgggcgccggtgtgctccaccgcctgctgcgccaccgtcaggccgaacaggcccgcgccaacgataacgagatcgggatactgggtggtttcggaattgttcggcgcaccggccatagcaagcaacctttcacaggtcatgttcgttttacgaaagaccatgttactcggccaggagaaaatcaggcaatacgataaactatccgtctgcgcagctcggctaggaaacgtgccatactggatacgtccgcatatacaaagaggaagcacaagccttgccaaacaacgccattcccctcatttccgtgatcgtgccggtatacaacgccgaagactacctgcgctactgcgtggattccattctgcagcagtcgtatacgaacctcgaggtgattctggtggacgacggggccaaggattctagcccggccatctgcgatgagtatgcggcgcaggacagccgcgtcaccgtgatccatcaggaaaacggcggcatcgccaaggcccagaacaccggcctcgatgccgcgcatggcgagtacatcgcattctccgacaacgacgatatcctcgaccgccgcaatatcgaatacctgctgcacgcgctgcaaagcaccggggcggatatgagcaaagcccgctggcgccagttcggcgtctcccagctgggagaggtgtccaaagaggccgaagcaggcgcacaggcgcccggcacaatcaccgtgttcgagcatccgctcgccgcctaccagaccgtgttctgcaaaagcctgcgactgctcggcagcaagctcggccgcaacaccgaggcccgctacttcaacgaggcgaactggtgccgactgtacaagcgcgagctgtgggacggcctgcgattcccggagggccattacgcgcaggacatccgcatggcaggccccctgtacgcccgcatgggcaaagtggccgacatcgattgcgtgctctactactggcttcaggagcccggctcggtgacgcactcaaaacgaaccgccgcattctggcatgataacgtgctctccgcagccgaaaacttccagttcactctggagcaaggcatcaccccttgtaggaactacttcggcttgaccgccagcgtacgcgacgaaggaaaaggtctcaaggcgctcggctccgaagaactacatgacagcgactggcaaaaccatctcgatgacgtggccaccatgcgcgccctaatcagcaagctgagcatcggcgaacgcctgaaatgtgcagtgcttgccacgattcgctcctgcgaaaatgtggtatacgataaccgcatccactctatgaagtagaaaagtcaccgaatccagtaaacccctaccctcagttggctaggacgcgctggcgtacgtttctgtcatcgactacgaccagtcccagcaggaagaccggcaatatcggaagtacataacggccttggattccctcaaagacctcaaacctactcattgacgctagatcattccaggtcagtcccacaaagagcacaaacgctgctatctcagcagccgctattacgagagccagaatcaggaatcgatgtcttcccacccataaggctggtgtcatccgacccgtccagtgctgcttcaccgtatagaccgatgccgccagccaagccaccatcagaacagccgccattgcgacataccaagtcggcagataagcaaaagtcccgagaaatagcatggaatgtacgattttgccgatggtgagtgccggatgagacaacgcgacactcacattatgtgatacatccacctgcgccaacgaactgccgaacagcacgctccacggaagatacaacgctcccgtcagaaccgccgcaatccccacaagctccagcttgcgacgtacggtcattaccgcagaaggtaggaacagtaccgcgaccgacacaaacgcatagggaggtttttcacacgctaaggcccacgccagcacccccaataccgcagtgtacggaagagaaatcacacgtttgccctcggcagccacagcgatagccgccaccatgcaggccgaaagtgccacaatcataccgtcaatcatcaggctcgacgccacaaacgccgctggcggaataaccaacaacagcgccatcagcgatttccaacgcggcagcagcgcaatggcaatgcaccccataatcgcatacagaatgctgttggatattcgcgccgcctgccactgcgcgtacggccgcaagttcatcagcatggcgattttcaggccaatggcttggggcaagtaatcaagcggaaaatacgcgttagagcgattggtgtgtgtcccatccggcacaacgatgtgatcagccatcacatcatcagcactttgctgcgtttcccgcgacgaatcgccctgcgtcgccctactgattgactcaacaatcagaacgttcgcgaatcctggaatcgtcagcaaacgcgaatcaccctcaatggactgttgcttgacggtgttgccgtgcgcatcctttccctttgcaacaggattcaacgattgtcctgtggccaatgcgtacgtggacaacggatgcatatcaggatctggaatagtgagagggccaacctagacgatgaacatacaggcctgcagcgcgaacaacaccaggaagataaaatattgcacgcagtccccttcaagacatgtgccacatgcttcataacgccctaccttccggtcattcgtccacagtctaccgcacacacaccgcaagggcctaccaatacctggtcaatcccaacataattcgccacagcacatttagggatgactttatcttgggcttcattattacaatactcaagtacgttgtttatagaaatgagcgagcagagtgaacgacatccaaaacgatcaggaaccttcagcgcaagagtctggcacggatatgggaaaaaccgaagtcccagccgttccctcaaaacagaatgacgatcatcagagcaacaaattgccgctgcttttcgcgttgaactttagcatattgatggcttcaaagcccatggtcatgctggccaaagccatatctttcttgcacacactattgaagaagcgcccccgctgcccctacacgttgtacgtagtggtcatggcaatggttgacgccgcagcagtgctgttcatccaatggagcatgtacgaggaacccacatatgccgatccggatgcagtagatggcaccaccaaaatgttcaatagcgtggctgggcagctgacgaaattcgttgcccagatgtggatggaacacaactacgtctggctgctcaatttcctagtgctaggcatggtgtacctcgtactggtattcgttttgaaccgattctgggtggcgaccgccctattctccattctcacgtcaatctacgccgtggcgaatagcatcaaggtcgacctgcgcaacgaacccatcatcccttctgatttggggttcctctccagcggcaacggtggggaaatcacatcattcatccctaaagacagccagccactggtcaacggcaccattaccatgcttatctggctgactattatttgtctggcattgcagcttatcgatggtcgccgctgcgtgattccgttccactggtggcacccattccgcaatgtcaagaccatcatcggcaactgcacacgcatcatcgccgtagtactcagcgtttctctactgtggtcattcacttggaatctgggaatcaacggctcatggtcctacaaatgggcaaagagtctgggcgacaatcccctgctgtggagcacggttgttgacgccacctataacgggccaaccgtgggctttctgcggctggcacacgcaaaaaccatggataagcccaaggattacaacaaagagaccatggaggctttggctaaacgttataaggaaagcgcccaagccactaacgaggcacgtgccaataacctcaccgacagtactgtagtcatgattctttcggaatcattctccgacccaactcgcgtgccgggagttgaactcactgaagatccgatgccgaatattcacgcccttgaaggcattaccacttcaggcctgatgctttcgccgggcatcggtggaggcacagccaatatcgaacatcaggcattaacaggccttagcctggcgttgttcgacaattccatgcaatcgccttatcaggagcttgtcccgcaccagaaaacgccttatacgttcaaccaaatatggaatgatgcttacggcaagaatggttccgtggcgttccacccatacttcaagaacatgtatctgcgcgatagcaactacaagaaattcggtttcagcaagttgtattcgcttgatagcgaccccgcaatcgagcatcaggaccatatcgacagttcgccatacgtgagtgatgccgcctcgtatcagaacgttcttgattcaatcaacagcaatgatcacacccagttcattcagctggttaccatgcagaatcatgcgccctacaatgatttctacgcggacaaccagttcaaagaagccgatgtttcccaactctccgacgaagagaaacagtctatcgataattacgccaagggcatcagcctcaccgatcaggagactgcggactttttgaaccagctcaatgcagtcgataagccagtcaccgttatcttctacggcgatcatctgcccggcacctacagcaccgcgaccaaagacaagaacaatactcttgtcatgcatgagaccgattactttatatggtcaaatcaggcgtccgcgtctgccggtgtcaaactcgacccgcagaccgccggctatgtctcatcgaactatttcatggctttggctgctgaacatatgaatgccaaggtgtcaccttatctggaaatgctgacgcaggtgcaagcgcagattccggcaatcagccgactgatcagctccaacgattcctggggcgatggcagcaccgcctatctggatgctgaagggaaccgcgtcaagcgtaaggatctctccaaggaagccaagcaactactaaatgattaccgtctcgtgcaatacgatatgagtaagggtaagggctaccttaacgacgatggattctttgcagtcaagtaagcaaaaggggcatcagacggttgtccaatgccccacgaatcgattacttctctcgaacccaatagttgcctgatgtacgagacaggtttggattgtaatacggatcgttatctacgatttcggcatacttcttgcggaatttcgcagattcccgatccagtcgagccttctttttcttgctctcgatatcgtacccgcgcgtgacggactcgtagtggtatagctccacctcatgcgcccacacgatgtcacgtccaagctgttcgtgaatccgaatgcacagatcgacatcgttataagcaaccgccaaagcctcatcaaagccatgtaccgcgcggaagtcatcggccttcaccatgcagcacgccgccgtgatggcagagtaattgacgttttcgatgagtcggccgaagtagccaaaatctccacgggggaaaccgacctgaatgtgtccagccgctccgccaagaccgagcacgatacccgcgtgctgaatggtctcagtaggatagtacagctttgctcccacgacgccgattcgatccagctgcgcgaacgacaccattctggtcatccaagatgggctgatgacttcagtatcgtcgttgaggaacagcaagtaacgaccggaagctttttgagcagctatattgttaatccgcgagaagttgaacggaatgtcaatctcttccacacggaaacgatcaccaagtttcttggcaaaacgctcgtacaaatcctgcatatgcgggttgtcgctgccgttatcagcaatgatgatctcataattggggtagtccgtcttgtcaataattgagctgacacaacgttcgatattgtcgtacccgttcttcgtcgggatgattaccgacaccagctcgtcgccggagacatcgtaatgcacgttataaatgccattcggaccggcggaaaccacttcagcctgaataccgcgtctctcaaccgccgactgcaatgcgcgcaaaccagcgtcggatgtgtagctcttggcactgccgctggatgcggtagaggttgccaaagtgcgccaatggtagagtaccttcgcgatgtgctggatgcgatcaggggtggttttttctacgaagcgaagcaccagatcatagtcctgcgagccctcatagccgactcggaaaccaccaatctcatctacgatgctcttacggtacacaccaaaatgactgatgtagttggtgctcatcagcaaatcgggagaatagttcggcttgaaatgcgggtcgaagcggttcccctcttcgtcctctttgtcttcgtcactgtagataagatccgtgtccggatgctcattgagggtcttcactacctcaaacagtgcctggggagccagttcatcgtcattgtcaagcagaccgacgaactcccctgaggcctcttccaaagccgaattcgttgctctggaaatgtgcccgttttcagggcggaacaccactttgatgcgagaatcctgttgcgcataccgttcaagcagcggacgcacatgcggctcggacgaatgatcatcagccaggcacaactcccagttggaatatgactggttacgaaccgaatccacacacttttccagccacttcggctccacgttatataccggcaccagcagcgaaatcaacggctgatacgcaaacgaggcaatctcattgcgcactgccgtctcgtcgtaacgctctgttcgacgaatgaggttatggtacacgtgcttctgccaacgagggccccaatacttatccagcagacgccttgtggtacggcgaggatgccccagcagtgcgaccttgcgcaagaagttcgacaatccggcaagaacggacgacgactgaaccgggatgatgacttcctgactatccgtagaagtcctcaggcgcaaacgcagcttgtcgttcgccagttgcttacgcccgcccggtaccgatatttccgcacggaaaccaaggatcgaatccgggggaaccgtagttattgcattcacgtcaggacgaccgtaacggctcaggctgcgcaaactcgccacaggggattccaccagagagatatcgacctgttcaccgccgtgtatatcggcagcccatccgttaacgagcacagtagatccatcttgcttggcatccacctgatcaaggttgtatacaatgcctcgctgttcctcggaagcaggcgggaagcatgcagccgcaaacggatcaacgatctcgcgatgcatcttcagatattctgcaacgtcatccttattgattgacaagtgagtacgcttgcaatccgtgaaaaccgaatacggctcccaaagcacagtatgaccggactgctgatacatgcgagcgcaatagtcaataccgcgcagtcctgccgccaggcgcgtattgagtccgccgatttccacgaattccttgcgacgtaccagcatgcaatcttccgtggccgcgaacatgtcacgaggaagcagatccctgaagtagtagccgattccttcatcccaggaaccgcgcatttcaaaaggctcaccttgtttcaatgcccgaagggtaacgcccacattgagcacacgcttcttggcgtcaaataccttgccacccacaacgccaacagaagagggacgcgcataattcaccatttcgcgtagccatgtgccatcggtcggcttcatgccgtttaacagcacaatcaaatcttcggaacgacgctttgccacatcattcacggaatccgctgcagcagcaatcacagtgaacgacgggtaatccgtcatctctcgtagctgcttcacttgcgcatcagtcagagaagaagcaaccaccgcaaccgtcggggtgtaatcggcatagtcaatcttatacgtaccgagattgtcgagcattcgcacgtcaccggctattcctcgacgctccaaggccgcttcgattgccttgcgaccagcctcataggcatacatcttgcttcgggggtctccggccacagagcttgcaagggtgcgccagtggtacagcatctgcggaatatgatgaacgtgatgtgcctgctcggtggcacgcagcacgaagtcataatcctggctgccgtcgtattcgctgcgcaatgcgccaaccttgtccaacagcgcacggctcactaccacaaaatgagtgatgtagttatgccccagcaaaaggttcggcgagtaattcggcttaaagaacggatcaaagcgcttgccttgctcgttgatcttgtcttcatccgaatacacgaaatccgtatcgggctggtcattcagcgcacgaacgacttcaaacagcgcctgcggtgccagttcatcgtcattgtccatgaaaccgacgtaatcaccggtagcgagttctatggcagaattcgtcgccgccgcaatacgtccgttgctgtcacggaagacaattttgatgcgcgaatcgctcgcggcaagctcttccagcagcggcttgacgtgtgcagaaggcgaatggtcatcagccaggcacaactcccagttggagtaccactggttttgcatggattcaacgcatttgcgcagccagacctcgtccacgttgtacacaggtgtcaccacagagataagcggagtcttggaaaatgcggcaatgacaggctcagcttcttgctgggtcatcgtttcatagcgctgaatccacgaatcgtaaaaatccgtctcaccaacaacgcggcgtttcaccgcgtctcgcaaatccttcatcgcctcgcgattgccaaggtgcgcggcataaaacatgagcctgtgcacgcgggtgctgatgtattgcatgcggaatcgactcatcaaacgctgaacattgatgtgccttgtcatggtcgtgccaggcgcctgacacatcaagtcgaaattctgcactccctgaggaataacaatcgtgaagcctgcttgatcactgggatccaatccatacgtcttttccagatcaacacgagtattccgcgataccgtcacacccatgccggctaccgccaacggcagggaggtctgcctcatcttgtcgaccgcccagccggtcactatagtccgagactgttccccaaccttgacgttctctactttttcgactgttacctgatatgtacgatcattcaacagcgtcagcatgcttgttctgtccttatcatctcagcagacgaattaatcgattgtcacttgcaccgtattgtccgggttcaccactgacatcacttccgaggcggatcccttgatgtggaatctgcaggcattctccgccaactgcaaacgctcagagtccgtctgcagagcaatacagatgcggaaatcgccaaatgcgagcacattcttcaccgcaaattcggccgtatgcttaccggctgaaatcttatcgtcctcggagccaaacggcatggaaagcacgggaacattgcggccatcaaacacatcgatgaacagctggttcgcaggaaccggacgatcgcattcgaagtcaacattcatggtgaagtcctcgcgcgtatccaggaatttctgcgtctcgccatcgacggcaacgtttacggcattcacggtcacggcattgcgaatagccgcttccttttgctgtgcctccactacttcgcgcgggggaaggaacgaatccgagtaagcatcggcaatctcgtcagggtcgccgatcttcgcaatatagccgtcctgaatgagcattgcccgatcgcaatacctgcgcacatccggcatggagtgggtgaccagaataaccgtcttcttgttgcgcttcgcctcaaagaaatagttctggcacttcttctggaaagcttcatcgcccacggcaagcacctcatcaagaacgaggatgtcgccctgcgatttaatcgccacagagaatgccagacgcacctgcataccgctggagtagttcttcagcttctgttccatgaagtcgccgagctcggcgaactccacgatgtcgtcatacatggcatcaatctcgtcgttggagaaaccaagcatggcaccattgagatatacgttctcgcggccagtcagttcaggattgaatccaacacccaactcaatgaagggcacgagtttgccgtccacctcgattgtgcctgtattcggcgtgtaaatctgggaaatcagtttcagcagagtggatttaccagagccgttcttaccgacaatgccgaaaaactcaccttgcttgatatcaaaggtgatgtctttcagcacttcctgcgtacggtacccgcgaatgccgcggagccaattgaacagcatgttcttcaggctgccagcacgttcaaccggaagtttgaagttcttggatacgtgctccaccttgagcgccaccggtcggtcagcgttcttctgctccatcgctttgtccatcttgttcatcgtcacaccaactccgcgaagtactgggatttaacggtgaaatacttcaaaccacccaagaagatcagtacagaaagaataatcggccagcactgcaggaatgggttatccacccactgccaaatggtctgatttgcagggctaatcatcacatgacgcgcatcctgaacgatttgcgccaccgggttgagaatcagatcgagccgggcaaatatcggaccatactcgcccgcctttgaagtgataagggaaatagggtagataataggcgtggcatagaatccagcctgcattaccacttcccagatggggttcaagtcacgcagattgacatacacggcactgaggaagaaagcgattcccaacgacagcatatacagctcaagcaccagaggaaccatcagcaaccacgaccaggtaagactgacgccgttaatcagagcaaataccactaccacaacaaaattgatgccgaagttaatcatggcactcatagatgaggcaatgacaatcacatacttcgagaagtgaatcttacgcagcagatcaccgtgtcccacaatcgacatcatgccgccggtagtggtttcattgaagaaattccacatgatgatgcccagaagaagagccacagagaagtgcggcacatcagcaccgaacttcaggaatcggacgaacacgagatacatgatggtgaacagcatcagtggcttgagcacagaccagatgtatcccaagaaggactgctggtagcgaagcttgaagtcggtgctgaccatcgccttcagtaataggcggttcttcctggtgaagatttccgtgatgttcaaaattgctcctcaaatacaacaaacccgcatattttatcagcgcggactaacaatctatgcgggttttcagtgaaggtctatcgatccatcggtttgacgatgaacttattatccgccacatccttcagatgcttgccatacgggctcttgccgtacttcacagcggcctccatcagctcatcacgagtaatccaaccgttctcaaaagcgatctcttcggcaacggcgatcggcaggccctgagcacgctgcacggtgcgcacgaattcgcctgcctcatacagggagtccatggtaccggtatccagccaggcatagccgcggccaagcgtctgcacgttgagggtgccgtcttccaagtacatcttgttcagatcggtaatctccagctcgccacggggagacggtttgacctgcttggcgaactcggtgacgcgttcgtcgtagaagtacaggccggtcaccgcatagttgctggccgggtgctccggcttctcaacgatggagatggccttcttgttctcatcgaattcgaccacgccgtatcgctcaggatcgtcgacgtagtagccgaacactgtggcaccatgttccaccgtggcggccttgcgcagtgtcctgcccaaaccgttgccgtagaagatgttgtcgccgagcaccagcgcgcacggctcaccatcgatgaactcctcgccgaggatgaatgcctgggccaggccatccggggaaggctgcaccttgtaagagaagctcacaccatactgggagccgtctcccaacaaacgttcgaagttcggcagatccttcggcgtggagatgatcagaatgtcacggatgcccgccatcatcagcacgctcaacgggtagtaaatcatcggcttgtcatacacgggaagcagctgcttcgaggtcaccgtggtcagagggtacagtctcgtgcccgaacctccagcgagaataatgcctttcatgaaaaacctgctttccacaacgttttactcgttattcgtctacaaacgtattcagcttagctaactcttattcaaaatgaaaaaccgcgcagagagcctgcgcggttttatcacttgaggtcaactgttatgaacaactatcagccgagttccttctccacgtaggtcttgagggtctcttcccagtcggcgggcacgtatccggcttcaccgatcttggcaagatccagtgcggagttgaccggacgcggagataccgggttggtcgcgttcgcgaagtattcggcggtgctgatgggcttgaccttgctgccgttgccgttcgtcaggtcgaacacctcggccgcgatatcagcccaggacttcaccgcaccggaaccggtcaagttgtaggtgccgtagggggcgtggctatcgagcaggtggaaaatcgcctcggccatgtccttggtgaaggtcaggcgaccgtactggtcgtccaccacggtgacctgatccagcttgtcggccgggtcggcgaccttgttggacagcatcatcatggtcttcacgaagttgtgcccctcgccgatcacccagctggaacgcaggatgtaatgctcgggtgcgttggccacggcgatgtcgcccgcggccttggtctggccgtacacaccgagcggggcgaacgcctccgtctccgtgtgttccttggcggtgccgtcgaacacataatccgaactcacgtgcacgagggtgatgtggtggtccttggccaccttggccagcagagccggaccctgggcattcgccttccacgcgatcggacggccttcggcggtctcggccttgtcaacggccgtgtaggcaccggcgttgatgatcgtgccgtacaggctccaatcgtatgcctcgtatgccttcgggtcagagaagtcgaactcgtcgatgtccgtgtactcgaagccctgaagatcatgggcctcggcgtaggcgcgaatcgcgtggcccagctggccgttgcagcccgtcaccagggtgcgcttgggagccatgggcttggcgtccttgagcatcgggtggtgcagatcggcctcggagcgctcggactcctccagcggaatcggccactggatgttcagttccggatccgcaaggttcacgaacgtgtaggtcttcttctgttcgagcgaccagtgcgcgttcaccagatacgtgtacacggtgccgtcctgcagtgcctggaagctgttgcccacgccgcgaggcacgtagattgccttggacggatccaaacgggtcgtgtacacctggccaaagctctcgcccgggcgcaggtcaacccacgcgccgaagatctcgccggccgcgatgctgatgtacttgtcccacggctccgcatggataccgcgagtgacacccttggtggcgttgtagctgatgttgttctgcaccgggccgaagtccggcagacccagacccatcatcttggcgcgctgccagttctccttgaaccagccgcggttgtcgccgtgcaccggcaggtcgaacaccagaaggcctgggatgttcgtcttctcgaccttcagttccttctcgaattcaaatgccatgatcgaatcactgtccctgttgcttgtacttggcttcggtggcggccttggccggctcccaccaggcgcggttgtccgtgtaccacttgatggtctgctccaggcccttctggaagtccgtgtgcgtcggcttccagccgagctcggtctgaagctttgtgctgtcgatcgcgtagcggcggtcgtggccgggacggtccttgacccagtcgaagtcgtccgggctcttgcccatcacggtcaggatgtcgcgcagcaccgtgatgttgttgcgttcgccgttcgcgccgatcagatacgtctcgcccaggcgccccttggtcaggatggtccacacgcccgtggagtggtcgtccgtgtggatccagtcgcgcacgttctccccgttgccgtacagcttcgggcgcaatccctcgaggatgttcgtgatctgacggggaatgaacttctccacatgctggtacgggccgtagttgttcgagcagttggagatggtggcgcggatgccgaacgtgcggtgccaggcgcgcaccagcaggtcggagctcgccttggtggagctgtacgggctggacggatggtacggggtctgctccgtgaacttcgccggatcgtccagggccaggtcgccgtacacctcgtccgtgctcacgtgatggtagcgcacgtcgtacttgcgggccgcctccaacaggcggaacgtgccctccacgttcgtcttcaaaaacggctccgggttcgcgatgctgttgtcattgtgagactccgccgcgtaatgcacgatcgcatcatgacccggcacgattttgtcgagcagctccgcatcgcagatgttcccgtgcacgaactccacacggtcgcccagaatggacttgatgttctccaggttgcccgcatacgtcaacgcatccaacaccgtcacatgcacgtccggatggttgttgtacacgtaatgcacgaaattcgaaccgataaaaccacaaccaccggtcacaatgatattatggggagtaaacaattcttcagccataacttacagcataccgtcaggcataccgagatggcgagcaatcgggaaaagatactgctactattgctgaattatccgatacggagttcgtccatcaatcgtttcgccgatgcgttcaaacgagtacccgtcgaactgcatctcgtccagcttctggggggaaagcacattgttcaccccgagcttgcgcaattgcgccggcgtgacatgcacggtaaacgaatcgggcgataccagggtaaatacatccgccgcttcttgttccaccacgttcacggaaacgaatgcataccggttgtatatctcttcccatcggccgttcggatccagtttcttccacgtggcaaggtcaggtgtgacctccaacgcattcagcgtgtgcactccattggccaccgcgagattcgccagctgggagccgaacgcatcatcgatagcccacataccttgatacttggtctgcagcgactgcacctgttgcatcaacggttgcttggtcaggggtgcgctgccatactgtacgggattcacggatagtcctgataccaataatccgatggatacaatcggtgccacaacagtacgagcaattacgccattgctgagaacagcaaaactcagcagacccactatgacgaaacacaccataaccaatagacgcccgatatacggcagatacatcccatgattcgtccacgccagtactgcggcgaacacggaagctgccagtaacgactgcttccaagaaagcccaccctctgtaatagccaccgcacgaaccaatatggcaatattcgcaacgcccaaaaccaccacgcatcggccgctggtcacagaggtcagcatcaatattttcgagagccacagcggcacgcccacacaggcgaatattgagaacaacgcgatgaccgcaataagacaaacgctgagtatgtcaactttcttccgcttgatcatgccgaagagagcaaggattattccgagcgggaacaaatccacaaaacgcgatgcctcaaccatattggttgccgcagaatcaacggcataatccttgaacgggaaaaagagagtgcccacggacgatatcagcgatagagggggcaatcctcctccagtggattgcctcgcacccggatatgccgtgtgcagcatggattgaatcgtaccccatgaagtcataactgcagaaccgagaattacacagaataatgcaatttcgcctaccaaaatcacgacatcttttcgagaaaccctgatttgcccccagtgccgtataacgacccaaagaatgagcactgcgagaagatagcccagcgaaatctgccatgcggggtacaacgtcagcgcgaacatccctgcgcatatcaggatcactgcggcatatgcggccctatggccggtttcagtgtcaccaaggtaccggtcaaagcacacgatggacacgaatatcgcgataagcatctcaggcaacgcattgaccgcaaaccaccattgcaccaacggggcacatgcaatgaggatggcgccaacgaacgctacacccttgtgcttctcctgccggtgatcattgctgatgcagaggaagaactcatacgcggctaagaaaagcaccactaggcgcgcagaccaataaaaagcaagccctcggctactgccaaagaggatatacccccaatggaatggtcgaaatatctcggcgagagccagcacaggtgcatctttgacgatgaacatgtccgccggtttattgccaaacaaatcattaaagtagctatacccggagtagctttgcgaaaaagccagaggagtgcccaccacatattcgtcggttcgtattatgcgcgggattccccacaccacgtccgtggacatgtcatgccccagccagtaattccacatgcctaaggatgagccgttgacattgagaatgaccgcaaaaagaattatgccgcaaccaatcgcaaaacgatacctatgaactatatgcccgatggcacgaaaaccatataagaaacaaaaccacagaagtagaaaaggtacaaataagaccaatactcgtaataaaacgatgtagacttgcggagcgacaccaaaggtaagcttaaaaatatgctgctgtatgattggagcacccagtgcgagaattatgctgcacgccaatgcgcctataatggcaccgaccaatttcctccacctgacggaacgcactaaggtttttcttttttcagccacaatacttaccatcagttctcctcgacaacagaaaacatctagaacatcctacaaaaaggaagcccgtcatgcacatataccaccttcctcagcaggtagtgctcgagtttcttgtgcactttgttcctcgccagtccctgtggcgataatcagttcgctgtctgtacgctctcatcgaaccttgacatgttgaggtagcatcgtgtcggtcactcgttggaagtcacgtaacgcgcacatatgagcatcaacgtgctccgtccgtcgagggagctgctggccccaccgttttagtcaatccggtgtttcgtatgggagtctcgtcttgtctaacgacaaaaaacgcgcatagggcataggacacgagtcacatcctttcaactcaagctcagaccaagtgcacaaaatttcagacgttagggggtgcggacggaaagttggacgcttgggcgtccggattggagtccgcatgttttcgatggaggatcggcgcagggccgttgacctgtatttcacggagagcatgaccatcaggaaggtcgtcgccaagctcggctacccgtccgagggcgcgctggcgaaatggcttcgcgaggacccgcgctacacgggcgcgtgcaggcgttcgtatacgctggaatgcaagacgaacgcggccagacgcgcgctcgagggcgagcccctcgcccgtgtggcgcgcgacgcgggctgcacgccgacgagcgtgtaccagtggatgcgccgctaccggagcgaggggatactaggactgatgaacggaagaaacgcgccgatgccggccgaaccgatgcccacggccggcgatgacgtggaggagctgcgtcggcaggtggaggccctgcggttggagaacgcggtgatgagggagacgatcggggttttaaaagccgacgactgtgttgggggtggtgccgttttcttggactgtgatccgaggaggagacggccatggcgaagtacacgagggaacagcggcaacgcgcggtcgagttgtatgtgaaatacgagtgctgcgcggcggatgtgatccgcgagctggggtatcccagccgggaggcgttgcgcatgtggcaccgggactggcccgacgaacaggagacgggcgtgtcctcgcagcgtggtgaacggtatgcgcgctacacggaggagcagaagcgtgcggccgtggaccattatctgacgcatgggcggcgtgcgagccgcacgatgcgtcagatggggtatccgagcaaagaggcgcttgcctcgtggatcgacgagctcgcgccgggcgaacgccggattcgccgtggcccggttcccggggaattgaaacgggatgcggtcctgaaggtcgcgtccggcgaattgagttcgcgcgaggccgcggaggcggtgggtgtggattcgtcggtcgtgcgaaactggaagcgtcaactgctcggagacgcgaaaggactcatggtgacgaagagggaaccggaacgcggggattcctcgcagcaggacgatccggacgcgctgcgcggcgagatcgccacgttgcgcgccgacctcgagcgtctgcgcgccgaacagcgggccatggagatccggttggcgatcatgaagggtgcggcggaactggtgggaaaagagccgggcgcagacccggacaacctgacaagccgagagaagacgaccctgatcaaggacatcagtgagacgttgggcgtgaacgcggagagcctgctgaaggaggtcggcatcgcgcgcagcacgtactactaccagttgaaggccatgcgccggccggacaagaacgcgaacctcctgtccctggtgcgcgaggcgtttgagaacagcaggaggcgttacgggtacaagcgcatccacctcgagctcaaaagcgcgggcatcatcgtgtcggccaagcgcatcatgcgtctgatgaccagccacggcatggtccccgtgctcaagagcgcgaagcgctacagttcgtacaagggcgagatcggcggcgcacccgcgaatctcgtgaaccgcgacttccacgccaccgcgccgaaccggctgtgggtcacggacatcaccgagttctcgatcccggcgggcaaggtgtacctgtcgccggtcatcgactgccatgacggcatgcccgtcgcctggacgatcggcacgagccccaacgccgccctggccaacggcatgcttcgcgacgcgtgcgccacgctcaagcccggcgagacgccgatcatccactcggattaagccggttttgttgttaagccggggaacggttcggggtcttggtggctggccgtgtcccatgtggtttcccggcttaacgttccgggttatttgagggtgtgtagttgtcggagtcgttgctcgctgagccatgtctccttggaggggtcggggccggggttggccgcatcgacggctttgcgcatcatgtcgagggtcgcgaacgcgtagaacgcgctggttgtgctcatgctttcgtggccgagcagttgcatgatgagcggtagcggcacgccctgttggtagaggtccatggcgcgggtccggcggatcaggtggcagtggacgcgttcgggcatggacgggcacgtcccgcggcgtgctctggccgccgcggttttgaggatctcgtcgatccggtccacggagagcggctggatggcgccgttcctcgtcgagtggaacaacggcctgtcgccgtcgcgcatggacggtccgggatggaattcctcgaggtaggcggccaggtgggttcgtgtcctttctcccaggggcacgacccggctcttgccgcgtttgccggtgagcgtgaccctggccggcttatccatacccacgtccgcgatggtcagtgcggcgagttcgccgatcctggcggcggtgtcgtacatgaggatcaggagcatgcggttcctgcgcgatttggcgtcgccggtgccccatgcggtcagcaacgctttggtgtgctcctccccgaggtggtcgacgggtttgcgcgcgggtggtttgacacgtatgccggccgcgtcgttgcccagcgcggtcaatgccgggtgttcgaggcccgcgtggtcgaggaacacgcgcatcgtcgtcatcctcagcatgatggtgcggtccgagtacccgcgctcggtccgcatccattcgacccaccggcccaggcgcgcccggtcgaaatgcccgaaaccgatgtggctgcgctgcgtgccttccgtggtttcgagccatcggacgtaggattccaggccgatgcggtacgcctcgacggtcttcggcgagctgccccgcaccttgggcagccagtggtgcagccagtcgcgcgcgactcgccagaagtccggttcaccggagctggcggccgttttccttgccttgctcatggttcctccgtttccgggaccacgcgttcggcgtcggcgacgaggtccgcgtatccgtccatgaaatcggggctggcgtgcacgtagtagagggtgctgtcgatgccggcgtgtcccatgtaggccgccagatagggcagcatcgccatcacgtccacgccgtcgcgagtccaccgctcgatgttcgcgaacgcgaaccggtgccggaaatcatagggcctgggccgtttgccggcttgtggccactcgagcccggcccgcgtccagacgcggcggaacaccacgccgggcatgcccggggagaccggattgccggtggaggtgacgaagaacgcgggacggtcgtctccgaagcgttcgcgggaccgttggtcgcattccagcagttcggcggcgacctcgtcgcccacgggcagcctgcggctgcgaccggccttggaatcgaccacgtcgatggaacgggccttgtggtcgacgtgcccgacggcgagtctcctgacctctcgggtgcgcagcccgcagcaggccatgagcatgaagaacgcgcgagactgccacgcccacggcgacggagactccaacgttcccgcggcccgcaggaacagggcggcctcgcggtccgtcagcaggtacggcgtcggacgcggggatccggccttccactggtcggagagcacgtacgcgtcgggatcgtgggccagtcgcatccacctgccgaagtccctgatgtacgagaaccacgagcggcaacccccgggattcgcgtcgatcctatgggcgatccatcgctccacgacgccccgctccagacgcacggccccgtgttcgaggcaatgccggtcgaacgagcgcaggacctggacgcgggtggcgccatgcctgcccatggacgccttgaagcggatgtactcctccaattcgccggcgagcgggccgacgaatccgtgttccgtgggtctcatgacgatccgccttccggcacgggcagcacgcacgcgagcattcccccgcggtgcgtggccatgtagacgcgtgtggaatcggggtcggcgtggccaagcaccgcgctgatcgtcggcaacggcgtggccgcctccagcatcctcgtcgccgcgttgcgccgcaacagcctggaaccgccccggcgtccgagcccggcgtgccgcatgacacggctgatcgcctcgtacaccgatgaatgaccccgaagcgcgacatggggcgccttgtaccgcacgaacacacggtcgtcgtcggtggcgggcctttcgtccaacagccaggacgccagcctcgcggccagcggtcccgtcatcggcacggtcaacggattgcccgtctttcgctgcaccagacctatgctcatggaatcccaatccacgtcggcgatcctcagaccgatcacatcgcatgccctcagcccgcacgtcagcgacagcagggtgatcgccgcgtccctcgacggcaccgaccgcgaggcgcatgtttgtgttcaattagttgttgcgggtttagtcacgatgatttttcgggtttagattgactataaagaagtagtacaaacacgctcttgagttctcaaaccaccaccacaccagccagacgggaaaccaaccagaggaaggaacccgccgcgctgagcggcaacaggtgaataacttacacgcatgtccggattcacgcaaatcaaggcgcacaaaaaccccaggaatcggcataacagcgcggttccctcggcgtgtcgcacagagcccactttgctctgatgaggctaggttaacccctcaaatgtttctgaaaagcatcaaatccactattcggctggcgtgtcgcgagagttttcagcttgtcggccctgcgttcatctctcggcaaccacactgccggcgcacaatcggcgcatgacagcgctccgtcatcggatttcgttcatgaatcgcgggtatacctgtagttatgaccaagaagattgctgtattaaccggggcgggcatttccacgtccgccggcatccctgatttccgcggtccggacggtgtgtggaccaagcatcctgaccaaatgagcgtttacgacatcgatctgtttctgcgcaacaaagaggaccgcgagtactcctggcgctggcaaaaggaatcgccagtatggaatgcgcagcccggcactgcgcataaggcgctggtcaagctggaacaagccggcatgctgacgctgctggccacgcagaacttcgatgcgctgcatgagaaggccggcaacagcgacaacgtcatcgtgaacctgcacggcactatcggcacctcgcattgcatgaagtgccatcaggaatatgccacggcggacatcatggcccgtttggatgaagagcccgacccacattgccatcgcaaactgaagtatcgtggcgatatgccgtgcaatggcattatcaaaaccgatgtggtgtatttcggtgaggcgttgccggacggcgcgatggagaagtcgtacagtctggccaccaaagccgacgaactatgggtaatcggatcgacccttgaggtgtacccggcggcgagcattgtgccggtggccgcgcaggcgggcgtgcccatcaccattatgaatatgggtcacacgcaatatgaccatcttgcgagccgcttgattcatgaggatatcgccgttgccctgccgaagttggtggacgagacgattgcggagaacaagtagccctcagcataacgaaagcgccggtgggtgggttaagcaactgatgattgtggttaaccacccaccggcgcttttgcgccacctcccgccagcgggaggtattggagcacacttctgcgcggcttcccgccagcggtattggaatcagtagatgcgcttgggctggaatccggcttccctgagtgccgcgaggatgcggtcgatgtgctcggggccgttggtctcgaccgtgacgccgagagacaccgcgttggtgtagtggccggatgccttgaactggtcgtgatcaagctgaatgacgttggcgcgctgctcggcaagcagggtggccaccttgacgagctggcccggagtatccggcagctcgacctcgaagttcatgatgcggccgcgggcgatcatacctttctgaatcaccgcacccatggtcacggtgtcgatattgccgccggacataatcggaaccaccacgtgcgggccggtggcggcggcgaacttgcgcgaacgcaggttcaggtgttccagcgcagccagcgaaacggcgccggccgcctcgaccaccagcttatgcttctcgagcatgagcagaatcatttcgttgatgtcgcgctcggtgacggtgaccagatcgtccaggaactcgttaatcagagcgaagggcaggtcgccggggtgcttgaccgcaacaccttcggcggaggtaaccacatggtcagccggagacacacgacccgcggccagcgagtccttccaggccggtgagccctccggaatcgcaccgattacgcgcacttcaggcttgaatgtcttgatggcgagcgccacgccggcacccaggccaccaccaccgagcggcacgaccacgtcagtgacgttcggcacgtcttcaaggatctccagaccgatggtgccttggccgcagatgacttcgtaatcgtcgaatggcggcacgtaaatcatgccttccttgtcggcgagctcagcagcgtgggcggcggattcatcgaacacatcgccgtacagcaccacgtcggcaccgtaggccttggtggcatcgaccttcagcggcggggtgatctgcggcatgcagatggtggccttggctccacgctcgcgggccgcataggccacaccctgggcatggttgccggcagacgcggtgacgatgccgtgagcgatctgctcttcggtgagcgaagcaatcttgttataggcaccgcggatcttgaaggatccggtgacctgcaggttttccggcttcaggagaatctcatggccggtcatctcgctcagcaccggagaaggaatgatctccgtgtggcgggcagtgcctttgagtcgttcggcggccagcttcagttcggctgcatgatcacgttgcagcgccttcaaaacatccttttgttccatagctttccattgtaagcaccacaatgccgagagacaccagctatctcgcttcacagaggtacattcggccttttgcagacagctatctgttttcataggggtaccgagaagcaaaaaccccgggtataagccttgattttcaatgcttatacctggggtttcgacgttacggtacctctctcaagacagatagcatttcgggatagccccgaagtacctctttgagcggagaaaggcactcaatgcactacaactggatgacggctgcctcccacgggtcgagctcgcggttggcaagggaggccacggtgtgcggagcgtcatacgtgctgatcaccacattcggctcggcgattccgacggcggttagttcggcagcctcacgtggcaggtcaacggttcgactggacatattgactacgaccaacaacttctcagcgtcgagctcacgggtaaaggcatagacgtgcggatcagcggcgtcaatcagtcgccagtcgccggcggccacgaccgggctgttgtgacgcagcgcaacgagttgcttgtagaaggagtacaccgaatccggatcatcgaattcaccggcggcgttgatctcggcatgattcggattcacggaaatccatggctcagtggcggcgtccggagcggtgaaaccggcgtagccggaaccgtcccattgcatcggagtacgcgcgttgtcacggctgcgcgcggccagaccggccatcattgactcagacgactgcaccttggcctcctcgaccctctgccggtaggcattcaaggattcaaggtcacggtactggtcgagacgcgtgaagtgggcgtcggtcatgcccagttcctcaccctgatagatgtacggggtgccgcggtgcatgtgcagcatcaggccaagtgccttggccgaacggacgcgggattcctccgcggagtcgtcgccccagcgggagaccacgcgcggctgatcatgattgccggtgaacaagctggcccatcctgcgttctgcacggcagtctggtaaccggccataatgctcttgaatttcggcaggtcaagcggcagcggcttccacttggtaccttcgcaatcaaaatcaacatgctcgaacaggaagagcatgtccaattcaccgttgcccggatcagtgatgtgctcgttacgctgagccgtgacgcctggcgcctcgcccacagtcaggaagccttcacgcccctcgaatacctcacgtcgcatttcagccaggaattcatcctgacgggggccgtccgcacagaacggattcgggttggaatagccctcctcgcccacaggaagatcctcaagctccgagccgtactcgcccggcagcttgccgttcgaatcggtgcgcttggagatcagggtgatgacgtccatgcggaagccgtcgacgcctcggtcaagccaccagttcatcatgtcgtacacagcgcggcgcacggcagggttctcccagttgaggtccggctgcttcttcgagaactgatgcaggaagtattcgccacgctcggggcagtattcccatgcggagccgccaaagtaggagccccactgattgggctcggcgccgggctcgccgggcgtggtgccgggacgagccggacgccaccaataccagtcggcgtgttcgtcgtctttgttcttggatgcttcaaaccaggcgtgttcatcggaagtgtgattgacaacaagatccatcacgatcttgagcccacgcttgtgggcctcggccagcagctcgtccatatcgtcgagcgtgccgaacagaggatcaatgtcctgatagtcggaaatgtcatagccgttgtcgtcttgcggagacttatagaccggggatagccacagcacatccacgccaagatcagctaagtaatcaagacgcgacgtgatgcccttaagatcgccgaatccatcgccgttcgtgtcttggaaagagcgcgggtaaatctgatagaccaccgcgttggaccaccacggattgggggtggcgccgttggtgcggatggcgtcggggattattgcgcggttgaaagtagtcatcattggctccttattgatatctatattgctcgttgctcacagtctaaaaattggcgaattacattcccattggagaactgcgttggtgtgccggaaaataaatttcaatcggcatatgcgctttcatgattgcacccggaaaacacgcagtcggccgtactcgatctcgcaagtatgggtttctcccggattcatatcaatcgtcgcaccatggtcatcgatgatgcggcaagagcgaccgctagccgtaataatgccgatttgtggctgccggcgcaatccgacgaaagcgatgacctgttctgcgccgaatcttgctgtgacaccgagcgcatagtccgtatgttcggggtcattgagcagtgacgcaatgactggtcgggccggctcatcaggacgcggtaatgtaccatcttcggcaagtaaatcacgcaagacagccgcatcagtgtgaccgcaggcatcggaacaatacactggtccgccgctaagcaatcggagcacggcatggactcgcgcatggggatgctccgtccagaacatgtcccaatcacagtggtacagctcccccatcagcagtgcacagtatgcgttctggataaggtgttcgcccagcgaatcaggattgtgcggtagatagtcgtcgctactacgggtgattggcgatgaaggacgatgccaataatcctccggtgccatgcccatgcagttaatcaatgcgccgccgaatcgtcgtgaggtcacttcatcaagcgcctgatggcgtccccaggtggcttcaccgtaactttcggtgccacgaaccattactgacgtggaactttgcgaatccactttgacgaaatcgacgccggcttcggcgagttcgccgtcccaggcatcccagaactgtgcgggttgttcagcacgacttccaggaatcaggcaaccattcgccgtggtggttattgcggtcgggcagctggccgcggctacacccgattcgtccaaaccattccaatagccttggaacgcctgccacacgcctacgctgcgcacgccatagtgcgttttgagcagcgcaatggtgtgggcaagcccgtgggggaaacgttggcgatccgcgccaaagtcgatcagggtttcctttgtgcgatccgtgttggaccaaccgtcatcgataagcacccaggaaatgggcacatgcttggcttggaactcctccatcttgttgacgatagcctgctcgttgacatctcgccccaatgaatcccaagtacaccatcccaacccggtgagcgcatccgggaatggacgctccttacgggtgcgaatacccagctggcgtgctgccgtttgtgtggcagctcgaatggccatatacgggtcggatgcgcaagcgatatatgcggcagtgtcacatagagtcgtgcgaccaacccggttggaagacagcacgagccgcaaagccgtgtcatcagattctgttgcgggctgcccactgaaatcagcccgaatatccgtgccgcagatagcgaccaacactagccactcggcatcttcggcatcgttgttgcggcgtaacaataactgcgtgcgttcaggcagttcagatggtgtacgcacccaggtcgggcgcatccaccactccttgtgctggtatagcgccagcatggtgtcatcgttgccgctgtcgacgccggccatggtgagcgacacgtcaatcgcatggtggggctcaaacgcttgttgttcctgaaaggcagcggcgcggtccttgggctggggtgcatgcgcgttcacatcgatacgccagagtcgcacctgagcatcaccctggatacccgcactggacgtgcactcatcttcgcatgattcgggaacgattgtgacggcttctaccggcagttcacagattgccgaagcctgttcgccatagacggcacgaccggtatcaagatgggccgttaccgtgcgaacggttattggacaggtttcggcaatcattggcgtaactccttggtgttcttcaatgagattatgctggcaaggcccagacggtagcagctggaggaacgctctcgacctgagtgttcgcctgcacagtcgcgtcagacacaagtagcacggtcatcggctgcggcaaggcgactggttgactgtcagagaagttcgccatcacaaccatgccggacggcaagcgccaaccaagcagcggcgccggacactcttcgttggtaagccacgagaactggaagtccgtgccgttggccacccactgtttgcgcaatgcgacagcagcacaatacaggtgcaggacggaagccccgtcaccaatctgacgattagtggcatactgcgcaaaccatgccggctggggcagccacgaagcaccggtggcattgaagccgaacgccgggccgtctgactgccacggcagcggtacgcggcaaccgtcgcgccccttgaaataatgaccggaacgttcccaattgggatcctgaatttcatcttcggtcaaatcaaagtcctccggcaaaccaagctcttcaccctgatacacaaaggcggtacctggcaggccgagcatcaccagcgctgctgcacgggcacgacgagcggcgagcgcggggtcaatcggcggattcgtgccgttggacgtcacccactgctcgatgtttgcaccgctcggcagtccgagacgcgaggcgatacgtggcacatcgtggttgccgagcacccaggtgggggcggtttcggcagcgagagcatagcgatgcgtgcgctcaatcgtggtgcggtattcttcgcgattccaggcggcctttgacatggagaagtcgaatacggcaccaagttcatcaggcttggcgtattggaaaatacgggtggtgaatggcgaccacgattcgccgaccgcatacttggctggcgtgtactgattgaacaggtcgcgccattcacggtagatatcatgcacggcgtcgcggtcccagagcggatcggagccatcggtagcctgtggagacatcagtgtcgggtcgatacggtcgcgcagcggctcacgcaggtctttggccagaccgtgcgagacatcgatgcggaaaccgtccacaccgcgatcgcaccagaatgtgagtacacgcaggaactcatgccgcacctcgggattgtcccaattgaggtccggctgctccttggcgaacagatgcaggtagtaccagccgtctccacacgactcccatgcggaaccgccgaagttactcagccagttggtaggcggcaattcgccgtgctcccccttgccctgccggaacacataccgttgtgccgcttccgattccggaccttgagccagggcctcttggaaccaacggtgctgatcggacgtgtggttcggcacgatgtccacgatgatgccgataccgcgttcgtgcgctttggccactaattcgtcgaactgatcgagtgtgccaaggcggggatccacatcacaatagtcggcaacatcataacctccatccgccagcggcgatggatagaatggagaaagccagagcgcgtccaccccgagcgcctgcagatagtcgagacgatcgatcacgccttggagatcaccgttgccgtctccattggcatcgctgaatgagcgggggtaaatctggtagatgacggcgtcgcgccaccagtcattgttggtgaaagtcatatcgttcccctgtccgattgctcggtacgtatggttttaccagtatggccgcacgaaacactgttccggcggccataccctacatcctcttgccttcggatcagcccttaaccgagccggcaagcatggcgcggatgaagtagcgctggaggaagatgaacaggatcatcgtcggtgccatgatgagcagtgcgcccgcgttgagcagcaccacgtcggtctgatactggccaacgaacgactgtagggcacctgccatcgtgcgcttgttcgggtcgttctccaacaccacagccaacaggaactggttccaggtggccaggaaggtcagaataccgagcgaggagatggctggcagtgccaacggcagctgaatggaacggaacgtgcgcagatggcctgcaccatcgatggatgcggcttcgatcagatcacgcggcatctgctcgaagcaggagcgcatccacacaataccgaacggaatattcaggccgatgagcggcaggatcagggcaagacgggtattcagcaagcccatgccactgatctcgtagtacagcggagtgaccaaggtttcgaacggaatggtcagaccgacgaggaacagcacgtagatcaggcccttgcacggcaccttgagctgagcgaaggcataaccgccgagcgagcagaagatcaccacgcagggcacgaccacgatcaccagaatgcagctgttgagcagcagcggggtgatgtttgccatgttccaggcgtcgatgaagttctcccagtgcgggtgggcagtgaactggataccttcgggcatggaaccttgcggctgcaatgccgcggagagcatgctcaggaacggcagtacgcagaagaggacggtcagagcgagcatcgccgtgccggtgatgcgaacggctttggattgctgcatggtcactgctcctttccgttgaccagacgctgcagaggtccgacgaccagcagcacgagaatcatcagggtgacggcgagtgcggaggccaagccaacgctctgctgggtgaaggccaagcggtagacctgcacgccgggcaccatggtggaggtgccggggccgccctgagtggacatgtacaccacgtcgaagctggcgagcgcggagatgatggtcatggtcaggcatacgccgatttggccgcgcagaccgggcaacgtgatggagaagagctgacgccaccagccggcaccgtcaagacttgctgcctcgtacagggactggtcgatgccgccgatgcccgagagcaagagcaccacacagaagccgagctgcagccagaaaccaatcacgcctaccgcgttcagggaggtggattggtcgccgagccacacgtgggcgaagtcgccgaggcctactgcgcgcagcagctgattggcggtgcccttgtcggccagcatccaggtccaggccacaccggctgcagcgcctgggataacgcgcggcaggaacaggcaaacctgcgcgaaggaacgaccgaccttggacttcatgtctttgatgagcacggcaatgatcaggccgagcacaatcgggatgatggagaagaagatgatcaggtagaaggagtgcagaatcgatccgtacagatcggggtcggtgaacacggtgatgtagttttcgacaccgatgaaggtgctagcatcgataccgttccactcgtagaacgagtaccagatggtctgaatgatcggccacaactcgaaggcgatgtagaacacaagcgccggagcgaggaaaagcaggctgaccagaccgagggacatattgcgcttgggcttgaccgccttggctgccttatgggaatccatgattgtcaccacgctttgctggtttggtgtgaactgggaatcgaacatcgcacacaacgtcgtgcgcgcgatgggaaggaaccaggcggagcgggaaaaagggaagaacactccgcccggtaagtgcaagggttacttgacctccttctcgtactgagcctgaatggattcgacgaatgccttgggggtcatcgtgccgtcaatcagggactggaagccggggataatggcgctggcctgcatacctgcggtggcgttgttgatgtagtcggtggtgttaccggtcttcaccagaccttcgtaggcggtaaggacctggccgagaagctggttatcggtgctcggagtctcgccttcgccgaccggcgggtagccgttgtcaactgcgatctggcgggcttcgtcggactggaggaagtcgaggaaggcggctgcagcgttcttgttcttggcgttggccgggataccgaaagcggtcacggcgttggctgcggcagaaccggaatcggccttttcgccggggaaggcgatccagccggcgtcatcgccaagtgcatcgttgatggaggcggagtaccagctgccggaggggaagaacagggcttcgccgttgcagaagcggctcagtgcagtggaaccgtcaagggcgagcgcgtcggaggagaagtaaccggcatcctgccagtccttgatcttctgtgcagccttcacggcaccgtcggtgttgaaggtggcgccatccttctggataatccaatcctgcacggtatcgcgaccctcatagttggtgagcaatgcctggtagatgtaggaagtgccgccttccttggccggcatcatcatggcgagcttgccagcgtcggaggccttcttcatatcggcctcgagctcttcgacagtggccggagcctcggtgatgccgagttccttggcgactttcttgttccagtacaggccggtcatcgagacaccgtccggcactgcgtagaggctgccggaaccgatcttaccgtcggagcccacgcggtagacctgagtctgggaatccggcagcttccaaccgtaagcatcggcgtaagcgtcaagattgacgacatggttgccacgcacagcggagttgatgtcggtgatacgggcaatgtccggggtgtcggcggcggagatgatgcgcgggccattctgctgggaggtgttgtccggatcgtaggtggccttgatggtgatgttcgggtacttcttctggaaggcttcgatcagctggtcatcaaaggtcttcaggccagcgccgtcccacagcttgagctcatacttggtatcgccaagatcagtgctcaccgcttcggtttcggtgttggctttgttgctggacgagcccgggccgcaagcggcgacggatgccagacatgccacagacatcagaccggcaataacggttttggcggttcgttcgatcctcattgatcattcctttcttccttccgggcgatcccggctatgtcttccttggctatctcggcttagcgtatttgctaagcgcttatgcatgaggataacagatgtcgaaccggttcgtcaaatccgcaacacgcaaacaaatggccgattcccgaagaaatgaggaaggcttgacgttccccataggcaagcacttccttctcgcgaaattgcaacatcggtcccttaaatacctaagcgcttattcattcacctaggatgacgtttcgaaggctcgggcagctcgggaaaaattgaatgtggctcaatttgataccagtacgccacgctagacacatcatcctgacgctcaaatgcaccttcatatcctgaaccaatttgttgaagcgtgactctaagctcactatcaaacctgatgggatcaggaatatgccatcggtacaagccacgcataggtggacaataatcgtcatgatattggtttgctatagccccatcgcgcacagaataaaatggatatcctacatatggggcacaaaaagtacgctcgcgcgtatgaccatctcgctgctcagcgaagctccatgcaccgccaaaataatcttcggtgccggtactacacactgtgggataatcgttatcgccatctaggaaaaacttaatctctccctcaccccaccaatatcgttgcaacgtagaaatagcaagatatgtgccgacgtaatggccccgtccgctgactccatcgaggattacatagtcctcgcctaaagtagtgattggctgtctgcgccattgcgcatggaaataagccatttcacgggaggaatacgcattacccaatgcataatcaatctgataaaacaaagccggaatagcatgagcgtggtcattgcgcactacgatacgtgcccgtttacgaaacggcatcgtgaaataacaattcatacctcgtgtaggtgccaccacaataggctctgagaacacatcgcaactttgtccaaagccgcaacagaagaagtctcctaggggacattccacagaaggtcgcttttcatcatcccaatagatggcaagcaccgcatcgcgcagaacgtatcgatcagcgtcactggtgcgatccgtaacggtaaaccacatgtgccgaatacaaccggggccttcaatatctgccaatgtcacagactgcccgggagcaatgtcattcaaacacggctttcccttgcgcgacggccccaacggaccagtttcacggcaaccaaaacccttggctcccgttgggttctccgcattaatcgaacatgttacttcgtcgcggacagtcggcaaatccgataaagttcccgcgtacggtcctgccatcatcataggttgactctcctcaaatcaagcgtcgctagcgaaagcggcatataagttgaagctgtttctaccgcttcgcttctttgtcatattgcgcctgcacattctttgtgaattcctgaggcgtgatgctgttatccagcagtaactggaagttagggattagcccacttgactgcattcccgcagtagcattattaatgaaatcgctagtatgaccgctcgtcagcacgtcggcataggcatcaaacatactctgctgcaatgcgctattcgccttgagatccaaagtagatgattttggcaaatagccagaattgtcaacaataatctgttgcgcttcggcactttgcgtataatcgaggaacgccgcagcagcatcacggttcttagcattcaccggaataccataaaatgcacctgcattagcagcaacgttcggctcatcttcactggtggcacccgggaaagcaaagaactgaacatcatcacccagcgctttggccacagtatccagattccaattaccgctcgggaaaaatagtccttcaccattgcagaacctgctcagagcagtagaggcatccactgcgttaacaccttcaggcatatatcccttgttattccaatcctgcaaggtggacgcagcgtcctgcgccgcctgattgtcgaaggtaccagatttctgcaaaatccaattctgcacatcttccgcagaactgttattagccattaacgcctgaaagacaaaagaggtaccgccatccttggcatatgtcatcatcggcagtatgccggcatccttggctgtctgcatatccgcctcaaactcctcgacagaggtaggagctgcatcaatacctagctgctcggcaagcttggtattgaaataaatgccagtcaccgaataggagttcggcaatgcgtacaaatcaccgctgccgagcttgccatttgaatccactcgatacaattcagtctgcgaatcgggaacatcccagccgtacgcatccacatatgcctctaaagacaccaaatggttgccacgaaccgctgaattcatgtcggtgacgcgggcgatatccggcgcatcttttgctgaaatcacacgcgggccattttgtccagagacattatccggatcatattgtcccgtgatggtgatgtttgggtatttcgcttcgaacccggcaatcagcgcctcatctacagccttcagacccgctccatcccacaaagtcagctcatattttttattacctaaatcagtgctgacctcagtaggatttgtatcacttcgtgagctacttgccgagccgggaccacatgcagtcagacttccagcgataaatatcgcagcaagcgccgcgccgctgttacgcataatcctattcatcggttacctccttgcatcctcatcatatgcaatcgatatttctctttactgtcaccatttttcggcggcaataaaatatatttgcgatatcgattacgcacatcgtacatctttttgcggaacccgtcaaccttgcatcacaccaatggtggccttaacttcaaaatccagatacaatacaatcgattacgcaatgcaggagatcccatgagcgaaccaacaatctatgaagtagccaaggaggctggagtctctgcggcgaccgtatctcgtgcaatcaacggacgtgaccgcatatcggaaactactaggcaaaaggtatttgatgcatgtgcaaagttggggttttcagcatcgaaaacagcctccatgctgcgaacgggaaagacaaatcgtatagcacttaccgtaggtaactcactggctggctggttcagttcacaactagccgaaggcgtatattccgtgctcgcatcccaaggatatgacttgctatcataccgacttgcaaacgccgatcaaagacgcgatttcttttcctcaatgccagtgaagcgcaacgcagacgcggtcatcatctcctccttcgacatcagcgagacagagaggcgaaccttagaacaactcggtatgccagtcatcggtgtcaacaccatcgggcttacggaacagcgagatatgatttccatcggcgtagacgaaattatagcaatgcgacaaaccgttcatcagctcgcaggactgggacatcgcaatatcgcctttatctgcaagcagcaagacagtaacggattcatatgggaagctgaccaacgtatagaagggttccgtcttggcatggcggctgagggactcaacttgcccgacggatacatcatcgcagtacaggacaacgaatttgccggagcagaggcactcagtagcctgctcgcactctcccctcgcccaaccgccgtatgctgcatcagcgacgagaatgccattcctctagtccatgcgcttcgctcatacggattccgcgtacctgaggacatatccgtcatcggattcgatgactggccaatggcacaagcgctcaatatatcaaccgttcggcacgaccctcggtcctacggagcattagcggcagatgccgcaatccgattatcacgaggcgaaattctgacagaaagttgcatcgttgttcccacgacgctcatgttgcgcggcaccacaggcccagcacctcgagattaaacatcgacaacgtccgcatttgatgatgtgcatatcattattgcaacagcgaaacaacaggtaccagccagaggaaggacgaccgggtaacagccacaaggcggccacccattcaccatgaaacgcgcgaccatcaacgacgtagctctcacggccggagtctcaacttttaccgcatcccgcgctttgcgaggtaaggatcacgtggcagcagctacgcgggataaggtgctgaaagcggccaaagagctgaattacaccgcgtctcgctcggcggcggcgctggcaagcggacgcaccaatcgcattgccatgctggctcgcgaacggctggccggctggttcatgggcgaattattcgacgggctgtatgacgaactgagccgcgcacgctatgacttgaccgtataccgagccggcagcgtcgaggagcgtgcggaattctttactcggctgccagccaatcgtaacgccgacgccctcatcgtatccggattttccgccaccgatgaggaagccgacacgttggccagcatgggtatgcccatcgtctcggtgaattcgccgtatatcagctgctgccaagcctccgtggccattgatgacgaggcggccgaagccatggcagtgcgttatcttgcggccctcgggcatcgtcgtttctgctatgtggggcgcaccgatccgctgaccggcaaggaatggggattcgatgcacgcgcacgcggatacaaagatgagatagtctcgcttggcctcaccgactgcggcatccacttcatcgactcggaatcaccacgctcggccaaacaagtcatcgccaccatgctcgcgcagcctgagcggccgaccgctatctgcgtgtggtctgactactacgcattgcgcgtggtacatgagttgcaggcaatcggagtacgaatccccgaagacgtttcggtctttggctttgatgggtccgacgtggcggaatccattggattaagcaccatggtgccaactcccccgcgcgaaatcggacagattgccgcgcgcaaggcactgaatttggttgaggggaagaccttggacgaccctcatacgactgtacctgtggcggtcgagcccggcgcgaccagtgggccagtgcgggaataggcgatatgggaaaagcccccctcggcggaaaaccgaaggaggcttgggtggagctgcactacttcacagcgcctcgcatgactccaccgacgacccacttttgggcgaagatgtagacgatgaggatcggggccatggccatcaggtagctggagaaggccatcgggtagttggtggcgaactgcgagctgaagacgtactgggcgagcgggatggtctggttcgactggtcggtcaggatgatcaacggcaggaggaagtcgttccaggcccacagtgcggtcaggatggcgatggtggcgttaatcgggctcatcagcgggaagatgatggtccagaaaatgcgccacgtggatgcgccatcgattcgggccgcctcttccagcgaaaccggaatcgaacggatgaagccagtggcgatgaacaggttcgtgcccaggccgagcaccgtgtacagaatgatcaggccgacctggttgtccaggtgcagggagcccatctgcttcgcaatcggcagcatgacgaccgggaacggcacgaacatggcggcgatgaagaagtagtacaggaagcggaagaagcgcttgtccatgttgcgggccacggcgtaggccacgaaggtgttggtcagcagggtgagcaccacggcggccaccgtgatgatcgcggagttgagcgcggccttcgggtagttgaccttggcggaggcgtcggcgaagttgtgccactgccacgaggtgggcagggcgaaggtgccggcttcggccggagtcttcagcgcggtgacgatggtgaagtagagcgggatcagaatggtcaggctcagcacggccacggcggcggtcagccaccagttgatcttgtggtccctgcggaacttggcgggcttgccggacttggacggggtaactgttgcagtagtcatttcttatcctcccctaaatcagatctgttcctggctgcgggagatgcgcagctgtacgaaggcgatgatcgccagcacgatgaagaagagcacggcgtttgcggtctggtaggcgtactcgccaccggtcaggccacccttccagatgaggtaggtgacggtttcggtggaggagttcggaccgccctcggtcaaggcgacgacctgatcgaaggtgccgagcgcgttcttcatggacagcacgaggttgatggtgaagaacggtccgatcagcgggaatgtgatcttccagaacttctgccaggcgttgacgccgtcgatggcggcggcctcgtagatttcgtcgtcgatggtctgcaggccggcgaggtagatgagtaccgagtaggcgatgccctgccagacggcgaggaagacgattgggatccagctgagttgctcattggtcaacagcgaggtggacagccacttgatgcccagcgccttgccgagctcgggcagcgggttcatgaagatgtacttgaacacgtagccgatgaccagcacggagagggtgtaggggatgaagaagatggctcggaagccattcttgaaggcgatcttcgagttcagcagcaccgacaggaacagggcgatcacattaatcagcaccgtgatgagaatggcgatgaggaacgtgaacaggtaggcatggcccactcggttgtcctggaagagggcgatgtagttcttcaggccgatgaacttgtaatcgccgtagccctgcgagttggtgaaggaatactttacgccatcaagaaatggcaggtacaggaagaaggcgaagatgatggccgccggaaccaccatccagtagtaggcggggtccactttgcgggtggagaaggcggagaccttcttcttggccggtttcttggcagcggtcttggttgcggttgcgtgtgacatgatgttctcctctcctaccgatcactcgaaggtcctggcttggaccttgtcccattcggtctgcatctggttcaggaagcggtcggtgttgccggaggtcaccatggtctgcaggtagccgccgatgttgatggacgaaggaatgtagtggtcgcagaagtcggccagtcggttttcctcgaagaacgggcgcacggtttccagcgcatcgttgccgaagtaggtgtccttcagcggcgtgatggcggactgggcgtcggcgtaggcgtcaagctgatccttctgcatgaggaactcgacgagcttcatcgcttccttggggtgcttggtgttcgcaccgatggtgagcatcacgtcgtcgccggcggtgaggatctgctcgctggcgtcatcggtggccggcatctgggcgaaaccaagttcgatatcggggttgatcagcaggatctgcgggatggcgtaggtgccgagcgggatgatcgcggccttgccttgggcgaagttctgcgtgccctgctggtaggtgacgccggtgtccgcagtggagtaggtgaagagctcggattccttctcgactgcggtcttccacagttcctggaacgtggtcttgccttgcttgagctcggtgtacttcgattcgggaaccagcgtgccggtcagggaggcgagcggtgcctgggtggtccaggcgtcggccacggaaccctgcagcgggttgatgccggcgtccttgaaggtgttgagcatatcggtgaactcgctccaggtggtcggcggattctccgggtcaaggccaaccttgcggaacagagccttgttgtagatgtagccggaggcgttacccgcgaagggcaggccatacaggcgcttcttggaggaatcggtggtctgcaccagattcttggcgatctgcaccatgccggggttgagggtgtccacaatgggttcatcggtgaagtcgtagaacacaccggaggcggcgaagttgccgaagctgatgtcgccgttgaaggtgatcacgtccggcacacgattcttgacgaaacgggtgcgcagatcggtctgggcgttggcggagttgttgatgttgaccttgatggtcgggttctgcttctcaaagtcggcgaccatggacttgaactggtcggcggcctcggacttgaactggaagaaatccagcgtgacggtgcctgcggtgctggagccgcagcctgccaggccgaagccgacggcgatcgcgcacaccacggcggcggtgcgcacggccagacgcttcagtctaggcgttgcatgtggggaatcggacagcataattgttgactcctttatctttcttttcctccggcttcggtgccggcggttcttccactttccaaggtaacggttcggccatttcattcccagcgccagcgagcccacttgcgcaagcaacaaaaagcgcggtattttgtgattaacgcaataaatacagcgagggggggcttgcatgtctgatgccaacgcgattccacagtggttttccggatccgagcatacgcatcgcgtggcggcggcaattgcccaatacgggccgatagcccgcactacgttggcacagatgctgggactgagccaaggggccttgtcccgcatcaccagcgatctgatctacgccggggtgatcgaggagcttccggccgaggccggcccgtcaggcaagctgcccgagcgattcacgccaagggaaagttcggatcgtcgcggacgcccgcagacttcgctggtgttgtgttcgaacgcacgcaccttcattggtgtcaaggttcatgggatgtcgattgtggccgctgcggtgaacgcgcatggcgaggtggtgtccggccggcacgaggtgccgatcggggcggatcagtcggctgagtatgtggtgtcggccatcacgcggctggtgcgcgaatgttccgccgatatcgcctcttccggactaccctcccccactgcggtgggcgttgcggtaggtgggcatgtggtcgacgattcgattgtgacgttcgcgccgttcctgcattgggacggggccacggacttggggacgatggtcacagaggcgaccggcctgccgtgcggggtgttcaatgatatcgattctctgctggtggatgcctcctggttcgggccgggtgtcggcgtggatatgttcgccgtggtgaccatcggcgtgggtgttggttattcgctggccgtgaacggcaagccagtgcagtacccggataagagctatggtctggtgggccacgtgcttatcgatccggaggggccgcgctgcaccagcggacatatcggctgttcacaatgcttgactgacgattcaatcgccgaacagtactctgcgattgtgggtcgcgcggtcagttttgaggactttgcgcgcgatgccaaggaacgcgtgccgcaggccacgcagttggtgaaccggacgtgtttccggttgggttcgctggtggctacggtggcgaatatcgcgatgcccgggcatgtgatgattgccggggagtccgcgtttttggccaagctcggcaccgattcgctgcgcgatggcattcgtttctaccgtcacagccagacccagccggtcaagttcacgattatggaccacgactggcagctctgggccaaagccgccgccagtcgcgtgattgtgaagcatattgggtaggccgttcttggctcccctcagagaggggagccaagaacgttgcttcgccacagttactccgccacgaccagcaattacggacttgcctatcggcaaggctcaatcccaccttcgctcagctgtcgcttcgctcaggccgtggctactgacagcctactaggctgtcagcttaacgccacagccttgagcaatactgcctgctgggggtggagggacgggggacggatgccgtagcgctgcagggtttcgccggtcaggactacgccttcctcgttccaccagccgagagtgctctggccgttggtcagaccggtcaaatccaagctcgggtcgagcgggctgacgcggtaggtgcgctcggggtcaagtccgggcaggtgcacgggcgcggccggataggtctggctggtggtcagctgggtgaagcggtagatggcggcgtcacggttcggcatcaccataccgtccagacgcacggccggatcgttggagtcggcgtgcacgcaggtgtcgatggcgaaccagtcgcggtgcttcttgaattcggccacccacacggccagcttggcgagcgcctcgtccggctccttcaacaggttccattcgatgcccatgtgaccgaagaacgccatggccatgcgcagttcctggctggtggcgcgctgggtggagtgtgcggggctggcgcccacgtgctcgcccatcatcgccggcggcaccagcagcgaggtgtagcgctggatgtccgcgcgctcgaccgggtccacgcagtcggagacccagatacgatcggcgtgctccaggatgccaagatccacgcggccgccaccagaggagcagctttcgatctcaaggcccggatgtgcggtcttgaggcccttgaagatgttgtagacggcaagggtctgcgcgtgcacggccgggcggccggagcggcgggaaccgggctcggtgacgagcttgttgtggtcccacttgatgtagtcgataccaagctcgccgacaagctggtccatgcagccgtagatgtagtcgaacgcatccggattggtcagatcgagcacctgctgagtgcggccctgcagcggcagtcggccggtggtgggcgagagaatccaatcagggtggttacgggccacgtcggaatcggggttgaccatttccggctcgaaccacaagccgaattccatacccttggcgtgcacgtagtcggcgagcgccttcagggacttcggaccatcgggccagacgtcctgcgcaatctgccagtcaccgaggccggaggtgtcgtcgcggcgggagccgaaccagccgtcgtccaccacgaatcgttccacgccggagtcggcggccctgtcggcgagcgccttcagcgtatcgaagttgtggtcgaagtacacggcttcccatgtgttgaggatcaccggacggccgtgcgagaacaggcgcgggtgcagggagcgcacgtaggagtggaatcgggcggcgatctcgttgagaccatcgccataggagccgaacagccacggggtgtcgtaggagttctggccttcgccggggccggcgagcgtcacttcgccgccgaacaggagttcgccgccgccgattacgccggtcgtgtagggcagacgttcggcggacagtacggagttgccgctccagcccacgtgcaccgaataggcgtcgccatgctcgaagctgaaaccgggcacgccggcggtcaggagcagggatgcgtcgaagtcagggcggccggcgagctgcggcttttcgaaacggccgacggtcagcggctggcgctgcggactgcgttcacgtagatggtgaccggtggtggtgaggatttcgccggcggattcgggcagcgggaagccgagctcgatcttgccgatctcgagcggggctccggcgtctgcaccgaacaggttggttacggtggccttctgacggaccaggccgccggggagcagttcgaggtgccattcgacttccacgccctgctcctcatcgcgcgcggtgactatgacgccgggcacgcggaccggaccggtggcacgggcatggccggccacatcggtgtagctttcgccggacacggcatcgagggtggcttccagcacgccgccggtctcgatgttggtcacggtgaacttggggaagagctcgacgccggcgcggcgcagcaccacgcgctgctcgccgatccagctttcggcctgggtgggcaggatggacggccaggcggtgtcgtcgagcgcgccggacacgcgctgcggcttcagggcgtcataggcggccagcagggtgtcgggcttggccagcgggcggccccagtggacgatgtgcggcaggtcgctgccggcaaacaccagaccgatcgccacattggcggcgggctgggtcaggtagacggcggtgagtgcggtgccgtcagcggcggcgccggtgaaagtggaggtgttctcggccatattgtctccttcgacgtgtgtggatttgcattgcactactggtttcgatggtagaagaaatggaatatgttgccttggtgccgcgtgttggttgcgtgaggtaagtaatgcgtccgtgtctatcgccgctgggcgaagaaatcagtcaggatggactgacactcgacttccagcacgccgccgtgcacttcaggactatggccgatatgcggatcgcgcggaatatcccaaatcgaaccgcatgcaccgagcttgggatcccaggcaccgaacgcgatggtgccgatatgggtctggatgcaggcacccgcgcacatcgggcacggctcaagtgtgacggccagcgtgcaatcggcgagattccaagcgcccaaggcttgggccgcctgacgcatggcgatgatttcggcgtgggcaagcgggtcgccatcagcctcacgcgtgttgtatccgcgcccgacaatctggccggccgcatccagcaccaccgcaccaaccggtacgtcaccagcggctgcggcctgaccggccagttccagtgcgcagcgcatcgcctcgtcatattccataccaacgagtgtatgccttttctcatatcgtctcatgatgtgcataatcggccgcaagcttaacgttttcttcatggttcccatatacttttggtggagaaaaatttaagggagaaggcggcaacatggcggtatttgagctcatcctatgcatcattgcggcggtggtggtgagctcgtttgtcagtcgcttcgtgcccaaagtctccacgccgctggtccagattgtgctgggcgtgctggttacgtatctgccgtttttcccggatgcaacgctcgacccggaactgttcatggtgctgtttatcgcgccattgctgtatttggaagcccacgaaatcgataagtcggcgttgctgaaaacgctggatctgagcctatcgctggctatcggactggctatcgtcacgatggcggcggtcggattcactttgcatgccgtctggccgtccatcaccttagcctcagccttagcactcggcgcggcactcggcccgaccgatgcggtggccgtcagctccctcggtaaagaagcctcgctgacgcagcgtcagcgcagcgtgctgaaaggcgaatcactcttcaatgacgcttccggcatcgtcggcttccagttcgctctggccgccgccttcactggagaattcgccgtggggcaggccgccggcgaattcgtgatctccttctttggcggcaccttatttggcctggtgatagcagcagcggccaactggctattcgagaccgtgcgatccctcggctgggaaaccactaccacacgtattctgatggaactgttcctgcccttcctgctgtatttgggcgcggaggaattcaatgtgtccggcattctgtcggtggtggccgctggcctgttcatccgattcgaccgcaccggcgtggggccgaatgtggcacgtacgaatatcgtttccacttcagtatggggtgtgctgagtttctcgctcaacggtgcggtgttcattcttctgggcatgcagctgccgcgcgccatgagggccagctggtctgacccgtatatcagcaataccgtgctgatcggcattattctgctggtcactctggtggtaatcgcgcttcgattcttctggattgcggccatgctgcgcgttgcgcgagatacaatcaccggccagcgccgcaaaatgacacccgaacgctggcgctcggccgcagtgatgacctttggcggccccaagggaaccatcacgctgtcattgatgtttaccatcccgtattacattgccggcggtgcgccgttcccgatgcgtgacgagctgattttcattgcgtcaggcgtgattatcgtgaccttgctgctggccaacttcctgttaccgctattggctccgaaccgtggcaaggatcccagcgcggaaataattccggtgaccatcgatgtgttacgcgccacggtggaggaattgaccggacgcatcacgccagagaatcgtcgtgcgattctgatggtaatcgaccagtacaccaagcgcatcgggcgattgcagcagcgcatcggcgataccgatccccagggattcgagcaattgcagatcgaagcgctgcattgggaaaaggaattcgtgcgcgaccggcttgccgacaccaaagcacatccggcggcggatacggccacgcaagagctgaacgtcgaagcctgcgagcgcatgcttgaccagattatgaatacgctgcgtcacacttccactgatccgacttcggggcatgcggtatcgcagattcgcggtcgcgtacgcatgttccagcggcagatgagcaattacgccaaacgcacggtgtccaagattcgccacaccacaccattggtgagcgaggaccagattttcgcgcgcacccgcgaactgcaggtcgaggcgattcatcatgttatcggtcggcttattgacgagatgggccaggatacgtacaacaccgagcattgttcggcactgttgctggattatcgtcgtgccgaggcttcattgcaggcacgtccgaccatgagcggcactacggaaaccatcacgcaggtcgaggacgtaaagcgcgagagctacggtatcgaactcggtatgattcaggacatgtacgaagccggcgacatcaaccgagcccaagcccgctccctgaggcgcaacatctacgttatgcaagtggacgctgattccggcatctagtttccctggctcccttctctgaggggagccaagttggggattgctatttccgtatgattctcttcagtatgtgcagtagtgcttgcagtgctcacttcgctcatgggagaacagtctatgaccgcgccggccacaagcgccctcgatgtccgattgctgtgacggccgcgccaattccagtgatggcggctgactacagcacgccagaggtaatgtcgttgtcaagtagccactggcgcaaatcggcgaactcctcaagactcacattgtgatccagaccgtggtagctcttggttttcagccacgtatgctcttccaaccaagcggcggtggcgaacagttcgtatttcgggattacgccatcgttcttgccgtacgtatagaacacggggatatcgtaatcggccaggcgagagtcggcgggggccgtgccgggcacctgaccgggtgtgttgaagccggacagggagacgacggcccggtaccgctcgggattgatacgcaacaaatgcacggcgaccagcccaccttgcgaaaacccaagcggcaccacgtcacggtcggcgggaatgttgtcggccacccatcggtcgactgctgtggcggcggcatacgcgtcgtagtcacgatcatcgccgataggcagggcatcgtgaaaccacgcgtagttgccggggtcgggactgccttcacgggccggcgcgagtgtcagcggcccgcgcagtgccacgaagtcgttatatggagcgatgaggcgcatgatgtccgccatgtcttcttcgctggatccccatccatgcaggcacaggaacagcggatgcgtggcatgctggtcgaagccgccgcgcgaggtgacgctgtgttccacggtgagtggctcgccaaaacgtccgggcacagtggtggattcgcggccgatcagaggctggctggcattcgcttctttgctcataccattccaatatagaggtcttgcgcgctgtgcggaaaacgatggaccatgatttcaatcacattgggtaatccgcgccgaatcgccttgggacttttcaagggataccggcaatctgtcaggcgttaccgctgtctgcggtatctgcggctgcggtgattgtctcaagttcgccgccccactgctgctgcagtgcggtcatcttgctggcctcgccgaacaccatccagcgtttgccgttcagcaatcgccaatcacctttcgtttgctcattatcagcgtattggctcagcagttcggaaatcttgctttcgataggtgcccggctgatggctgcggacgattccgattcaaaggatacgaaggccactctcggatcagtgcacatctgtacggtggtgatgcccggcaaaccgcccgtatcaagcccctgccatccttctttgcacgcgccggcagcttgttcgatgccttgctccatctgtgcggtatcttcgacgggtgccttgtcgttcgactgctgaatcagtccttccgggaacaatacgcccacggccacgccgataaccaagcaaactatggcgcacaccagtgcgatgatgccgcccgcgcccactcccccgtgagtggcgtaccgaggcatggtgactcgcgcagcgatgaccagaatcagggtgatgccgataagcaccgccgccgtcaacgcaatgtatcgtcctggcactgccgtcataaaggaaatggcgtaaggcgcgatctcatgaaccgccgaggtggccgataccacgacggctagcagtccgctgacaacggcaagtctgcggcacaatatcgacgttgggctgctggcttttgtagcggcgaatcgccggccggcatcccgcctggatgggcgtcgattctgtgcacgacgtgagctgcgcgaatcgtcatactgaccatcgccgaagaaatcgtagtcctcatcgttgcgggccatcggtgcccccttcctgccgattacacagctagtgtaccgctatggcttgggaatggcggtcattcgggggaatgattcagggcacaaaaagaaccccggcggttgcccgccggggagagaaaggagagagaagaagaaagggggttcaattgtcgggaactgctgcggctcctgatcagctttccgctgacatcttttatataaccactgctttctgggtctacctctaagtttctctgagaaaaacctgagaatacttgcgattgatggaccgcggaagcgtgaggagcctctcacgtttccgcccaaggcgctagacttgaaggcagtatttatttgcccaaggagtttttcacatgctgctgtccgaccgcgacattctcgccgcacagtccgcaggtcatatctcacttgatccgtggacccccgaaatggtgcagcccgcttccatcgacgtgcgattggatcggtacttccgtttgttcaataaccacgcctacacctatgtcgatccggcggaaaaccaaggcgcgctcaccgaacagttcgaggtggctcccgacgaaccgtggattttgcaccctggcgagttcgcactgggttccacgtgggaatacgtcaagttggacccgtccattgccgcccgtctggaaggcaagagctcactgggccgattggggattctcacccattcgactgcgggcttcattgaccccggtttcgaggggcatattacgcttgagctgtctaatgtgtcgacgttgccggtcaaactatggcctggcatgaaaatcggccagatgtgcttcttccagctgagctcgcccgctgagcacccttatggctccaagggcaccggctcgcattatcagggccagcggggtccgacgccgagccgttcctacgagaatttctaccgcgcgcacatcgacgactgagcgttgcgacgtaccattcggccggcggatgccggccatttgcttaatcccaaggagatgtcatgaccaacagcgatggcgggttccagttcgacttccagcagcccgaaaagccggtcaggccaacggttcctccgattcccgggcaagagacggcagcatatagcacagaacccacggcacaagccacaccggctctgcagttcccgcagtctgtgcagtctgcgcagtctgcgcagcccacacagcccacacagtttgtgcagcccgcgcaagtagcgtatgcctcacaacccacgcaagctgtgccgaccgtacaagccgctcagccgacgcagcccatcgatccggccatgacgcaaccgttctcgccgcaattcctggctgcggttgccgcacaagcaccacagccggcggcagccacgcagccagtagtatccgaaacaccaatcgccgctgcgcccggccagcagcaatacgtttgggatcagacgacgcaaagcttccgcccggtggaaccgacagcgccggtgacgccagcagcaccagccgcaccagcggcaccggcgacatcgcctgtttcggtagcttcaaacgccgcgacacaggcgttccaacccaatcaggccgagcagcctgcggtagatgccgaggcaacacaagcgttccagcctgatcaggtcatggcaacacagcctttcgaagctcaggccatgccgaatgccgaaaccgcggccacacaggcatacggcgcatcatccaccgtatccggtgagaccgttgccatgccggcaacgcaagtagcgtctgccgatgatgctgcagccacacaggtgttccaaccggccgccctggccgcttcggcacaggctcagcctgctgtgatgcctccctccattccgttggatcaggtctccgatgaggacgattccgatggcgccgagcctcgtcacggcggtagcggcaaaaagaacacccgcaaaatcgtcggcattgccgtagcggtagtcgccgtgatagcgctggttgtcgccggcctgctctggtggcattccaacagcagcaaggcgagccaagccgtggcattggccgagtgcaaggtagcggccaagcagtacacgaatgctcagaagaagctcaccaccgccatatccaatggccaaaccagcgcgcaaacatccaccagcgatgtggccgatgccaatacgctcaccacgctgaatcaggcgttgcaagacgccgacaatccgaccgacaccgccaagtgcgattccagcctcaacgccactgagctgaagtctcacactaaagagctgcagaatgatgccagcgacatggctgacaagacggatgccatcaacaatgcgatcaaggccgttaatacttcaaaggcgacggccgataccgacacactgaaatcgaacctgagctcggctatttcgcaggcgcagggcacgctggataattccgcgggcagtgtggccgatgagaacacccgcaccgcgctgcaaaacgccatcaccgaggccaatacggtgatgaacgggaccagtccgtccgaatccgacgtcaacaatgcgatttctagactgcagaaggccgagtccgacgtcaccgcctcgatgcaggccaagcagcaggcagatgccgccaagcaagctcaggaagaggctcggcagaaggccgaccaagaggcacagcagaagtctcaagacaagtccaacaatagcgacaacaataacggcggcgacaactccacctctactgacggcaccgacggcagcaacaactgaggtctgcagcgttctcccgtttcccatggggcggtaacttccccatggggcggttagcacattttcctttttcgcggaataacgccgttttcagcgaccgccccatgaggaactcaccgccccatgggatagttaccgccccatgaggagccgtttggatatagcagtgggccgggctctgaataccagagcccggcccactgctatatgcccacaatcagggctattgcgatggcttaacgcttggccatcgcgcgtagcacaatcttgcgcagttcggaggcaatcagcacgattgcggccaggcagatgcattccacccaagccatcgggctcaatgccacggtgccgaacggaccgttgaggaacggcacgtaaatcaccacgagctgcagcgccacggacaaaccaatcgcaccccatagccacttgttggagaacagacccacgaatgcggactgcagatgcgaacgggaggacagcgcgttgaacagctgggcaaacaccagaatcgtgaagcccatcgtacgggcctcggtcatctgcgcttcatggccgatggcatccaccgagcggtcggtgaacaagccgccggacaggtgcatgtccataccaatcagcgtgacgatggccatgatgacgccgatgtagatgatgtcgccccacatggaggcgtcaatcacgcggtccgtcaccttacgcggtttacgacccatcacatcgtcggtctgcgggtccacgcccatagccaacgccggcgcggcatcggtcagcaggttgatccacagcaactgtgtggcgagcagcggcacggtgacgcccacggtttccggctggcggatgccgaggaagccggcaaacaccacaccgaggaacacggtgaacacctcacccacattggaactcagcaggtagcgcaggaacttgcggatgttgtcgaagatcacgcgaccctcgcgtacggcggccacgatggtggagaagttgtcgtccgccagaatcatcttggcgctctgcttggtcacttcggtgccggtgatgcccatggccacgccgatgtccgcggacttgactgccggggcatcgttcacaccgtcgccggtcatggccacgatgttgccttggcgctgcaaggattcgacgatcttgagcttgtgctcgggggccacgcgcgcgtacacggacacttcggacgtggccttgtcgagcgcggcctcatcgggcagctggtcgagctggtcgccggtcagggccttgccatccttggcgatgatgccaaggtcggaggcgatgcgggcggcggtcagcgggtggtcgccagtgatcatcaccgtgcggatgccggcacgatgggcctcggtcacggagtcgcgcacctcagtacgcggcggatcgataatgccgaccatgccattccagatgagatcggtttcgatggcttcggcctgatcggcgatgtcggacacctggcctgcagcgttgacgcttacaccgggcacatcagccaaagaaccggtttccagcggacggcaggcctcgccaagcgtacggtaggcctcggaggagagacgttcgacggtggcgagaatcgactggcgatcgccttcggtgagcttacggacctgaccacccacgcggatgcgcgtgcagtagctcaacagcacgtcgggcgcgcccttggcgaacacggtgagcttgtctgaatcggtgctgtccttggcgatgatggacatgcgcttgcgttcggaggtgaacggaatctcgccaacgcgcgtgtatcgcttgatcttgcgatcggccttgaccttgcgtgcggccacgatcagcgagacttcggtggggtcgcccacaatctcccaacggccgttctcctcgcgtagttcgccgtcgttcgcgagcgtgccggccacgagcgtggcgacgacttcatcggccacaatctgggcctgctcggattcaggactgacgccgccggtcataaccatgcggccttccggcgcgtaaccggtgccagtgatctgcacttcgccggacggggtgaccacacgttccacggtcatctcgttgcgggtcagcgtaccggtcttatccgagcagatcacggaagcggagcccaaggtctccaccgaatgcagtttcttgacgatggcgttgtgcgcggccatacgctgcacaccaagcgccagcaccacggtcaggatggcggccaagccttccggcacggcggccacagccagcgagacagccaacagcaaggaatcaatcacgtcatggacatcgttgaagccttccagcacggcgagcgccaccagcaccacgacagcgatgacgcacaccgcaatgccgaggatcttggagacgtaatccatctccttctgcagcggagttttctcatcttcggtggcggagagcatgtcggcgatcttgccgacctgcgtattcataccggtgccggtcacgattgcgcggccggtgccttgcgtcacggaagtgccgttgaagatcatgttggcgcggtcgcccagcgccttggcttcggtgagtgtgtccggcttcttgccaaccggcacggattcgccggtcagtgaagcctcggcgatgcgcaggctggccgcgttgaccagtcggccatcagcggagaccgaatcgccttccgcaaggacgatgatgtcgccggggaccacgtcggcggtgttgatgcgcatgaccttgccatcgcgcagcaccgaggtctgcggggccgtcatttgtgcgagcgcttcgacggccgcctcggccttggcttcttgcatatagccgagcacagcattgacaatcaggatcaagatgatcacgatggcgtcgaacggcagcacttcgccgccttccgcgccgggctgcgcattggctttttcgatgaaccaagcgatcaccgagataatagtggccgcgatcagcaggtagaccagcggatcttggaattgggccaggaatttcttccatttcggtacgggcggggcgctggcgagctcgttcgggccgaatttggccagtcggcgcttggcttcttcctcgctcaggccgtgggatgggtcgacgttcagggctttggccacgtcgtcggcgctggtcagacttggatcagtatcccccaatagcgcttcctgtgcgcgcacctcttccgattccacgaccccgttcgttgcggtcgtggacactgcggattgatctttgagatcatccataatgttctccttggtattgccgcggagtagtcagccttgcggccgctgccgggttttctctcccggctggacgcacaggactgcgcggttatggacaccggcgcaactgctgccgatgcatacgattgccattattccataaccgcgtggcgcacttggcgcacagcgtaatagcgttttgcctagaacaggcgacgcaaccaggcctcagccaaatcaggccaacactgcacgcattcgacgatgtgcgcatagaagccgttaccggcagtttccgcattggccaaggacaggccgtggctgccttcagggaacaggtgcgcctcaatgctcacgccggcggcccggcaggcctggatgagcattagcgtgttctccacgggcacggcgtcgtcggtcatggtatgccagacgaagacgggtggcgttttggcgtcgatgtgcttttcgatggagaacttgtccagcaaagcctgattgtgagcttggtcccctagcaggcattggaagctgccgcgatgggcgtacttgccggcggtgattactgggtacgagagcatcagcgcgttcgggcgcacggcgtccgggtctatgccgccctgttcgcggatgtcttcgtcgccgaccgaggtggcgaggttggcggccagatgcccgcctgcggaaaagccgagtacggccacttgcgcggggtttacatgccactgatccgcattggcgcgaatcaggcgcattgcctcggcagcctccagcaaagccaccggatagcggctgggctgcaccgaatagcgcagcacgaatacggcgaagcctttggccaggaattgcagggccactggctcggcttcgcggtcagaagtcatggcgtagccgccgccaggcaaaatcaggatggccgggcgtatacggtccggttccatctcctcgctgttgtcggccacatagccaaagaatcgcgcctcgctgccatcaatgccaacgatggtttgttgaatgtattgcatgccatacatcatacgcgcagagaatagttctcgataagaaccactcgccatatgcggtcttgcccgtatctccaaaccgaataacgcttacagcgaatcgtgaagactgcgggccatggcgcggtcgcgcgagcctttggtgagcttgagaccgagggtcacggcaatcaacacaacagtgcaggcgatccacagcgttcgaccgccgaagttgctgatagtccagccaccaatcagcggcgccagcgcaatcgacgccgaccacactacgttgtagacgccctgatacgtgccgcgcgccgacgcgggtgccatggcggcaaccgtagtggtggcgatagggaatgtgcccagctcacccagcgtccacagcactacggcaagcgcgaatccgccccaagaatgggccgcggcctgcaccgcatagccgatgacggttacggcgaggcccatcaccagcacgcgtgaattgcccatgcgcgcgaacagtttcatcgcgggaatctgtagcaggcacaacataccgccattgatggtgagcagcaccgaatactcgcccagccctagaccaaggtccgtcatggcaatgggcaggccggaggtgctttggaagtacacaaggaagtagccgaacatcagcagggagaagccgaggaatggagtatcggtgagcacgcgccgccaattgcgagacatggcgcccttgacactggcagccggtgcggcatccgagtgattcggcctctcaatgccggcgaattccgcatgggtaacactgcattcgtcttcatggcgcaccgcacttggcaccgatacagtaatccccaaatgccgtacctcgcggaagaacgcaatcagcaatatcgtgacggctatcatcaccgccgcttcaacgtagaacatcagcgaatacgagatcttgaccagctggttggccacaatcggtccaatcgcgtacccaaaattaatcgcccacgattgcagtacgtatgcacgttgctgacgttcggcaggcaccacatccgcgatatacgcggcgatggccgggctgggcagcgaggcgaacgcaccatagacgaacagagccgcgcctaaagacacaggatcagtgagtacggaaacgaccagtagggcagccgctgcgccgatttcgccgatgataatcatggattggcggccgaatctgtcggacaaggtaccgccgaacaggcagccgatgattgcgccgaagccgtacatggccacgactgtgcccaccacaccctcatcgaggcgcagcgcggaaaccaaatatatcgacaagaatgaggtcacgaagcgacccatccacagaatcagaatcgccaaccataatccccaatacagcagggacagtccgaatatcatacgctgcttcttcactctcaataccttaccggctaccgacggcggaatagccgcgttttggcgcggggtgctgggacaatagcacctatggctatcaaaaaaggaccgaccaaggggtcgggtggcaagcatcgcaacaaactgaagggctacggccccactcccaaggccgaggaccgcgtctatcacaaggcgtacaaggccaagaaagcggccgaacgtcggcagatggccgacccgcgtctggcagcccgccgtcgagtggacaagttcgcttcggcggatacttcggatctggtgtacggccgtaattccgtgctggaagcactgcgcgtaggcgtaccttcttccacgctgtacatcatgtctcgtattgaacatgacgatcgtactcgcgaaatcgtgaaaatcgctggtatgaacggcctgcacatgctggaggccgatcgtctggagatggatcgtatcgcccgctctggcaaccatcagggcgtgattctgaaggtcgatccgttccagtactcctcgctgaacgagctggccgatcgtgctgagaagaaggccaaggcaatggaggccgcgaattcggcggccgcccgtattgctgcgcgaccgctgtttatcgcattggacggcgtgaccgatccgcagaacctgggtgccgtgattcgttcggcggccgcattcggtgccaatggtgtgattctgccggaacgccgttccgcttcagtgaacgccgccgcttggaaggtgtctgccggtgcggccgcgcatatgccggtggcgcgcgtggtgaacctgactaaggcacttgagggcttgaaggagcgtggatactacgttgtcggccttgacggtggcggcgataagctcgtcggcgagactggctttgaatccgatccgctcgttgtagtgctcggttcggaaggcagcggtttgggccgactggtgcgcgaaacctgcgacgcgattgccggcatcccgatcagctcgtctgttgagtcgctgaacgcttcagtggcggcgggtatcagcctgtacgcggtgtccaacgcacggcgcaaggctgcggcggagtgattgtcgcttgaggccgtaataggttgtacatacacggaagcccctctatttgaggggcttctttgtgtgatgggctcacctacagacagtccaccggattgtccgcttaatgactccacactgccgcatccggatcgtcatcggggttgtagccgtcgtcgtccgggtcgctgtaggtggattcgtcgtcaatgacgccggaatcggcctcttcgttaagttcggcgagtgccttggagtcaaggctgtagctcggcagagcgttgtcgatgtagctggtcacggcctcgcccatcggcacgtcgtggccggccttctccgccaggaaccagcgatggtcaagcacctcatggaagaactgagcaggctcgatctgggagcgatattcgcgcggaatcatacgcacggtcggctcgaacacctcacgcatccagtcggtggccacgatttccagatcctcgccctcacgccacgtggaggcacggtaggcgtcaaggtcgttgagcagacgacgggcctggttctcctgcacgtcaaggccggtgaggcgcagcagcttgcggttggcgtagccggcgtccaccacgcgcgggcggaccagcacacgcttgccgtcctcggcggtcttcatttccagctcgtccacgtcgaagcccagctcgttgagcttgttgacgcgctgctcgatcttccacatttcgtccgggttgaacttgtcggtgtcggtcagggcgctccacagcgagtggtagcgatcaaccaggcggttgcccacctcgatctcatccacgtcgccgggcagtagcttgccggacgccaaatccataagttcgccgatgatgttggtgcgggccaagtcgatatcgtattcgcgctggccgtcggtgagctgggcttgcaggtcaccggtctcggcgtccaccaggaaggcggagaaagcgtcggcgtcgcgcaggaacaggacgttcgacagggacacatcgccccagtagaagccggccaggtgcaggcgcaccagcagcacggcgagggcgtcaatcagtcgttcggcggtgtccgggcgcagattgcgggcgaacaacgcacggtacggcagcgagaacttcaagtgccgggtgaccagaatcgcctccagcggctccccttcacgggtgtgacggccgatgaccacggcgatcggggtcacagttggcagttcgagcttctgcagtcgacgcaggatctcgtactctcgctcggccacctggcgcgtgatctccttcatggcgtacacctcgtcgcccacgtgcacgaatcgcacgacgtggcgggagatgcctcgcggcaggttggccagcaggtcctcaggccaggtggccaagggcttgtgccagggcagcgtgaacatcttcgggttcgagctggcggcggtgattttcagtgcttgcggctccgctgaattggcgtgttcgtcttcggctttgacagacgtggccttcagcgcacgcggatccatctggggcaaatcgttcaactccatgtgttcgattttacgtgtcgttcgcgatgtgtgctcctttgccacgacttcggcgcgttatgtttacgggaaaaacaccgtttggtctctccctcagaccgtctaaaaggcaaaagaaaagccccgcagctatgcagggcttttccaacgaggccataagagaggaagagaataacctcgtttaatggttgacgaagcgattagacctcgccaagtatctattagttcagacgcagctcagtcgacggagcgaacaggtgcatcttggccgggtcgatcttgatcttgacggtcgcgccaaccttcggcagcgcacgcggattcacacgaatcgtggtgagcttgttctggtcggacatgacctgggaagcctcagcggcggagccatcggtgatgatgttgccgtagatgtagccatcggagcccagatcctcgacgttcacaaccttcagggagaaggcgttcgggtcgtcagccggggccaggccagcgtcctcaggacggaagccgaccacgatctggccgttgtcttcggcggtgagcttgttgacggcctcagccggcaggtccacggtgtcctcaccgatcttcgccttgccgttgaccaccgggtgggtgttcaggttcatcgacggggagccgatgaagccggcgacgaagacgttggccgggcgatcgtacagctcggtcggggcgccgacctgctgcaggataccgagcttgatgacggcgatgcgatcgcccatcgtcagggcctcggtctgatcgtgggtcacgtacagggtggtgacacccagctggcgctgcagagcagcgatctgggtacgggtctggacacggagcttggcgtcgaggttggacagcggctcatccatgaggaagaccttcggctcacggacaattgcacggcccatggccacacgctgacgctgaccaccggacagagccttcggcttgcggtcgaggtactcggtcaggtcgaggatctcagcggccttctcgacgcgcttgcggatctcgtccttcggagtgccggcgatcttcagggcgaagcccatgttgtcggcaacggtcatgtgcgggtacagagcgtagttctggaacaccattgcgatgtcgcggtccttcggctgcatcgtggtgacatccttgccaccgatgaggatgcggcccttgttgacctcttccaggccggcgagcatacgaagggtcgtagacttaccacagccagaagggccgacgaggacgaggaactcgccatccttgatatcaagattcagatcatccacggagggcttatcgttgcccgggtagatacgagtgacgtggtcgaaaacgacttctgccataattactaatcctttcagaggcaggtacgtgcctcacgatccgttgtaaagggatttgttctttactgtgcttccgccctcgccaccgacgtacaactttgctttcggaaactgcaagcttcagcgtttacttttttccggttcagtgaaggttctcttcgttgagccgagaactactatacacggaccgtggaccaaggcaagtggcgtgtctgaaatgtagttaactttatgggcgtttctgggggtgttgtgtggttcggcccatgacacgcctgcttctcgaacgtgcgaaccggcacgcccgacgtagagcaggtctgctcttcccggactgatggattccatcagtcgccgactaatgcgacacagactcgaaggtgacgccgttgcgggcggctttgcgctcggccttgcgctcctcggcgtcttcgatgcgctggatgcgcagctggcgccagtcctcgcgcatgtcgcggaaacggtcggccagcgttacgtcatcgttctcggcatcgccatcagtactgctgccatcggccttaccgaacgtgccatcggccaccttggcgatgcccagcttgagcagtccgagcaactcacgcaacgtttccggtacgggctcatcgccctcatcggcggacttggtcaggccctcgatgcggcgacgaagcgcgtcggcgtcctcgggatcgatcttgagcccggcgatcagcgactggcgcatggtctcgtaatcgaggttggcaaaaaaattcagctgttgcagcgtcatgaagcccttgagctcggggaatcggtggacgatgtattcctcgcggtcgtcggcggcgcgggtccagtcgcgggtgagctgcggatcccagctggcggtaatcgacccctcgcgcatgcggtagtggtacagcgccttgggcagacggaccacgcgcgtggcctcgccgatcacgttgcagatacgggagagatcctcgattttgcgacccaccgggaaggagaatccggtgccctgataggtggaggcgggtgccaggaaggcccagaaatagccgtcgatctcagccttgacctgctttttgatggcctcgaccggggtcagaacctgcacctcggtgaagtcgttgtggcgatagttggacagcagcggcttgttgttctcggagatggtgtcgaactggaacatcacgaggtcggcgtcatactcgcgcatggcgttcaggcagtcctccaccaacgtgggggccacggtgtcgtcggaatcggcgaagtatatgtacgcaccggtggccccggcgatgccggcgttgcgggcgtcggacaggccgccgttgggcttgtgaatcacccgcacgcgcgggtcgcgggtggcccaagcgtcgcacatggccgggcagtcgtcaggcgagccatcatccaccagcagaatctcgaggttgcgataggtctgcgcaaccacagacttcacgcattcgtcgaggaatttctcgaccttatataccgggatgatgatgctgaccaacggctcctgttccatgcctccagcgtagcgccgtcgtgcgaacgcggcggcgctgcgggttcgcggaccgcgaaacccttagaagtcccagtcgtcgtcatcggtttcttctgctttgcccatcacgtaggaggagccggagccggagaagaagtcgtggttttcgtcggcgttcgggctcagagcggccaggatcgcggggttcacatcgcaaatctcagccgggaacaaagccgggtagccgaggttcatcagcgccttgttaccgttgtaccgcaggaacttctcgacgtcatcggtcaggcccacgcagtcgtacagcgactgggtgtactccacttcgttgtcgtacagctcgttgagcaggtcgtacgtgtagtcctgcagatccaagcgctcggcatcgctcagatgggcgatgcccttctggtacttgtagccgatgtagtagccgtggacggcctcatcgcggatgatcagacgaatcacgtcggcggtgttcgtcagcttggcgtgcgcggagaagtacatcggcagatagaagccggagtagaagaggaaggattcgagcagggtggaggccaccttgcgcttgtacgggttgtcgccctcgtaatagtcgagcacgatctccgccttcttctgcaggaactcgttgttctcgctccagtcgaatgcggcatcgatctgctcggtggagcacagggtggagaagatggacgagtagcttttggcgtgcacggattccatgaaggcgatgttggtgtacacggcctcctcgtgcggggtgagcgcgtccggaatcagggagacggcgccgaccgtgccctggatggtgtcaagcagggtcaggccggtgaagacgcgcatggtgagcgtgtgctcgtcctcggtcatcttctgccagctggggatgtcgttggagacggggactttttcgggcagccagaagttgccggtcaggcggtcccagacctcaaggtctttctcatcttcgaggcggttccagttgattgcggagacgcggtcgatgagtttcagcggtttgcgcggaatggaaatcggtgccatgagtgttccttattactcgttgtcgttgtcgttatcgtcgttggatttgttttcgaactcctccggcgcggtcagccggagcagtgccttataaatcattggtgacattgtgggttcctcagagcatgcaggagacgcagccttggacttcagtgccttccagggcttgctggcggatgcggatgtagtagagggttttgatgcccttgcgccaggcgtagatctgggccttattgaggtcgcgggtggtggcggtgtccgggaagaacagcgtcagcgacagtccctgatccacgtgctgggtggcctcggcgtacgtgtcgacgatggccttccagccgatctcgtaggcgtccttgtagtacccgaggttgtcgttggtcatgtaggcggccgggtagtacacgcgcccgatcttgccttccttgcgaatctcgatcttggaggcgatcgggtgaatcgagctcgtggaatggttgatgtacgagatcgagccggtgggcggcacggcctgcaggttctggttgtagatgccgtccttcagaatcgcgtcgcgcagggcctcccagtcggccgcagtcgggatcgcgatgccgtactgttcgaacagcgcacggacccgttcggtgcgcggagtgagcgaacgacgaccatcggtgtacttgtcgaagtagttgccctggccggccggcttggcgtagtcgctcgtagcgaagctggcgaacgtgcggccatgctccacggcgagcgcgtgcgaggcacggtaggcgtggtaggccacggtcatgaagtacatgtcggtgaagtcgaggccctcttcagaaccgtactggatgccttcgcgggccaggaagccgtgcaggttcatctggccgagaccgatggcgtggccctcctcattggcgcggcgaatcgaaggcaccgcgttgatgctggtgtgctcggccaccgaggtgagtgcgcggatcgccgtctccaccgtgtggcccaagccgccatccatcgccttggcgatgttgagcgaacccagattgcaggagatgtcgcggccaacatgcgcatacgtgaggtcctcgttgtatgcgctcggctcctgaacctgcaggatttccgagcacaggttggacatggtcacgcgaccttcgatcgggttcgcgcggttgaccgtgtcctcgaacacgatgtacgggtagccggattcgaactgcagttcggcgatggtggtgaagaacttacgggcgtcgatgtaggtcttcttgatgcggtcgtcggccaccatctcgtcataatgctcggtaacggagatgtcggcgaacggcttgccgtacacgcgctccacgtcgtacgggctgaacagggccatctgggccttctgtttggccagttcgaacgtgatgtccggaatcaccacgccaagagccagcgacttgatgcggatcttctcgtccgcgttctctcgcttggtatccaggaagcgcaggatatcagggtggtgggcgttgaggtacaccgcgcccgcgccctgacgtgcgccgagctggttggcataggagaaggagtcctccagcagcttcatgaccggaatcacgccgctggactggttctcgatgtgcttgatcggggcgccgagctcgcgcaggttgctcagcagcagggccacgccaccgccgcgcttggagagctggagggccgcgttgatgccgcgcgaaatcgactccatgttgtcttcgatgcgcaccaggaagcagctgaccggttcgccacgctgggccttgccgaggttcaggaaggtcggggtggcgggctggaagcggccggcaagcatttcgtcggcgtattcgatggcctgctgctcattgccggcggcgagctccagggccacagcggcgcaacgctgcgggaagtcctcaagatagaggcgaccatcgaacgtcttgagcgcgtaggacgtgtagaacttgaacgcaccaaggaaagtgccgaactcaaagccggcggattccacgtgctcgtagatgcggtcgaggaattcagcggagtactggttgaagaccgcagggttgtagtactggttgctgatcaggtattcgagacgctcggcggtggaggcgaaccgcttgctgttggtggccacgtgccctgtcacgtattcgcgttcggcggccttgtctttgtcgaactggatcttgccgtcggcgtcatagaggttgagcatcgcgttgagcgcgtggtaatcgtgcgccgggtcgtactgttccgctgcggtgtcggcagtattgtcgagcggcaggccggtggcggtgaggtcagtcattggaaatccttggaatatggcagaagtgtgtttactcagacagttgctccccccagtcaacttcgttgacagctcccctcggagaggggagccaatacctcgagggggtcaagatttactgttcggtgaagaagcggacgaggccgtttcgcacggcggcagtgtcttccggggtgcccatgagttcgtaacggtagaggtagggcaccttgcatttggcggcgatgatgtctccggcggcacagtaggcctcaccgaaattggtgttgcctgaggcgatgacgccgcgaatccactcgcggttggctggatcgttgaggaagcgtttgacctgaatcggcactgctttcttgaccacgccgccgccataggtgggcaccatgatgacgtacggttcgcggacgtttagcgccgggtcggcggcccgcaacgggatgcggtagacgttgatgccttcgtcctgcaaacggcatccggccacgaaccgtgcggtgttttcggaggccgacgagaagtagaccaatgcgccgatcgtcttgccttcggccgcgaattcgggctggctcagactcacgcggacaccgtggcggcggcgcggttgtcggcggccacctgctgggcgacttcgcgaatcaggtcggggcggtagccggtccaggagttgtccggcgtgatgaccaccggagcctgctggaaaccggcggcctgcagctgctcaagggtggaggggttctgcgtcaggtccacggtttcaaacggcacacccagcttggtgagctggcgcttggtggcatcgcactgcgggcaatgcggcttggtgaacacggtgacggtcatggcgactccccttgatgtggttctgatgaacagtgaagcgaaggccatattacagcggtgtgatttgaaatcaaggcactatatgtagtggcgcgtgtcacataacaaacctagatatagggtttttcgttgatattccgccattcccatgcacccccgaaaatcggcgtgcagcgacccgcccaatcacatgtggcattgttcacatttgcgtttgaaccgctcttcgactgatcctcaaccgccctgcaaccgccatcttgagtttcgaggggctgttttgaccctttccggagatctatctccgtttcgaggggctggtactcaagtaagcgcatccccaaaatggcggaatgacggtggggcgaagccgtttatacccgtgttctagcgggccaccagcccctcgaaacgggagtaaacctctacggaaggccaaatcagcccctcgaagcggagaacggatacctcggcaccccgtgtggagccagaaggcccggccggatgtccaaacgagcatccggccgggccttaaaagtagttgttcagttatcagaatcgatgcggcgcgatactactccgcgtctttacggctccaacagatcttcgatgcggcagccaagcgtgcgggccaaagcgagcacggtggagacggcagctttgccaaggtctttgcggcgctgctcgtacatttggatggagcgcagggtaacgccggagcggcgggccaacccggattggctgagtccggcgcgcacgcggatcgtgtgcagccgggagtcgccctcggtgcgattatgggcggcccgctcgtcgtacacgtcgacgaatcggctttcgtcggcttcgtgcagagtcgggtacagtcgcacgatatcgtcgagcgacagcacatcgagaatgtccgagaaccgcactcccctggtccattggcagtatgcgagtacccatccggcccagtattcgggtgttgagccggcgcgcagtgcggctggcggcatatcgagaatgcgcgcccaaccggtttgccgcatgatttcggccaccagctcctcgccggacatgccacacacgtatttgggcgtgcctcgcccgaaaagcgcggccgcctcggaggtggcgaagaagtccatgaataggccgaccggcaacccgcaatcgttcagcgcataatcgaaggcgccggccaagttggccatggcgtccggcaagtatgtctcatcataggcggggatcatcgttggtcactttctcgcggatgatgtcgcgcatgaacaggccgtcgagatcggcttctgcgctgttgcgacggtaggcttcacgagccgtgcggtcgcgctcgttgcgcaatacgtggtaggtcgaagcgcgggcgatttcgcagccttggaaccgcagcgccgcgaatgcctgaggactggcgagtacgatctgcttgccgagctcgcccaaccgcatcgcctcagcgagttggtcgatggaaatcgcgttattgacaaaagcgcgggcgaacgagaaatacgaatcgtcggcacgatatccgacgatgacgtcagcctgactggcatccggcagaaacacttgtttcagatattcgatgccttgcgcggcgacggcggtggtcggctggaaacgacggttttcgaccagcatggccagccagttcaggatggtgtagggcggctgggacaggtccaggaagaggagcccgtccgtggtcaatgtgtaccgattcgcgaaaccgtcatccagtcccgcgcacgcccattccttggccagctcgacgctgcgcgtgcaatagaatccgcggccataatcgttgttcggcttgaccagcccgtattcaggatgcttgatgacatgcgaagagccatgccacagttcgatcgatgcggtctccattggccggctccttctctctccttacatattcttgattatatcactgtggtgatagtcataagggaaatacgagatgaaaaataccgctgtatacgttcgtacacaacgtgaaatgtatacgaacgtatacaacactgatgtccggagtcatgctccgcagtggcgcagcggacgcgccactacaatcggaatatgggactgaagacgtggaagaagtggacggactggccgctgatggtgctgtccgtggtgtttctggtggtgtattcgtgggaaattctctcccgcacgcatatcgcgctgtgtgaaaccgtcatcaacgtgatctgggtggtgttcgtcgtcgattatgtggtctcgctgtggttggccgacgatcgctggcagtggttcaagcacaacctgttcacgctgctgaccatcgcgctgccgatgctccggcccttgcgactgttgcgtttgctgaccgtgctgcacgtgctgaaccgcacctccggcatggcggtgcgcgggcgcatcaccgtatacgcggtcggcgcggtgggaatgctcatgtacgtgggcgcgctggccgtgtattccgtggagcgcggggcgtccggatccacaatcaccgacttcggcacggcgttgtggtgggcgttcgtgaccgtgaccaccgtgggatatggcgacttctcgccggtcaccttccaaggcaagatcattgcggtggtgctgatgttcaccggcatcgcgttgatcggtattgtgacggccacgctggcctcgtggatcgtggatcaggtcaatctggagacggatcggcgcgaggacgctcgggagaaggaagtggccaaggaagccgcgcaagaggctattgcaacatcagccaatcccgaaatcgacctattgcgcgaggaagtgcgtgagctgaccgctacggtagccggtctgcgcaccgaacttgagcgacgttgattggcgaagcgggacaaacaacgattctgccaagaaggtccgcgccagttgttgtcaccgcggattgcggcagaatcattgtcgccatggctgttttcttcagtcggctcaacccaacttttgataatttttatttttttgatatttttgataatttttattttaggttgattcagcgaggaggcggtccacatgaaggcaaaggaaaacccattcaagccaacggcaggaggggaaccgcccctgctcatcggccgaggcaaagttatccgcgatttcgagaaaggtctcgataacggagtcggtgccccagggcgcattatgctcgtcaccggcgctcgtggaaccggaaaaaccgtgatgctcactgtgttcggagaccgggccaaagcgcgtagatgggatgtcatcgaagaaacggcctctgccggactatgcgaacgccttgttgatgccttacgaaccgggcgaggggcccttgaccacctcactatccgaccatcgttgacttttgctggagcgggcatcggcctcggagaagccgaactatccccgaagcgtatgcccgaaacgttgagaagtgccattgccggacggttggatgcgcttgagaagcgccatgctgggttgcttatcaccattgatgagactcaagcggctgagcgatccgacatgattgccatcgccactgccatacagcatcaaatcagggaacgacgcaatatcgccatcgtgttcgccggtctcccacagatgatttctgatttgttcaatgacgaagtcatcacgttcctacgtcgcgcgaaaacgaacatactcacagatattcctcttgatgaagtgcgcgatgctttcgccacaacattccgcgcctccggcatgtccatcaccgacgctcaattaagcactgcagccaatgtgacagccggatacccctatatgattcaactggttggctaccatatctgggatgccgcagacatgcgggactcggataccatcatcgacgctgatgttacggcaggtatcgaggaagcacgtattgaccttgataacgccgtgtgcatcccggagttgcaaggcttatccaaaaacgaccgtgagtatctcgaagccatggcagcgtcagatggtccctctcccaccgtgaatgttgcacagcgcatgggcaaaacgcctaactatgccgccacctaccgcaaacgcctccttgacgccttcgttatccgcgaaacagaacgaggcgaagtcgattttgccgtgcccttcctgcgcgaatacttgcgtcggaatcagtaatcggcacaatgcacagtatcgatatattccgttccatataatgacttttcgcattcagatacacaatggacggcctgctgagtagcactcagcaggccgtccattctatttagctattcagttatcggagacacacctcaggccttgaccggagcgtcagcgacctgctgggaggccatcacgccgaacaggtagccgtcttcggagaagtattcgaaggtacgaccggcgaagtcgcggcattcgaatctgatatcgttatcgattcgatcagcggctcacgatactgcccttgcatcgctgtgccactgttgaatgtgcccggctggctcacctttgggtcaccgccgacacatccttgatgccgatggttatagagtcgcaaattcacgactggcgcacctgcccacgcacctatcctgtcatttcgagcgcataatttgctaccacatccggtcagggcaatcgaccttaatggcgtaaacggcacttctcaatacgtaaacggcatttattcttggctcccctctcagagaggggagccaagaaatatcaagctcggcctcccaggagagggccagaataatgcaccagcaaggcattaggatggagggcatgagcgatttgaacgcgttgaatcttgagcccggcgaagtggttggtgggtatacgctgatctcccggctcggctcaggagctatggggtcggtgtggcgggtgcgcgacgacggcggcaccacctatgccatgaagattctgcgcgactccctgaccgacgagtcagtggcaggctccggctctgcgtccacggccctgcacgaccccgacctcaagcccgatgtcacgccgcgcgagcgcctgcggcgcgaggccatggccttgaagaagatcaatcatccgggtgtgtgcggcatcgtggatatggaactcgacgatacgttggcgttcatcgtcactgaactcatcgagggcaagaatcttaaggatgatgtggccgccaatggccggtatgtgggcgacgatctggaacgcttggcccgcaagctcatcgaagccaccaaagccgtacatgcggccggcatcgtccatcgcgacatcaaacccaccaatgtgatggtgtcggccgccggaccggtattggtcgatttcggtatcgcgatgggcgagggcgaaagtcacgtgacccgcaccggcctagtgatgggtacacccggattcatcgcacccgagattattgacggtgccgaatccgacgacgccaccgattggtggtcggtggcgtccgtgctcgcttttgccgcaaccggcgcgcctgtgttcggcaccaagccgatgatggcggtacttgagcgcgaggcctcgggcaacgcgaatctttccggactaccggccggcacattggctgccttccgttctgcactggacccggatcgcagggatcgttgcacgccggatcaattgctgaatgccatcgccttggatgcgttgaatcccaacgcttggcagggcgagcaggcgggaccgttcgccgcgggagccgtggctggacaaccggctgcgatcgttgccgaagccgcggaggcgatgcccccttttggcgcggccggcggcgttgaccgcaataatccccgaaccatctggcgcgcggccgaggaagccgctgaggctcccaccatggccgtgttctccggcaataagggcgataacggcgatggcgaaaccgccgtattctcgccggctggcgccgctaccgccacgctgcccttagccgatatgccgccacgtccgccggccggtgcggagcaggccacgcaactgttgcccgacgctgctgccgatttcaccgacgacgccggcacgcaggtactcaccggcgcgaccacaccgatgccggaccaaaccacgccgctggccgagcgcaccaccgtactccccacgccgcagccgtcatcattccccccgtccggcaccgcccagagcagctgggatcccgcaagcaaccagcccacagcggtggaccccgccattcgcccggcattgcagcgcatcatcgaccaaaccgcccaagcggcccccaccgaaaccatggtccaaaatcctcccatgcccaatccggtggacgtgaagcgaggggaatatctgcagcgcggcaccctgccattgatcctgctggcggcgccgctggcggcactggcggcaaatgctccgctcgtggccatcatcgcggccactgcgttgttgtggctactgctcaccctggcctataacaccgaaccccagcttgagcgcgagggcaaacgcggcggcgagcgcaaaaactccgattcgtggattcgcgtggcgacttttccctggcatctggtcaaagccctgctgctggccattccccgcatactgctgctagtcatcatctatatggcgggaaccgccgtggccaccgcggctctggcactgcccgttcacaccatctcctggtatttcaccgcggattggggtattccggtgccgttgctcaatgatgtgccgttctccgcttccgggctggcgctgggcggtttcatggccatcggctggctggtcactgtgttcgccccacagtcgatgatgattcggctggggggcggcgtactgcgcgggctcaaacacagtcgcccggcgggcgcgccatccaccgaagtgggtggggctccacctgctccagtggcgccggcgcccaagggcggcgggcgcggcaccgtgctgttcaccatatgggccatcatcaccgtggccttgtgcgcgatgccgattctgggcatgccgatcaactggatgccgttcgcctagagcggggcggaatctcacacatcagccatccgcacacatggccgttgtgtatccgatacgttcgttccgtcacacttttacagggaattcacctcagatcagctctgggcgcagtcctcctcaggcccggtcattatgatggggcccaaacattgaagcgattgcaaggggatagctatgtcagatccgaagcgtcaggccaagcgtgccacacgcgctgagcgccgagcggccgaggaggccgcacaacaggcacgggccgagcaggcagccaaggagcgtaagcagcagaccatcatcggctgcattgtggtggccattattgtggtgctggtggccatcgctggattcgccgtatacaaggctatgcggccgtccaacaccagcagcagtagccagcaaagcaacatgaccgtggacgaggcctatagcaagctcaagaaagtcagtacccagccggctaacgccgacgacaaggccggcttcgtaatctccaacaaagggtatggccagaaagccgagggggctcccaccgtatccatctacatggaaccgctgtgccccggctgcgcctcggtgaaccgccaactcgacccgacgctcgtcaagctgatgaacgcaggccagctcaacatcgatttgcacttcctcaatttccagaacaacaagagctccgacaactactccaaccgcgtgttcaacggtgccatctacattgccgagcatgatgacgatcccgaccacctcatgagctacctctccaacatctacgctgaggatttccagccgggcgaattgtccaattacgagccggtaaacaacgccaagctggagaagcaggccgtcaaggccggcgtgagcgaggatgtggccgccgcggcgttcagcggcaagaacgaatacctcgactggctcaccgcctccaacaactacacgatcctgcgccccgaactgttcaacagctccggcgccttctcctcccccacactcaccatcaacggcgaatactgggatctgaagcagctcacgctggcggacacgaatatggtggacggcttcctcaagtccattgggctggatgctgaccaggtaggcgtggaaggcaaaatgccatccatcggtgccagcggaaagccgatttcggtcacctcctgatgctgcgtggccgaataagttgacgccgcgacatatgcaataccgcctgcggctcggcttaaattgaccactcgggaagtaccggtatactagtcatttgttcgcaacgatttacgcgttaagaacaatcgcctctttagctcagatggccagagcggccgccttgtaagcggcaggtcgtcggttcgatcccgacaagaggctcgtcgcgcagaaaaaatggcgtattatgtgatacgtagacttttctacgcatataattcttaccttgggtaagtactccaggagccttcccccaattatgggcttcctggaatgagggcggagcgtcccccaaccagctccgcgccttcaagggggcgggaacatccccttctctcccgccccccttttcttttctttttttgagctcagaacaatctgacgagcaggaatggtgacggtggccggtgaaaccgcagtacgggccggaacaaccgttacgatgggtggcgtaatcgttcacccagcaggaagagtatggcaatggcacggcgttggaccccgcagcggtttgttacactgcgtcgcatccgcgtaatcgcctgtatcgcggcgaccagtatcgcgctggctggatcattcgcgttcaccgcgcgtaaatccgtggccctgaacatcaacgggcaaaccacccaagtcaccacatatgcgatgacggccacccgtcttctggaggaacaaggggtggatatcaagacccacgatatcgtgaccacctcgtccggcgaccagctcgccaatcatgccgtggtcaccgtacagtccgcctaccagaccaccatcaacatcgacggcaccgccgtgccgttctggaccgtggccaccagcgccgaccagctactgggatttttcgaggaaaaccagaacaacgccgcgaagatcaccgtcgacatcaagaacgtgtacaaccagctcaccggcggcctggtgatcaaccagtccgggccggtcaccgtcatcgccgacggcaaaagctcggtggcccccaatggcaagctgccggccgcctccatcctcgattccaagggcatcgtgctcaacaaggaggatcgcgtcagcgttgagaaagacagcgacgagaccattctgcgcgtacgccgcgtgacccacggcgaggagacgcgcacgtccgtgattccgttctccacccagaccatcatcgacccgaatctggctgaagggcaggccgatgtgcgccagcagggcgtcaacggcgagaagacgcaggtgtacgacgtcacctatgtggatggcgtggccgaatcggagacgctgaaatcggagaccgtcacctcgatggccatcgaccagatcatcgccgtaggcgccgccaagtctgataccgataaaggttccgataagaaatccgactccgccgataacggcaaggccgattccggttccaacaatcagcacgagtcgtccaacaacaatgccggcaacaccggcggcaacaactccggcaacaccggcaattccggcaacaccggcggcaacaactccggcaacaccggcaattccggtaacactggcaacaccggtaacaccggcaactccggcaacactggtaacaccggcggcggtacgaacaacaattccggctcttctggctccgattcaggcacaaccaccacgccctccggccgcctgtggcacgccaccgtagcccaggctcaggcctatgccgccggtgccgccgcgcagcgcgggtggacaggcaacgactgggattgtctggtcaaactatggacccgcgagtccagttggctgtggtatgccgaaaacgcgagctccggtgcctacggcattcctcagtcgctaccagcagacaaaatggctgcgttcggtgccaattaccgtgacgatgccgccgtacagatcgattggggtctgtggtacatcgcacaagcctacggcagcccgtccaaggcatggcaacattccgaacaagtcggttggtactgatcagttacgaagcccacaaggaacacacgcttatgaacgacaccattcccgccactggtcacctgttaggtgccgccgatatccgtcgtatcgcggccgatgccggcatcagccccaccaagaaattcgggcagaacttcgtcatcgaccccggcacggtccgtcgtatcgtacgcgaggcgggagtgaccgctgccgatcatgtcatggaagtcggccccggcctgggatcgttgacgctggcgattttggaaaccggcgccaccatgaccgcagtcgaaatcgatccgccgctggccgaacgactgccgggcacagtcgccgaattcatgcccgaagccacgtcacgactcaccgtcatcaatcgggatgccttaaccgtcaccccggagaacgtgcctgatttcagcgatgacgcatcgtttacgctggtcgccaatctgccgtacaacgtggccacgccgattctgctcacgctgttggagcgtttcgacaacctcggctcgttcttggtgatggtgcaaaaagaggtggccgacagactcgccgccaagcccggttccaagatctacggcacgccgagcgtgaagctcgcctggtatggcaccgccgaacgggtgggcaccatcggccgcaatgtgttctggccggctcccaatgtggattccgcgctcgtcaaattcacccggtatcaggccgatgacccggctgccccgggaactgcgaacagcacagacgacggcacacaacgggaactcgtatttcgtctgatcgatgcggcattcggtcagcgtcgcaagaccctgcacgcggcattgaagaccattgcgccctccgaggcattctccatcgccggcatcgatccgacccgtcgaggagagacgctcaccatcgccgaattcaccgctctggccaaggccatcgaatcgtgtggagatggagatgaggcacaatgagtccggtaatctcacatccacgctcagccgctgcccgacatcagtccgatgagctctcccccatcaccattacggtggattgcccggcgaaaaccaatctcaccttggaagtgggacctgctcacgacgaatggagcggacgccacgaactggacaccatctactgcgcaatcggcgtatacgacaccgtcaccgcaaccgccaagcaacccggagcaggattctctctggagctcgaaggcgcttatttgggcgacttggcctcctcacgcagcgacatgcgccgcaaccatgcggtactggccctcttcgccatggcccaggcggccgagcgcgagccggatgtggcgttgaccatcaccaagcgcattcccgtgggtgccggactaggcggcggttcagccgacgccgcggcgaccatgctggcggtcaatcgtctctgggagctgaactggcccatagagcgcctgcgcaccattgctgccacgttgggcgcggacatgccgttctgcctgaccggtggccttgcatacggcaccggtttcggcgaacgcatcacggatatcgcccccggcagccgcgatgagctggcgctgatagaacagggattcagcggcgaagtattggtcggcgcataccagtcgcaactcagcactcctgaggtctaccacacctttgacatcgtgggagccgcagaaggcgaccgcaatcatctgcaggctgcggcaatcagcctgcatccccgcagcgggcaggccatcgacgccgccacgcaggcgggtgccagccatgcattcgtctccggatccggcccctcagtggtcgctttcgccgccgacgaggcagcggcacaacgcattatcgaggtgtggcgcgatacagctgtggtcgatcgtattattcgagccaaatctcccgaacaccccaatatcagcgtcagacagtgacgctaaggtagcaaccagccacccgacccatgaaagaagtccaccgatgacgtatcaggttgatgaacgtgaagcccgcaaggcgtacgtgcgccaccgccagaccatcgtcttttccatcagcggcgcggtattggcagtagtgctggtcatagccctactgttcaatttccacgttttcggcctcggcgaagtggagactccggcccgccagccgaattacggcaacgcggcaccgtgcgcggtcaaggacagcagcggcaaagcgcaatacgtgtccaacgcttcggtcggcattcgcgtgatgaacggcacctctcacggccaattcgccaaggccgtgggtgaagctttggccaatcgtggattcagcgtgcagaaaatcgataactattccagcaccgacgttgaacgcaccaccatctacttcggcaagaacgccattaatcaggcgtatacgctgatcggcaatttcaccgacgccaccatgatcatgacggctcgcgaggatcagctcatcgatgtggtcatcggcgccacgttcaacgatctgcaggacaccaactcctccccgcaatccggtaagaccatcaccaatatcgagggttgcaaggccgccgatagcatgaccaagctgcccgccgacaccaaacacgacgcatacacggcgcagtaaggcgcatacagcttcatcttcgcgaaaaaccgtacgctgacacgtattcagcgtacggttttttttggtatcggactagtatcggactactgaatctcggcgtaccagcgcttgagttcttcgacggccacatcgtggtccaccggaccgttatccaagcggtattccagcatgtgcttgtaggcgcggccgatcatcgggccgggctccaggcccagcaactccataatttcgttgccgtccagatccgggcggatcgcgtcgaagtcctctttcttcttgagttcgcggacgcgctcctccatctcatccatggcctgggagaagatcatcgccttgcgtttgttttgtgtggtggcatccgcacgcgtgagcctgttcagccgctcatagaggtgcccggcatccttgacataccggcgtacggccgaatcggtccacggctcgtccacatagccgtggaagcgcaggtgcatattcaccagttccgagacgtcctcgaccagatggtggtcaaaacgcagcgccttcaaacgcttgcgggtcattttggcacccaccgcgtcatggtggtggaagctcaccttgccgcccgactcgaaccggcgggtcttcggcttgccgatatcgtgcatcacggcggccaagcgcagcgtcaggtcgggggcgggcaccgggccgtccgggccggtttccagggcgatagcacgttcgagcacaatcatcgtgtgctcgaagacgtccttgtggcggtggtgttcgtcgatctgcaattgcagggccggaatttccgggaagacgatgtccgcaagaccggattcgaccaacgcctcaaggccggcgcgcggacggtcggagagcagcagtttggtcagttcgtcgcgcacacgctcggcggatacgatgtcgatgcggtcgcgcatcgaggtaatcgcctcggccgcgtccggcgcgatacggaagcccagctgggccacgaatcgcacggcgcgcatcatacgcaacggatcgtcgtcaaaggactgtcgcggatccaccggcgtgcgcaacacgcccttggacagatcactggcaccaccgaacgggtccacgaattgcaggtcgggcacgcgcagagccatcgcgttgacggtgaagtcgcggcgggacaggtcgccctcaagcgtgtcgccataattgacctcgggcttacgcgagtccggatcgtacgtgtcagagcgataggtggtgacctccaccttgacctcggtgccgtccgggcggcggcgcatggcacccagcgtgccgaacttgcgccccatgtcccagaagccgtcatgcccccaccggcgcagtatcggctcgaactgctcaggccgtgcggatgagcagaagtccaaatcgtggctctttctatggagcagcaaatccctgaccgggccgccgaccaatgccagctcgtaaccctgttcggcgaacagtcgaccaagttcgatggcttcaggccatacttcgaaatccaatgggcaccttcccgcgtgcgacgtttttctgccctaccagcataccgttaccccacctgcacacggggttgagtaaggtggagaatatgattacgcccgccgaccttgcccgcatgctggggcaaacaccagattcggcggatagccatacccaagaccacctgctgtatacgtccgaaactccgcatcattccgccgattcgggcgattcttccgatgtcggcggcaccgcgagccactccaccaatcaggccgttcatcaagacgaagtagacgcagtaccgactgcgcaacattccggtgtgcctggcacacccgcaacgcccgccacacccgaaccatccgaatccgaaatatcggacgccgccagcgacatgcccgcaccgaagccgatgatgcccacaccggccaccgtcttcggcatgcatgccaccgtcaccatcgccactaccagcggcactatcgaggggcaggctgatggtatcgccggcgaggccggtgccgagacgattgccgaggtcgagccgattatcgccacggcacaaacgtccgtaaccatcgtcacgaacgatcccgcggcgaccgctcacgcggccgtagatgctgccgttgcggtcgccaaggccgccgccgcgcacaccacagcgataccgactccgcgcgacgtgctgatgccgcctgcggcacgtaccgcaccggccgcaacgccggtcaccatgccggtctcagcgccgtctgcagcaccagtgaggcccgcaacgtcagcgcatcccacgccggccacggtcttcggccggcacccgtccggagatgttgcctcgccggaaccggcagtgccggtagaaccggtgacgccatccggcccgactccggccatgatgccgcaacgccgtacgtcggacggtccgaccacattcgcttcactggatgcccaggaactgccggtcgtacgcgaatattcggcaggcggtctgattttcgatgaccagaaccgcgtggccattatcgcccgtcattcccgctccggccatctcgaatggtgcttgccgaaggggcatatcgaaaaaggcgagaccccgcagcagaccgctgtgcgcgaagtgcatgaagagaccggcatcctgggcgaggtgatcgattccatcgccaccatcgactactggttcaccggtaccacgcagcgcgtgcacaagctggtccatcacttcgcgctcaaacagaccggcggtgaactgacggtggaaggagacccggatcatgaggcggaagacgccatctgggtgcgttttgaagatttggatgacgtgttgagctatcccaacgaacgcaaaatcgcgtggctctacgccaggaagaagaacaggcaggcaaacgagtgaacctacccggagtcttacgacattgcacacgtctggcacacgcactggcggctggcgtcgccgttgtggcgatgctggccgctccattgaccgtctacgcgaacgatacgacggacacgactgattcatccgatacgacggacgcaacgggcaatcagaccgagaatcagcccaagcagagcattgccatcacgcaaagcacccccatcgtcacctccaaatcgggctatcgtgtcaccgcggtcatcagcaatacggacagcacggccacgtcaagcggcacactgcacctgaccaccaatgcgttgttcacctttgtctcgcgcaccgatattcagaattgggccgagaacaacgcccccatcccaacccccaacgagttgggttccgttgacgtgccatcgattcccgccggcggcactgccaccgtcaccatcgaggtgaacgccaatcagcagacccttgcctccatagggagttggggaccgaaaccgctgatgctgtcgtatatcgttggcaatcagatactcgccgatttgccgagttttctgacccgatcttcggatgggctcaacaccgcgacaacaccggccatgaacctgaccgtggccatgccctacaccgccagcggctggcaggtcgataataaggccatcagcaatcgcattgccgaaaccaccacttcctcgacatcaacatcgtccaagtccaacagcacggacaaggccgacaagtccgataacgccgacgccagcaacgcggccgaagccactgatacgcaagccatatccttatccgaacaggatgccgataccgcgcgatcccttgggcagacattcgccaagcaccgctcgctgcaagtgatcgcggatcctctgtattggcgtcagtccgcagtgcaaccgtccattgccggcatcatgcagcccgccgacttcgacatcaccgcctataccgcactggacgataccgcggcctacgaaaaggccggcatcaccactgagcagtggaacgccaagcaggcggccgcatggtatgccgacggaggcgactccgaaacaccctccgcgtacgcatggcagggcaacaactgttggacgttggatgcgctgaccgcagcacgcgagcagggctatgacacggtgattgccggtgcctctttcgatgccgaccagactgaagccgtacacacaggcacctacgtggtgcatacgcctgccggcgatgtcaccgtgctgaaggagcaatcgaccttgggcacgctgtccaagggccaagccaccagcacggacgcgcaggccgagtccagcgatgccggtcggttggcccgactggtcgctcagagcgcgttctaccagatggaacagccctatacatcccgatacctgcttatgacgttctcccgcaccacggaggccagctggatagatcaggtgatgagcgccttcgagcaggcgtcttggttgaatctgacggacctgaagaccatggccaaggccgatccgtacaatgtcagcgattcggtcaatcccgacaaggccgatgatgccaacaccgccaatacccggtcggcattgagacagttggccgacagccggcatgacatcatgcgcatggccacctccatattgaggaacgagattgattccgacgaggtctcgtcgttggacccgcaggccctggcccgacaggacgccaatgacaccgcctcgcatagcaacgatccgacgcaatggattggctctttactggtgctgcatgacgatatggcgctgcggtccatgtctggctccccccagccgacagccacgcgaaaagccatggtcaaagccgcgaaaacactggccagcgatcttctgaacggcgtacgcatcaacccatcggaatcggtatccgtgttcagcgaatccgcgaaaatgccaatcaccgtcagcaatgaccttccctacgccgtcagcgtgcaggtcaactcactgactgactccatgcagatcgtcacctcgcgaaccgctgacatcgatattcccgcgcatagcgacgctcaggtgaccttcaccatccgcgtttccacttccggctcatcgacggcccatgtgtcgttgaccgaccgggaaggcaacagcttcggcaacacgcaggacaccgcgatcaccagtgtgatgcgcatcagtgatgccagcggcttcattatcatcggcttcgccgtgctactgggcattatcggcctgtggcggcagttccatcggaagaaggaccccgacgaatgagttcaagcgtaggtcgtaattccctgatcatggccacgggaaccgctgcttcccgtgtgaccggtcagctccgcacgattcttctcgctgcggccatcggcaccaccggattggcggccaacgcctatcaggccggttccatgattccccaatccgtgttcacgctggtgtccggcggcatcttcaacgccgtgctggtgccccagatcgtgcgcacgttgaaagaaaaagacgcccaagaacgactgaatcgcctgattacgttggccatcggcatcctattggccatgaccgtggtgatggcggcggccagccctctgcttgcccgcctgtacgtgggtagcgacgatcaccagatgatagccctgaccacctcgttcaccctgtggtgcatgcctcaggtgttcttctacggcctgtatacggtattgggtcagatcctggccgccaaagaccatttcctcacgtatgcgtggagctcaaccggtgccaacattattagttgcgccggttttactggctttattctgctgttcagcaaggccaatgaacagcccctcgaattctggaccgccgacaaaatcgcgcttaccgcaggcacctggactttgggcgtggccttccaagcgctgatactgttcctgccgctggcccgtatcgggttcaagtacaaacccagcttcgggcttggcggctttggactcaggtctatgggtcccgtggcgttaggctctttgggcgtggtgatcaccagtgagatctgcggcattatccttacccgtatcgccacatccgcaccgcagcgcgcccacgaactgacgggtgccagcctgttcagcgtggcaggcaacgcgacctatcagaatgcgtacacactgttcatcctgccctattcgctcatcgccgtatcggtatccacggctatgttccccaaaatctcccgttccatcgcagctgcgaatctggatgaggcacggcacgacctggtcagcgcactgaataatgtgggcctgctcatcatgttcttcgccgccgccatggtcgtgttccccgaaccgatcatccgcgcattgcttccgtccgtctcgatggacgagactatgttgatctcctatgcgcttatcgccttgtctatgggcattccattggggtcggcgttcctgttaatccagcgcacgttctacgcctttgaggacggccttcaccccttcctgtccgcggtgatgcagtatggattcacctcaatattcatgatcatcggcatgatggtacttcctcctgagcattgggtactcggcatcgcctgctcggtgaccctcggtggattactggcgttgccgctgacgttgatgatgttgcgccgcaagttcgaaggcaatcttggcggtcgggagatcacgaggacatatgccaaggccattgtggcggcactggcttccggagttgtggtctggctgatcaaacgaccggtagtcgcactgttcggcgcggatattcgaccagtaggcgggcacatgagctggtggtctgcgctggccatctgcgtggtgctcaccattgtgctggccgtagtatatgtggctgtgttgtgggtggtacacaccccggaactcatcagcgcctatcactcgatactggcccgtctacacaagactccggccagtgaggacgttgctgtgacagcccagccggaaaaaagtcgacgctacgtaaatcaatcctgagacggagcccgtcaaggatagccccgcacgtagaatatctaagaccaatctcgaacaccaatcacacggagccgaacgcactatgaaaccgcaactcggagacacgattctcaaccgatacaccttggtatcatcgttgcgtgaggagcctggcattcaggcatggaaagccaacgaccgtgtgctggcaaaggattgccagctgttcatcattaccaatcgcagcgctttcgccgcaatcgatgagctcgctggtcgcatggccgccactcgccctgatcgtgtgattcccgtactgaaataccgtatggaatccgacgtacttctcattgtcatgccggtggatagcggccaatgcctgactgactacatggtggataccgccaagccgctcagctacagcgccatccggtcgattatcggagaatgcgccaacgtgctgcgcgaggtcattgcggatactcccagcggcatcgtcatcacaaccgacaccgttcgagtgactacctccggtgtgcaaattgccgatgcaccatgtgccacgatgctggccgatacgtccgctaccgatctgcgtacggacggtcctgaacggtatgcgattcgccagcttgcggcattactctataccctgctgacacgcacgccaagccaagcgacacccacattcaatctgcgtgccttgccgcaagacacccctggcgaattccgcgtgatttgcaagcgtggattggccttgagcgagcccgacgagcatacgttgccaatggcagcccttgtagaactcgacgccttgttgggtaattggaagccgctctctgaactgagcgatgctgatatcgctttgccgagcgtggaaagcgattgctcgattaccaaggcgatactgaagcctgccaacgagactgatatcgtgcctattcccagcacgttgattaacagcaacagtcttccggaattgtctattaccccttccctgccgattcagccggccgccgtccccgctccgcacgcgatgtcaccggttcctctgcctgatgggtccagtactgctgacggcaaccagtctcagtctgatgcccgccgtctgtttgacttcaacctttctgacgcctgggagcacgaaaatctttccggtgaaggcaccggtgactggtacagcgaaatgaatccggcccctatcggcggtccgggtgataatactcggttgacagtgcctattgttaccggcggtatttccgatgccaccgtgggagagacaaccagtcgtattcccgtgttcgacgccagcggccgtgctgtggctcccggtgaggaatcactgcgtgccttggaagaggagcaggcccgcattgccgaagtaagcgccattcctccgagcttcacaccgaaggatgtgccggatgacgaggttgacagcaagctgcccgatgaacatctgttcggcaaactgtcgaccaaggtcgttgccatcattgtggctctgatattggtagtggcagcggctgtttgggcagtgcatgcgttccgatcctccggagacaatcctgccgatgcttccagcaactccagtgaaggtgactggcccgatatcaatgctgacgctgtgccattcggtggcagcaagaacgcgacgaacggtggcgccactgacgattcctcaaagtcgagtgatgccactcagagcgaatccagggactcggcatcagacaagtccaagaagtccgagactgctgattcgtcgtccaagaagaccaaggccaagaagtccggcgataaggattccagcgctgctccgcaaccgcgccatgagaacaacacggcgtttacgatttccagcgccaacttcctgtcgaatcctggcggccaatccgggtacgcatactacatgcaccttgaccagccgcaggatgcgtaccgcatggttatcaccatccgcacatccggtggtaagggctatattcgcgcaaataccactggagaccccactcagggcgagcaggtggccgaattcacctttgctgaaggtggcactactgaggtgaagttcaccaaagccgtcaatacgcaggatctgctgctgtgggtgccatcgggtagcctgccgcagaaccagctgtacatcgagaaggtggaggtcttctaatcggcatctataccgataactgacccaagaagggcggtaccgttcgcatacattcgacggtgccgccctttcttcgcgtctggctgaatgacatggaatatcgtatgggggtgtgacaatgtttcacgtgaaacataacgtcatcattatcggttctggtcccgctggctacacggccgccatctatcttggccgtgcaggtcttaatcctgttatggtcactggtgcgttgtcgccaggtggacagttggtcaacaccactgaggtggagaacttccccggattcccggaaggtattcttggcccggatcttatggatcgcatgaaggaacaggccaagcgcttcggtacaacttatatcacagacgatgtctcttccattgaggcgtgtgagagtgattcggtcaagccgacctatcgtgtaacgctctccgatgactcccagttggaggcatcagcactcatcatcgccacagggtcgtcattccgtaagcttggggtgcccggcgaacaggagctgtccggacatggcgtctcgtactgcgccacctgcgatggcttcttcttcaggaacaagcctatcgtggtcgtaggcggtggcgattcggcttttgaagaggcattattcctgacccggttcggttcttcggtcaccttgattcaccgacgcgatagcttccgtgcctcgcagatcatggtggaccgagccaaagccaatccgaccatcactctactgaccaacacagtggtgacctccattaccggcacctcctcccccacacagaacaccggtgcacctattgccattcctggcttgacaatcaaacgaccggctgtggcaccggccagtgtcagcagcattgccgtacgtaacgtggtgaccggagaagaaagcacgctggacaccaacgccgtattcgtggctatcggccatacgccagccactgattttgcagctggtgttgtggaccgtgacaatgatgggtatgtcgtggtgcagggtgccagcacggtgaccagtgcgccaggcatctttgctgcaggcgattgcgtggatcgtacttatcgtcaggcaatcagcgcagcgggcatgggctgccgtgcagcgctggatgcgcaggcctatcttacggactgattgcggcgacctgatgatggcttgctgttctgactgctgcctgtgacataggagcagcgctaggtcagtgttacagcatgccgcctttggatagtacgcaccggtcaaaggcatagaaaggcccctcaggcgcggagaggttgtgcccgatgttttgcgcaaatgtggcctggtccgtcgtcgggggaatgacttcagtcggttgattgcatgatgccgtcgagccgggacatgtccaggtagcggcggctcgaccaatcgttggcggtgacgtagcggatcctggcgcagatgagcatgagcgcgctcctgccatccgggaagctgccgacgacgcgggtgcggcggcggatctcccggttcaatcgttcgatcatgttgttcgtgcggatccgccgccggtgctccgggggatactcgtcgagcagataggtcgtggtctcgccgataccttccctcaggcaggaggccgccgctttcagtctcctggactccatctcgcgggcgacctcctcggccttggcgagggcggacgcgcgtgattccatggcgaagatcgccttgagcgcggcggacgcccattcgcggtgggtgggcggcaccttggagagcacgttgcgcatgaagtggaccatgcaccgctggtatctggcctgcggcagcatctcgccgacggtggcgacgagcccggcgcacctgtcgccgaccacgagcctgacgcccttcaggccgcgctcgatcatggaccgtatgaactgctcccagctggccttgtcctccttcatgccctcggccacgccgatgacctcccggtggcccgtgtcgtccacgccgatggcgaccagcacgctcacgttctcgaccgacccgccccatgagcgcttgtgccacacaccgtccatgaacacgtacgggtactcgcccccaagcggccggttgcgccattcgtcgatctggtcgtacaccttcctgagcttgtcggagagcgtctgcgagggcatccgctcgccccacagcaggcggctgatgtcgtcgacctgacgcgtgctgacgccggccaggtacatgtcgatcagcgcctcctcgacgctctgctcgcgacgccggtagcgttcgatgaccgccgactcgaagaccgcgcccttcagcttgggcaccttgagtccgagcctgccggccttgacggtgaacctgcgcgcgtagtggccggcccggtacgccttgcgtccatcgcttctctcgtatctggcggcgttggcgattaggtcggcctcctcgtcgagcatcgcgttgacgatctgctcgaccttgtcgcgcaccatggcgtcgagcttggtctcgaacatggcctggtcgaactgtatgatttccttggacatggcccgtgcctctttccaatcgcggttttcctgtgttagcgactgaaaatcgtacccggtgcgggccatgctcatatccgggaagcccgaatcacaaagtgcgcaaaaactgggcgttatctctcgtcgcccgcgacagcttcaccccgcaagactgaaaacaaaaactcgagatacagcaaggaccggcatcctgttacgaagccggtcctgcaattacgtttcagcaatcgcgccttaacgaagaaggtgggcgtcgcaccagacgtgttcgacggcccagatggcggggttgatcagaagcacgtcggcagcgtagccgggggcaagcagaccgagcggctgcttggtgaccgggttcgcacgatcgaaaccgaatgctttggccggaatcaacgtggcggcttccaccgcgtcggtaggcgtgaatcctaattcgagtaccgcacgctgaacagccttttccaacgtcaacgtggaaccggctatcgcaccattcgatgcaagacgaacatgaccgtcaatcacattcacatccaacgcacccagcaaataatgaccatccgggcaatcggtggcagccatagcgtcggtcacaaacgcaatgcgatgcggagcgaagccgaatcccaaacgcaccatcggatcctgcacatgaaaaccatcattaatcaactcaacagtgacgcgcggatcctcaacagcagccggaatcggaccaggctcacgatgatgcaaaccattcatcgcattgaacatgtgcgtcataatgccagcacccgcatcaaaacctctgcaggcggttgcataatcggcatcgcaatgtcccaccgcaggaaccactccagccgcagcaaaacgacgaatcgcatcaatgccatgcggtagttcgggggcgatggtgatctgtcgcaaacagccgttcgcagcatgcaaaagccgatcaacatattcgggaaccggatctttcaagcattccggatcatgcgcacctttacgagacaacgcaaggaacggaccctccaaatgcgctccaagaatgtcagggcgagcacccatcatgccacgcacggtttgaagattggcgcacatcacgtcaagcgggttggtgatcaaactgagcacctgacgggtggtgccgtgcatcatatgacctgcgcgagccatgcgtatgccttgcacaccatcatcgaaggaactcccccacgaaccgtgcgcatgaatgtcgacgtaaccgggagtcatcatgcggcctgcagcgttggtcacgaaaccggccgaaccggtcatggaatcgccgaaaccaaccgaactgaccgaatcggaatcagcatcggcatccaaaccgacgcttgcgcatgccgcagcaaaatcatcgtcccgattcccagtcgcaataatcgcgctaccatcggaaaccagccattaagagacgccactctgggagatagacacgcccctgacattgacttcatgtccacactcaaccagggtaaggtcgagcgtgaacatgaagtcagcttgagtcgattagagctgaatcacgactccctcccaacgagcaagctcgccgcgagcgatcgacttcacgccatgtacggcatcataggtgctgagcagcacctgcgactcgctcacgccattcccgagcaatcgcgcgacctccgccggcacccgcgccgtcctaccggtgagattgaccatgacgagaatcgtatcgtcgccgccggtacgggtgaacgaatacacctgctcgctgtctgccgcgaccagattccactcgcccgtcgcgacggtcgcgttgccgtggcgcatggcgatgagcttcttgtagaagccgtacacggaatcaggatcgtcgaactcctcggccgcgttgatctccacatggttcggattcacgccgatccacggttccgtcgccgcgtcggccgcggtgaagccggcgtacctggaagcgtcccactgcatcggcgtgcgcgaattgtcccgtccgatgagcgcgagggccgccatcatcgattccggcgactggcacctggcctcctccacgcgctggcggtaggcgttgatggcctccagatcgcggtactggtcgagcttggtgaaatgggcgttggtcatgcccagctcctcgccctcataaatgtagggggtgccacggtgcatgtgcagcagcatgccgaacgccttggcgctcaactcgcgcgactcgcggtcagagtcgtcgccccaacgggacacgacacgcggctggtcgtggttgcagaagaacaggctggcccagccggcgttcctcacggcctcctgctggtcggcaagacgagcacgcagattcctgacttcgaacggcacggtgttccacttggaaccttcctggtcgacgcccacgtggtcgaacaggaacagcatgtcgagttccttgtgggccggatcggtaatgaactcgttgcgttccggagtgatgcccggcgcctcgccgacgttcatgtagccctcacggccctcgaacacctcacggcgcatttcggcgaggaattcgtcgagccgcggaccgtcggaacagaacgggcctgcgtccgtgtatccctcttcgcctatctccccctcggacaattccgagccgacctctccgggcagccgtccgtggccatcgagatgtttcgagatcaaggtgatcacgtccatgcggaagccgtcgatgccgcgatccatccaccagttcatcatcctgtacacggccttgcgcacctccggattctcccaattcaaatccggctgcttcctggagaactggtggaggtagtattcgccgcgcttcggatcgtactgccacgcggaaccgccgaaataggaaccccaccggttcggctcggcgcccggagtgcccggctcatgacccggcctggccggacgccaccaataccagtcggcatgcgggtcgtccttgtcgcgagaagcctggaaccaggcatgctcgtcggacgtgtggttgaccaccagatccatcacgatcttcaaaccgcgcctgtgcgcctcggcgagcagctcatccatgtcctccaacgtgccgaacagcgggtcgatgtcctggtagtcggagatgtcgtagccgttgtcgtcctgcggggacctgtagaccggggacagccacagcacgtccacgccaagatcagccaaataatcgagacggctggtgatgcccttcaggtcgccgatgccgtcgccgttcgtgtcctggaaggaacgcggatagatctggtagaccaccgcgttggcccaccatgggttcggggtcgcgccgttggaacgcacggcgacgggaaggacggaacgattgaaatcagtcatatcttgtttccttattaaatcaagttcttcatcaacgcgatgctatggatccacgttgcctatatacgggatgaatcaatgttgctttttcctttccctttagagttccatccatgagccgaacaagcatgctcatgcccagttgacacaactctgctggcattaagggaaattcatctatcctcagacgcttgcctatggaatctgtatatgttcccgctgaaatcagcgaaagatcttgaggaatcttcattccacgctgccgcgtcgcagcaacaagattattaaggaacaatgggccgccttgagtcacaattgctgtgttctcactcgagatgaacctctcaagtaggttttcggcagcatcgaaatcatcctcgtcggtaaactcttcatctatatgaatcttgtatcgcgcagcagcatcatgcattgatgtcctgagtcgaatgaggtaatttgcacctccatttcgttcgtaatcaatctccttcccccctgcaaacagaattctgctgtgcccattacgacaaagcgtttgcatgatcatttcacccatttcaataaaatcggtatcaatgcatggcacatttatttcattcataggatgtccaatagaaatgagcggaatacttgaaagctgagccaattcaatccggggatcattcatagtcacatccataagagcgacaccatccaccatcccagtatcgatgatagagcgaagctgctcatctcctgtttcctcagtcaacagcaacgtttcatagccaagtcgcctggccgctttgagaaaatttagaaaataagcacaatagttggtatagctggtggaatcatggacgggcgaactcagcgcgacgaaatgagtctcaccactcaacggagctggaccaccgtttttcgccaagtaaccaagttcccgcgcagcttgcaatactctccgacgggtatttgcccctatgggacgtttccctgtcatcacataggaaaccgtgcttatggaaactcctgcgagagccgccacgtccttgattccagccattgttatccttattcgttcacagtaaagccttggctctttccttgctcaacgagcttgtcctgccaagccttcacaccttccttcattgtggtctgtcccgtgtaagcagccccgacagtgtcggtgaaaacgcttcgcgcataaacgtcatagggcagaaattcgaacttagatgtgacacgcttcgcagcctcggcgaattcagcattgaacttctcaccgccaaaataatccaccgtgtctccatcggagttcaccatagtagtctggctaaggaatttatcgttagacatggtcttcaaatcagcaggaaaaccaccttggtccacacgggacatgatggcatcagaattagtgctggcaaattccataaacttgtacgcagcatccgcattcttggatgacgacatcagggcaagggaggagccgccgtactcagaacttaccttctcgccggcgttccacgttggcatttgagcaattcgccactttccagcaccctccgaagcattgtttaaaaacatgccgggagcccatgcagcagatatcacgctcgcaaattctccggaaccaactgaacgataccaatcatcagaactatcttttgtcttcgtttcgattagtccttcatcaatcatcttttgccagaagtcacagaatttctgcactcctttatcagtagtgagtttgacggtaaccttggtgccgtctttagatgtggaatatgggtgtccacctgcttgccagaccattgcattgaagaatccggcgttccctggatcattagtaatatatgaaccaatctgcttaatcttctttgcatcttgatagaactcatcccaagtacttggcggctcagaaatgccagctttgtcaaatacctctttgtcatagtaaaaagccattggtccagagtcgactggcataccatacataccgccattgaaattcactgcattccaagtacctggggtgtagaaatccttatatttggcagtcccatagtcattcagatttttaagagagcccttaattacatactcaggaatcgcataatattcaatcatggctatatccggaattccactgccagcttccaaagcattattcagagctttgtattcatttttaccactaccggcattggtaaatttgatgacaatgttagggtttttcttcatgaaaaccttagcattagctttaagattgttatcccaagcccaaacattaacaaccgtcttaccgctcccatcgggagtttccgactgagttgttccacacgctgccaatggaacaaccatcgccgcagcaccgcagagagcaattatttttcctaacgagaacctcattgtttccctttctttctattgagcagcagtggcatgaccttgcttttggcgcccttgcttgtagtctgcatcttaaaaccgaaggattatgactgacaaataatttcgatgatttcgacgatttcaataatcaaggcactcaccataacagacatgcgcggctgcatcacgcaacggccaacacaattgatgatccattgtctaaagaacgagaaagtcacattagcgaatactccactgagaccaacggtagcagccgcaccgccaccgacaatggcccctcaagcggcgcatacaaaacccatggaggggcacaggttacggagatatgcaatgactcccggcccattaaacctataacgtaaatcaacagcgatgtcgccaataacagctctgctatatatttccatcaacaaattgcctggaatatgtgccaaattgcaaccccggcggttcagctatcatgcgctgaaccatcaacttcgtaggccctcacacgatacagtcgcgcgcgcctgttctggtgagtgccttgattattgaaatcgtcgaaatcatcgaaattatttgtcagtcataatccttcggttttaagatgcagactacaggcaagggcgccaaaagcaaggatcatgccactgccgttcaatagaaagaaaggaaaaagaataccatcaggtgtcctcgaaggcatgaaccgtaccgcccgatcatcgaaatctgaatttcttcagtccaacgatcagggtgcgattcatcaaggctccaccgtggagtgaaagtacaggcgcgaaagggatgctttcccatccacacctgtttcacactcggaaatctttgcgcggcaatcaaaaacaatcaaaaaatgtctcgaaggagagaatgatgtcagcgacggaagttgttgccaatatgccactgcattcggcaaccgtgcgtgtcaataaacacaaggccgattggcgtggttggaagtttatgtggccttttgcggtggtgttcgtgttcgtgttcatcgtgccgatcgtgtacgtcacgatcgtggcgacgtggaacaactacttcctgccgttgatcatgctcaaggattcgaactggtatccgctcacgatcggtttgaaccagtggaaggaccaggcgagcaccgctggcggccaggcgatccagaacctggtgatcacgggctcgttgatcacgatcatcccgctggtcatcgcgttcctatgcctgcagaagtactggcagtccggcctctccgcgggcgcggtcaaggaataatcaatttctacaccacagccatggaacgaaaagtatggcccgtgctacaagtacgggccatacgcatatacatgatctggcggaccttcctcacaaatcacgatagttgttccccattgtgagacgcacttcggctgcaaagctgaagtaattcagatccatatggccgaaggtacggtctggttgtgcccgaagtcttgcgcaaaagcggtctggcccgttgccgggtcggtttcagtcggttgtctgcatggtgtcaccgagtcgggacatgttcaggtagcggcggctcgaccaatcgttggcggtgacgtagcggatcctggcgcagacgagcatgagcgcgctcctgccgtcggggaagctgccgacgaccctggtgcgccggcggatctccctgttgaggcgttcgatcatgttgttcgtgcggatccgccgacggtgctcgacggggtagtcgtcgagcaggtaggtggtcgactcgcctatgccctccctgaggcaggatgcggcggccttcaatccgcgggattccatctgcgcggccacatcctccgccttcctcaacgcggcgtcgcgggattccatggcgaacacggccttgagcgcgccggccgcccatgccgcgtgtttgcggctgaccctggagagcacgttgcgcatgaagtggaccgtgcaccgctggtatctcgcgtccggcagcatcgagttcaccgtggccaccagcccggcgcaccggtcgcccaccacgagccgcacgcccctgagaccgcgttcgatcaggctcctgacgaactgctcccagctggccctgtcctccttcatgccctccgcgaccccgacgacctcccgatggcccgtgtcgtccacgccgatcgcgaccagcacgctcacgttctcgaccgacccgccccacgtgcgcttgtgccgcacgccgtccacgaacaggtacgggtacgaacgctccaacggcctgttgcgccattcgtcgatctgcgcgtacacccccttgagcttgtccgagagcgtctgcgagggcatccgctcgtcccacagcaggcggctgatgtcgtcgacctgacgggtcgaaacgccggccaggtacatgtcgatcagcgcctcctcgacgctctgctcacgacgcctgtatcgttcgatcaccgccgactcgaacagcgcgcccttgagcttcgggaccttgagggtcacggtcccggccttcacggtcaggtcacgctcgtaatgacccactctgtaggccttcctgtccccggtgcgctcgtagcgggcggcgcccgtgatctcgtccgcctccgcgttcagcaattgctcgaccttctccgacaccaaccggtcgagtctcgtctcgagcatgttctcatcgacctgtagaatctgatcctgcatggttccgtcgcctctttccatagcggttttgtttggcgactgaaatcgtacccagacgacgggccatgcctcttcattcaggcttcaaccaaagtgcgcaacaaaccgggcgttatcgacggagaatcacgatgtgtgatttgtcatcctccagcctgaggggttttctattgcgacaggggctacaacgcaggctacgcccctgccaggaatcacgcagaggctataacgtcttgcgcgtacaacgcactgcacagcaataatgccggcgacagtgacaagccgatacaatgccaagtgacaacgctaagcatcggtgttgtcactgacgatgccggcgacaacacgaatgttcttatcgtgttacacccatttggaatcggcatcgccttggctcggcaccagcagctgcaggatgcgatccatatcctctggtgacgaaaagacgatttcgatgcgaccatgcttggtgctgcccttaatcgacaccttggtatcgaaatgattttccaaactctgctggatggcggaaccaacccaaggattggtcttagacgtcttgggcttcttcggctgctcccccgacgcaatcttcatggcgacgatttcttcggtgctgcgtacagaaagaccttccgcaataatacgagaagccagcttgtccatttcctccggatcgctcaggcccaatagcgcacgcgcatgaccggacgatagcacaccggcagccactctcttttgcacagaagccggcaggttcagcagtcgcaaggtattggcgatttgcgggcgagacttggacaccgacttggacagctgtacttgtgtcaacccgaactcttcaatcatctgctggtaggcagccgcctcttccagcggattcaaggccacacggtgcaagttttccagcaatgcatcgcggagcatatcatcatccgcagtggttttgacgatggcgggaatcgtctccaacccagccaactgagaagcacgccaacggcgttcacccataatgagctcatacgggctgtccaaatgaccggcaaacggattcgtgctggattccgtctcgtcgtgcttggcggctttggccgcagcaatctggcttgccggacgcttgcgcacgactatcggttgcagcacaccaacttccttaatggaagcagacagctcattcaactcatcctcgtcgaagatggtacgaggctgatgtgcattgggcccgatatcagacagtttgagttcagccagataaccaccggctaccggcttgagctcgtccttcttatctgtgtcagcggtctttgccgccgatgcagtcaaagatgtttcacgtgaaacatctttgacagtgacggatgtacgatgtgccgtctgagacgcagacgacttgccgccctgctgaggtgcggcgaccttaccggtttgaggtttctccgtaccgaaaaacaggtcgctaggatgagtaatggtgtccaatgcgggcatggatgcgcgtttaccggcggctttcttggctgccttgctggacgatatcgtctgaggcacggcaggttttgattcctgctgggcagtagccttcttggcgggggttatgtcagcagtggccgccggagtagacgaatcctcctcaatcattgcgggctgctccgccactggctcctcccctggcaatgtggggaacaaagcgccaaggcccttaccgagtcgtgattttgatgccattacttgttcctcctcgcatcaatggtgtcaaggacttgttgcgaacgctgtgcgatttccaaagctgcttcaccatacgatatggcacctatgccacgaggatcataggcaatcaccgattgggagaaactcggcgcttcggagatcttgactgaacgcgggatggtggtattcagcacaatgctgggatagtgtcccttgacctcgttatatacttcacggctcaatagcgttcggcgatcgaacattgtgacgagcatggtggacaccagcagtactggattgaaatgctcctgcaccaaaccaatcgtgttgatcagctggccaagaccctccaatgcgtaatactcagcctggataggaatcagcatctcggtcactgcacacatggcgttgatgaccaagaggcccaagctgggcgggcaatcaatgaacacgtaatcatagtgtttatctgattgacgcaggtagaggtccaaggcctccttcaacaatgtgtttcggttgggcagatcagccacttccaactcggcaccgctgagatcgattgatgcaggcacaacatcaagtgtgggaaaatcaggacagaccgtgataacatcacccagatcggaacgcccctcgataacgtcatagaccgagggctctcccgatgcatgagatacacccaacgccgtagaggcattgccctgcgggtccatatcgatgaccaacacctgcgcgcccttgttcgccagcgccgcagcggtgtttaccgtggatgtggttttacccactccccccttctggttggccacggcgatacgacgagtccgttgaggctttgggaaatcggttttcttgagtacatcgtagcgtgagctttcatcagccatttggctgccaagcactgaaccgtgaccatcgaatattcgctgaagcgtttcggaagccgattctataggttccgactgatgatccttggtggccatcgctcctccttgcacagacgtaagttccagtgttctcattcgtatggacatgatgctcgttatccacaattgcgatatgcaatgtggataagtgtggataagtgtgaatgacgttgagtgtaagattgtgtattcacagacgaaaacattgaaaaatcaatgttttcatcattatgcacatcgtcccgtaaaaatgtggataacttttacgcatatatggaaatgtggataactcaatcagtactccactcatcgcttatccacaatcaccacgtgggtaggctcaagatccggcccgacagccgcctcaacgacacgtggacgacgaccaccgaattttgcaatctccttgccagccttgtcgatttcagcctgagcagaccgtcccttcagtgcgatcaactgtcctgacggtttcagcaacggcaacgtccagccagagagtttggtcataggagcaaccgcacgacacgtgacaacagcgaacggatgaatttcccgcttccgtacctgctggatgacggcatcggagcgtccacgaataatctcaacgttctgcagttgcatcaggtcaacacattcatgcaaccattcgattcgccgctccatcggctcaatcagcgtgaagtcatgatccggcaaacacgcggcagccaccaatccaggaaaaccaccaccactgccgacgtcggcaactgttttgaagcgaataccattcgtcgcattccgaacgtacggcacaatcgcagcggaattcagaatatgccgttcccaaatgatatcgacgtcacgggggccgatcaatccacgaggttcaccctcttcggcaatcttggcatggaaacgctccaacttcggcaacgcatcacccaagacctcagcaagtacaggtgacccctgcagctgatccgtcatagccatctccctcaccatgtttcacgtgaaacaatcaacatggagaatggcgccgctcattacgacgccattctccatgcggtcactttagtttgttcaaagacgacatccgtcgaacgtccctgtcatctcaaaaaaactcgccgagcaattactcctgatcaagctcgtcgtcttcggcggtatcctcgactctattcttgagatacaccgtcacgtaacgatgaggctcctcaccgtgcgagcgagacttcagcccctcttcccgaaccacatcgtgaacgactttacgttcgaaggaattcatcggcttcaagtcatacggctcgccggaatccttcactgcgtcaatggcatccaaggcgatatcacggaggtgctgacgcttgcgcttcaggaaaccgtcgacatccacaatcagatgagaacgctcgccggtcttctgctgtacagccagacgagtcaattgctgcagagcatcaacgacttcaccattacggccaataagatgtttgatgtcagtatcgtcatcagcaacgatttgcacggtggggcggtcattacgcacgcccatctcaatgtcgccctcatagtcggcgatatccagtaggccttcaaggtaatccgcggcgatgtcagcctcttcgttgagctggtcgatcgacttcacgtcatcctgtgccatacgctactccttcatgtcgtgtttgaattccaagtctaagccctgctcccccgaacagagaaagtaatgtcggtgcgtgttgaatgtttcacgtgaaacatcgaactcgcaccgacatagtcgtcacttctttttgcgcttacgcacgggctgttgacgctgatagccctgagtggccttacgctcggcctcttccttggccttggccaatgcttcttcttccagagagggcaggccggcctttgcgcggcgagcattctcattacgatgatcgcgcttctccttgtccgccgcagccggagagccaggggtcgggaatgcgtacacctgccacaatgtgcggcagaggttgcacacgttgttggtcagccagtagaccagcacggcgaacggcatggcgacaccggagaagatgtacatcaccgggaagagccacagcatagccttctgcatggtctcggtctgcttgttcatcgaagcagctgccatgttgcgcttcatgctgaagtactgcataaaccacaggcagaaacacatcaggaacacgaagataccgatgaccgccttgccactagcggcagcactggtgaagttatcggtcacgctgacaatgccgaacacatcggtttgggtgaattgcttggcggttgctacgtcgaacgcgcccaacgcatcgcgtttaccgttggcaatgtatggaatggccgacagcgtatagaacatggacatgaacaccgggccctgaatgagcataggcaagcaggagccagccggattgacgtcattgtcttgatacagtttcatggtttcacggctcatggcctccctggaagcctgatccgtcttgcctttgtacttgttctgaatacgctgcatcttcggcgccaatgcctgcatcttgcgcatcgacttcatctgcttgtagaacagcgggaagatacaagcctgcaccaccagcaccaggatgataatggcaagcacccatgagacaccaatcgggctcacgcccagcatcacgaagaagtcatgcacgatcttcatgatccaggtctgcaaccactcaacgggagtcaggattttatatagaaatccccaaaacccgctatcaagcagaaattcatttgagttcatcgttgggcctctctttgggttgtggccaatggtgtcagtcgaggctcttcatgagccttcgaccacgaaaacctgtaaaaaacggaataccgttgtggaacatcgtcgattcccccacgactccacggccggcaacgcagtaatctcagcacggcgagcactccccctttgaacgcgccataccgttccaatgcctcaatggcataattcgagcacgttggataatacttgcaacaaggcggtgtgtttgccgagatgtgctgttgataccagcgcaccccaccaatcatcaccgccttgaaagaagctgtcatgcctcagccaccttatgcgccaccgtggcaaaagccttcgcgatctgctgatctagcgaagcgaacgatgcggtcgctgcactgggcttggcgcgcaaaacgatatcgcaatgcgcgggcagcagatcctcatgggctctggccaatacacgaaacctacgcttcaccgtattacgggtgaccgcatgtcctaccgatttggagacagctaatcccaaacggcgatgcaccgtccggtcgtcatcatcatgatggtcgtcgggcaccaaatagtgcacgacgatatccttgccacctgctttgcgccggcgtttcagcacggtgacgaaatcacgatggctttgaagcctctccacctcgactatgcctgtggcactgatcggaatgatcaggcggagagggtcttgcggcccttggcacggcgacggttgatcaccgcacggccagaacgggtgcgcatgcgcaggcggaagccgtgcttcatgtggcgacgacggttgttcggctggaacgtcctcttcataatccattgctcctaggtctattcggcaacgcttcgcgctgccctcacgtgagtcaagctataccaaagtactctcacccctaccctcaagtcaaaacggacggagtattttcacatttcgacacgttgcgagacacgccccaaatctcttataatcggcggaataccaaccattcacggccaaaagttatccacaaattacatgtttgttattcacaatccagttatttcaacacgcgacacggtggataacttgtctaaaccagagtaaatattatctgttgtacgtatttcgccacagcgacagaaggggccaccatggttaacgcttccggcgaccccgtaatcgaggccgcccacatctggtcagacacgctgacggtgctcaaacacagcgcttcgctcagcccacgagaaaaaggctggttggaaggcgttgttcctgaaggcgtcttcggttcgaccatcgtgctgtgtgtggacaacaacgacacgcttcaagccattcagggtgatttgaacgattccctgcttcaggcattgcgtacggtaaccggcgaaaatatgtttcccgcgttcaaggtcgtgccgaaaaccgagcccgaaccgctttcggaggcaaagccggcgcagccatatccttcggaaatttctccgactgtcgccgaattcggtaaagaatcctatggtgcaaagccggcagccgcaccgcgggaaccgatgcccgccaccgagccgcagttcccggtcggtcagcagaagatgaatcgcgatcccgagactcatctcaataagaacttcacgtttgattccttcgtgcccggcgattccaaccgttttgcccgtacggtcgcactggccgtggccgaaggttccgggcaggatttcaacccgttgtgtatctatggcggatcgggcctgggcaaaacccacttgctgaacgccatcggcaactatgcactggtcaaggatcccgggctgaaggttcgatacgtcacgtctgaggaattcacgaacgaattcattgacgcgctgcaaaacccgaaccaaagccaggggcagattgctgaattcaaccgtcgataccgacaggttgatgtgttgcttattgacgatatccagttcctcggcggcaaggaagccaccttggatcagttcttccatacgttcaatgcactgcatcaggcaaataagcgtattgtcattgcttccgatgtagcgcccaagaatttgaagggtttcgaggctcgactcatctcgcgcttcgaatccggcctgaccgtagacgtcaagccgccggatctggagacccgaatcgccattcttcgcatgatcgcctcgatgaacggctcgaaaatccccagcgatgtgttggacctcatcgccgaacgcttcaccgagaacattcgtgaactcgaaggcgcgctaacccgtgttacggccgtggcctcgctgagtaatcagccggtgacccgcgccttggccgagcagacgttgcaggacttcttcaccaccgatgtggaaatcaagcccacggacatcatcagtcaggtggcgaagtacttccacctgacgtttgaggatcttgtcggtaaatcacgaaccaaaaacgtggctgttcctcgtcagatcgccatgtatctggctcgcgaaatgaccagtatgagcctgatggatattggccaggtctttggcggacgcgatcacaccacagtaatgcatgcctgcactcgaatcagtgaccgaatgcagcaaaaacaggagatctataactacgttatggagctcacggttcgcctcaagcaaagcaacaccaactgacacaacgcttctgagagacgaaaaacggcactttttggactgactttccgaaaagtgccgtttttggttgctcaggcggattctggtggatacgtcgaggcaacggattcgagacattagattcctcatggctcccctttgtgaggggatctgtcggcgcagacgactgaggggagtttcgaaggggaacacgcaaaaaaaccatgaaacgagagaatcgattctgaggaccgattttgcgggtttgggcgagcgagacggaaaaagtgccgaaaacggtctccagaatcgattctcctcgacgaaaaacagtcttcaacacgccgtgcgaaagtgcgaaaaccaaaaaagttatccacatagttgtgcacagatgtgggtaaactcggcggataactcgtggattacccactgttttgttgtggaaaactcgtgcataaccgcgacctcgatgtggaaaactcaaattcgacgaactggctgtggaaaactcgcccacttatccacaagccatgcagaatttgtccacaattttcagggacttatgaaccgttgcagttgtagggctcagccctacttatccacactatccaccggccttattatggcgattacttactcagttacgtgaaaagcatcatcgccatagtaacagccggtcatctagcgtacgtaagttcgccacctaacggctagaatatttctcagccaatccgacgaagggaacaatcacacatgaaagtcgaaatcgatactgcagccctggccgacgccgtagcctggacctcccgagtcatcgacgcacgtccctccaacccgattctcgctggtgtcaagctggaagccattgacggaacgctgcaattctccgccttcaactacgagatttccgctcgccaccacatcgaagccggcgttgacgaagccggttccgtactggttcagggcaagctgctggccgatatcaccaaatcgctgcgttcggagaaaacgtacctggtcaccgacggctccacgctgaccatcacgtccggcaagtcgaagttcaccttgcagctcatgcccgacaccgagtacccggatctgcccgtggtaccggccatgctcggccaagtcgatgccccgactttcgttcaggccgtgaaccaggcgtgcgttgccgtctcccgcgaagaaaaccgcccggtactgaccggcgttcgcatgcaattccaaggcgacaaggtcgtcatgacctccaccgatcgcttccgtttggcccgcgccaccttcacttggactccgcagaacccggacgtcgacaccaccacgctggttcgcggctccctgctcaaggatgtggcccgtgctcttgacgagcaccagaacatccgccttgatttcgatgccgatagcccgacgctgctcggcttcgaaaacgccggccgcgtctccacctcccagctcatcgacggtgaattcccggcggtcgaccgcctgttcgccgacgaatatccgattcaggccgtagtcaacaagcaggatttgctcgacgccatcagccgtgtggctttggtcgccgaacgcaatgctccgattcgcatgaccttcaccggtcaggaagtggcgctgtccgccggatcggtcgacgaggctcaggccaacgaaacactggacatcgacatggatggcgacgacatcaccgtggcattcaacccgtcctacctgaaggagggtctgtccgccgtaaccgaaccattcgtgcgcatcaaaatgacgaccccggtcaagccggtcgagttcaatggccagcaggaagctgattccgacgagtccatggactaccgatacctgctcgtgccgatgcgctttaacaactgaaatccctgaatttccaacgattcgctaatgcacatctcccgtctcgcactcgaccactaccgctcatggagtcaggtagtggtcgatttcgtaccaggcgtgaatatcctgttcggcaagaacggtctgggcaaaaccaatctggtggaagccgtcgaagtgctgtccaccggatcgagtcatcgcacgtccagcacgttgccgctgatcgaacgcgggcagaccacggccaccatccgcgcgaacgtcgctgatgatgccggtcaaaccactacgtatgaagcgtcgattcatgcgcgtggtgccaaccgagcccgcatcaactcggggtcgtcgctgtatctgcgcgatatcatcggcaagattcccagcgtttccttcactcccgaagatcagcgattggtgtccggcgatccgggagcacgccgcgtcatgatgaatcaggctgcggctctgctcgagcccggatacatgcagacgttgcaacagttcacgcgcatcgccaaacagcgtgccacattgttgaagcaattgaatgccaataccaacaatggacagccgatggatgcggttctgagcggtttggaaatctggaccggccagttcatcgaagccggtgtggcgttgacccgtatgcgcgctcatgtgatcggtctgcttgccgagccatttgccgcgatttacgccgacttggccggtgccggcgagcaggtgacgctcacttatgcgccttcattcgacgaagtgctgatgttcgacgatccgcatccgcagattagcgagcatttccaacgcatctaccccggtgaagtggctcgcggcgtgaaccttatcggtccgcagcgcgatgacatgaaccttgagttgggcggtattcccgcccgcgagttcgcttcgaacggcgagatgtggacgatggcgttggccttgaaaatggcattgttcgaaatagtgcgtgaccggttgggattgcagccgattgtgattctcgatgatgtgttcgcccagcttgacgacagccggcgcacgcagattcttgatttcgccagaaaacaggatcaggtgctgattaccgtggccgctgaaggcgatgtgcccgactatgaatcggcccatcgcatcgacgtggccgcactggacgaaccagcttccgtgatattgccaactctgggcaatttgtccaattcgcgggaaaatgagagtttgggtgggtatgacgaaaaaaccgcggtggacagcgcgtccgtagaacggaaagtgtcatgaacccgccgatcgcccgccaactcaacctggacgagaccaaactgccggccgaaatattcgagcggctctcccgtcgcggggcgaccttgaaggactacagacgccgccgtgaagaggccatcgaaaacttcggcaaaccggggcgcgatccggctgaactgggcagcgtgatgaccaccatcgccggcaacggcgtctggacggcgaatatgaagcttgcgcaattgcgcaaccattgggaccaagtggtgggtcaggccatcgccagccattcggcagtcgccgatttcactgacggcgtactgaccatccgcgccgaatccacggtctgggccacgcagctgacctaccttatcccccaactcaccgataccatccgtcgcaatctcaaaggattgaccatcaccgagattcgcgtgaccggcccggccgccggatacacacgcaaatgggctcggcggcggtagccaagataccaaacaaattcgcagaagcctcgctatggcgctcgtcgggttagacgagtaaaatcacatgcagtatggtcaaatggccagaagagccctttacgggcctcgtaagccatatcgcctccgtgaatgaccttcatgacggaggttgaccctgtagtcacggaaggaagcctgttggcagacgaaaccagcaaagaggagcagctgaaggcggctgcggaacgcatcaacaatgcggaattgaccgaaggcgaacttgacgaatccatggcccccgagcattatgaggcctccgatctgagggtgctcgaaggactcgaggccgtgcgtatccgccccggtatgtacatcggttccaccggcccgcgcggtttgcaccacctggtctatgagatcgtcgataactcggtcgacgaggcgctggccggatacgccagccatatcgaggtcaccattctgccggacaacggcatccgcgtggtggacgatggtcgaggtatcccggtcgatgaggtgcccggcgagggcgtctccggtgtggagaccgtgatgaccaagctgcacgccggcggcaagttcggcggcggcggttatgcagtgtccggcggtctgcacggcgtgggtatctccgtggtcaacgcactctccacccgcgtggacatcgaagtgcgccgtcagggcttccactggacccagatgtacatcgaccagcaccccaccgcgcccttgaagcagggcgagccgatgaccgaaggcgagtccaccggtacgtctgtgactttctgggccgacccgaagatcttcgagaccaccatctacgacttcgagacgctgcgttcccgtttccagcagatggccttcctgaacaagggcctcaagatcagcctgaccgacgagcgtgagaacgaccaggccggcgacgaggtggccggcgacgccgcggacgagcccggcgcaaagcaccagaccgtcacctaccagtacctcaacggcatcaaggactatgtcgactacctggtcaaggtgcgcaaggccacgccggtggaagaggacgtcatcagcttcgaggccgaagacctgaagctcggcatctccgccgaactcgccatgcagtggaccactgcctactctgaggccgtgcacaccttcgcgaacacgatttccaccaccgagggcggcactcacgaggagggcttccgcgccgcgctgacctcgctggtcaaccgttacgcgcgtgacaagggcatcctcaaggacaaggacgagaacctctccggcgacgacgtgcgtgaaggcctgaccgccgtgatctccgtcaagctcaccaacccgcagttcgaaggccagaccaagaccaagctcggcaactccgaggccaagaccttcgtgcagcgcgtgatgaccgacaagctcggcgactggttcgatgcccacccggccgaggccaagaacatcatccagaaggccatcgaggcatcccgcgcccgtctggccgccaagaaggcccgcgagaacacccgccgcaagtccatcttcgagtccgccggcatgcccgacaagctcaaggactgccagtcctccaacccggaagagtgcgagctgttcatcgtggagggcgattccgcaggcggctccgccatccagggccgcaacccgatcacgcaggccatcctgccgctgcgaggcaagatcctcaacaccgagcgcgccagcctggaccgcatgatgaagtccgacaccatcgaatcgctgatcaccgcggtcggcggcggctacggcgaggacttcgacatctccaaggtccgctaccacaaggtcatcatcatggccgatgccgatgtggatggtgcgcatatcgccaccctgaacctgacgctgttcttccgctacatgcgcccgatgatcaccgccggctacgtgtacgtggccatgccgccgctgtaccgcctgaagtggaccaagggcccgcacgacttcgtgtacaccgacgccgagcgcgaccgcgtgctcgccgaaggcaaggccaacggacgccagctgcccaagggcgaaggcatccagcgctacaagggtctgggcgagatgagctaccaggagctatgggagaccaccatggaccccgagcaccgcattctgaagcaggtgcacatcgaggacgccgccgcggccgacgagaccttctcgatgctgatgggcgatgaggtcgaaccccgccgcctcttcatccagcgcaacgccaagaacgtgcgttggatcgatgcgtaacggaatcctccaacctccctcgtcagagggaggtacacaacggacttagacaactaaaggaacaacagtggcagatgaaaacaacaccggcgacgagcagttcacgccggacggctcgatggagccgttgagcccgcaggaggcggacactaccgactacggcctgatggacaccggcgaacgcatccagcgcaaggacctgcagcaggagatgcgcgagtcctatctggcgtatgccctctccgtgatcgtcgagcgcgccctgccggacgtgcgcgacggtatgaagcccgtgcatcgccgcgtgatctacgcgatgtacgacggcggctaccgccccgatcgcggctacaacaagtgctcccgcgtggtcggcgacgtgatgggtaagtaccacccgcacggcgactccgccatctacgacactttggtgcgtatggcccagtcctggtcgatgcgcaacatgctcgtcgacggccagggcaacttcggctcccccggcgacgacccggccgccgccatgcgttacaccgaatgccgtatggccccgctggccatggaaatggtgcgcgacatcgacaaggacaccgtcgacttcgtgcccaactacgacggcaagacccaggagccgaccgtgctgccggcccgcttcccgaacctgctcgtcaacggctccgccggcatcgccgtcggcatggccaccaacatcccgccgcacaacatgcgcgaggtggcggacggcgtccactgggcgctcgaccacccggacgccagccgcgaggaactgctggaaaacctgatccgcatcatcaagggaccggacttccccaccggcgccaccatcctcggccacaagggcatcgaacaggcctaccgcaccggccgtggcctgatcaccatgcgtgccgtggtcaacactgaggagatcaacggccgtatgtgcctggtggtcaccgaactgccctaccaggtcaacccggaccgcctcgtcgtctccattcgtgaggccgtgcgcgacggcaagatccagggcatcgccgacatgcgcgacgagacctccggccgtaccggccagcgcctcgtgctcgtgctcaagcgcgacgccgtgccgaaggtggtcctgaacaacctgtacaagcactcccagctgcagcagaccttcggcgccaacatgctggcgctggtcgacggcgtgccgcgcacgctgagcctggacgccttcatccgccattgggtgaaccaccagctcgacgtgatcgcccgccgcaccgcgtacctgaagcgcgaggccgaagagcgcgaccacatcctgcagggctatctgaaggccctcgacatgctggacgaggtcatcgccctcatccgtgcctccgaagacaccgataccgcacgtacgggccttatggggctgctggacatcgaccaggtgcaggcggacgccatcctggccatgcagctgcgcacgctgacccgcatgaaccgcgacaagatcgtggccgagcatgaggaattgcagcgcaagatcgccgactacatcgacatcctcgccaagccggaacgccagcgcaagatcatcggcgacgagctcgacgagatcgtcgccaagtacggcgacgaccgccgcaccaagatcctgccgttctccggcgagatgaacgtcgaagacctgatcgccgaagagaacgtggtggtcaccgtgacccactccggcttcattaagcgcaccaaggccgacgaataccgctcccagcaccgcggcggcaagggcatcaagggcaccaagctgcgcgaggacgacgtggtggatcacttcttcctgacctccacgcacaactggctgctgttcttcacgaacaagggccgcgtgtaccgcatcaaggcctacgagctgcccgagggctcgcgcgactccaagggccagcacgtggccaacctgctgcagttcgcgcctgatgagtccatccagaccgtgctgtccatcccgaactacgaggtggccaagtatctggtgctcgccacccgttccggcaaggtcaagaagaccccgctggccgagtacgattccccgcgccagggcggcctgatcgccgtgcgcctcatggccgacgagaacggcgagaacgccgacgagctcatcggcgccgcgctgtgcaacgccgaggacgacatcatcctggtctccaaactcggcatgagcctcaagttccaggccgacgacgagcagctgcgcccgatgggccgccagaccgccggcgtgcagggcatgaagttccgtaacgacgacagcctgctggccatggatgtggtccctggcgactccgacaaggacctgttcgtggtcaccaacgagggcttcgccaagcgcaccgccatcagcgaataccgtctgcagggccgcaatggcctgggtatcaaggccgtgcaactggtcgagggccgtggtgctctggtcggcgcgctcgtggtgtccgaagacgatcaggttatggccatcatgaagtccggcaaggtgattcgctccaacgtggacgaagtcaagcgcaccgggcgcaacacccagggcgtgacctttgccaagcccgacaagggcgacacgattctctccatcgcccgtaacgaggagaaggacgagcccgaggatggcggcgatgccgcggcgaacggcactgccgagaccgcacaatccggcgagaatgtgaacaacgcggacgaggcgtgagcagcgtcctgaaaagctggtagcctcgcatacagcagaggctaccgccaagcctgttaaggagaaacgatgagcgagaatctcgaagacaacgagccccggatcataccgccggcagtcggcaatacgcagaacgagcatgtcgagccgctgatcggtactgagcacgctccccgcgtggcacgctccgtgtccagcgatccggaagaatccgcgttgccttcttcaggtgccgccactcccgtgcgtccggcacctcgccgtagcgcccccagggctcgccgcatgagcttgtcgctgacccgcgtggatgcttggtccgtggccaaggtgacgttcatgctgtccatcgccgtggcgattattcaggtcgttgcctccgcgatcgtatgggtgctgcttgatgtggtcggtgtattcagccagattacgcagattgtgtcttccaccggtcttgatgcaggcggtttcgatctcaagaacgtgttgtcccttaccaccgtggtctccggcgtcaccatcttctcgattgtcgaagtggtgatcttcactctgctggccaccattgcggcactgatctacaacgtggtcagctctctggtcggcggtgtgcacgttacgctcggcgacgactgatatagctatactgacggaactctcctcagtgaaccgcaccccggttgttggactgaagtaattcagattcgatgatcggaggtgcggtttcttatgtgtggggatcgcaggcgtcgttgctgggccgagacttgggactccggcgacgctgggggtggcaggcgtcggtgttgggacagattttgtatctctgacgacgctgtggagggcttaccgtcgtcagcggtacagatcttggagttctgccgacgctgagggtgcgttctgtgtcgtatgcgtccaattcttggccctctgccgacgctgggcacagcaagcgtcgttgctgggccaagttttggactgccgccgacgcagagaatgcacacagtggtgttggtctgccagcgtgtggcagcttggcgccgctgggggggagtcatgagtcccattccaactcccccttattgaccacttaggggtgcatcccaacacatggggtgcacccccttttttcttgttgtgctacggggttccagtcgcatttttttcggtgatattttgaacgcgaagacaggctgggaaatgcccgatagtcgtgttcccctcagcaggtgaagccctgctttcaggctgcaaaaccgactcgggtgttccgaaagcggctttcgttgttgtacatcgatacataagagagaacacccatgaaaaacaccattattcgtgctgccggtgtgctgttggctgcaagcatgatatttggcggtgcggcagccactgcatcggccgcggaagcaacgtcgccgagcaccggcaccaccagcagcacgcaagccgcggaatccatcaatcgcgaatgggtgctgaatcctgcgaacaacactgagctggcggctctcggcactatacaaggcggatcccagacgttcgacgggctgaccatcgatgccactgcaaacggtgccaagtttgcgccgcgcgccaatgacacccagatcaacgccggaaccatcatcagcatcccggtgccagcccacaccaatacagccaccatcacccttgcgttgtccggcggcaccaccactattaccgcggatgccggtgaagtgagcagcgacaacacagttatcgccttgcctgctgcggagtcggctcgtacggtaaacgtcaccttcactgcccagacctatctcaacggcatcgcccttgccgaacagcagccggaacccgagttccccggtacgcccacggtcgcggccaaagacacgaactgggacttcacggaaaccggcatcgatcgaccggccgtgcagggcctaccgacaactaccaaggcgtcgccatcgacgctcgggcgcaaggcgccaagttcaacccgcgtactaccgcggcaagcggcggcagcgatactcaggtgaacgctggaaccatcctgtacattccggtcgcacaggccgagggcggcgctacagtcaccgtgaagggccagctgtacggtcctacgctcaagctcgacggtacggacatcaccaccggcactgctgtaaccatcgcaaccgacagcacgcgctacgtgccgctctccgttgaaggcacgggcagcctgtacctgaccggcatcgccatcgactacgcggccggctcccccgccgccaccagccacacggtcaccgtgggcccgaacggccagtaccggaccattcaagccgctctggatgctaacgactcttccgaaaccgaccgactagtgctgaagatcactccgggcgactatcgcgagaagatcaccgtgaccaagccgggcgtcaccttcgccaacgccgacgtgaccgccaagcgcgcggtgacgattcgcgccagctactattcgtccaacacattcgatgccgacggcaagtttgtgccgcaggatgaattcgaccttggcaccaacaagtgcgccaccgtgaccattggcgcgggtgccacaggtttctccgcctacggcatcaccttccagaacgattacaacgtggtggatcacacggcggcgggcgagcagacgccggccgtggcgctgaacacccaggcagacaaggtgtacctgaagaacagccgcatcatcggccgtcaggacactctgtacgtgcagggcgccggcaaccgcgtgtacgtggacggcggctacatcgaaggcacggttgatttcgtgttcggcgacgccaacgcctacttcgccggcaccgagctgcacatggccgcgttcgccggcaagaacaacggctacttcaccgccgccaacaccaagaagtccggcgtgggcctggtgtttgaccgctgcaacttgaccgttgccgcagcatatgacgacgatgccaagctttcgctgggccgcccgtggcagacgttcgcgcagtacacgcaggtgcgtaagggcgacggcagcagctatgtgaccggcgtggatttgggtacgaagaactcggcgtatacggacacttcctcggccgtgacctacctcgacagcacgatgtccagcaagatcaccaagaatcgttggaatgtgtggaccagcaagaaccagagcggcaaaagcgtggacgtgaccttccacgatgatgtgcgattcgcggaatacgccagccacgatgaaaccggcgcgctgcttgatccggctgattataagaacgtcgtgctcggctcgatgtctgctttggatgaggctcaggtgcaggcgaagcgtgctgaattgctcgcggcactgggcttcggctcggcggctggttagtgggttgtgccggatggcgcgtggccattcgcttacgacccgaactactcgaccggcactgatgtgcagccgactcagccgggcggcaacgcctcgcctaacgcggattcggcggccaaggccgacaccatgccggaaaccggctcggccatcattgcggtggttgtagtcgccgtgccgctgctcgttgctggcttggcgctggtagcagtgcgccgcaatcgccagcagtgattgaaagcgttgctgcgaaccggacctggtgaccttgtagacgggggggctatctccgttgaaagaggtacattgatggctttgcagaaagccaactgctttcaaaggggtacctgaaccacgaaacctcgagtataagcgttgcaatgacggcgtttatactcggggtttcccatattcagtacccctctgaatgcagttagcttggatcgatgatcatatccaagaattcactcgtatagtggtgcgtaatgcttacgtatttgggatagcacttgttgctcgttgtacatatagcaatgcccttgcctcctcacggggaagcaagggcattacgctactgcttagtactgcttagtattgctcagcactgctcagcgattgctcagcggcaagcgtcacagcacgccctgggcaaccatggcgttggcgaccttgacgaagcctgcggcgttggcaccgagcatcaggtcaccctcgtgaccgtattccttggcggcggccagggagttggcgacgatttcttccatgatggacttgagcttggcgtcgacctcttcgaaggtccaagacaggcggtagctgttctggctcatctccaggccggagacggccacgccaccggcgttggcagccttggccgggccgtacagcacgccgttcttctggtagacctcgatggcctccggggtggacggcatgttcgcaccctcgacgaccacggtcacgccgttgtccacgagcttctgtgcggattcgccatcaacctcgttctgggtggcgcacggcagagcgatgtcgcccttgacggtccacacgcccttgctgccctcgtggtactcggagcccggaacgcgctcggcgtattccttgatgcggccgcgctcgacttccttgatctgcttgacgacctcgacgttgatgccgttcgggtcgtagatgtagccgttggagtcggagacggtgacgaccttggcgcccaactgctcagccttctgagcggcgtaggtggccacgttgccggagccggagatcacgacggtcttgccctcgaaggagtcgttgcgcagcacgcgcagggcttcctgggtgtagtagcacacgccgtaaccggtggcctcggtgcgggccagggaaccgccgaattccagacccttaccggtcaggacgccggagtactcgtcgcggatgcgcttgtactggccgaacaggtagccgatctcacgaccaccgacgttgatgtcgccggcgggaacgtcggtgaactggccgatgtggcggctcagctcagtcatgaaggcctggcagaagcgcatgacctcagcgtcggacttgcccttcgggttgaagtcggaaccgcccttgccgccgcccatcggcagcgtggtcagggagttcttgagaatctgctcgaagccaaggaacttgacgacggactcggtcacggtcgggtggaagcgtagtccgcccttgtacgggccaatggcggagttgaactggatacggtagccgcggttcacctgaaccttgccctcgtcgtcaacccaggccacgcggaacttgatggtgcgctccggctcgacgatgcgctccagtacaccggccttctcgtactccgggtgcttctcgacaaccggctgcagggtctcgaagacctcgcgaacggcttgcaggaactccggctgatcgccgtcacgggcaacgacctggtcgtagacacgcttgatgtactcgtcagtgagcatgattctcctcgatttgctagggaattaagacggttttattctatgcgcgcaggcccttgctgcatagagtctcgctcggataacgggaaagctatcggcgtggttatggggtggttcaagtttccgtttgttagatttttcggcgattgctggatgtctgtctgtgcgtgaatcgggtcgaaatggaagctgcatcacaccgaaggtgcgttcatatagtggacataaaggtggacttgggtgatgtcggatgtgcccgttgggaatcgtgcaccgtaggggccgaggtcttcggcgcgcaggttaccgggttcgcggtcagtgcgcgaagtaggtctgcagaatcatcgtggtctcggtgcttaccggcaccgtgcggtggatgagattgagcaattcctcaagggcggtgggggaggccacgcgtaccaccagtacgaagctgggggcgccggccaccgaatagcaggagacgatgccgtcgatattgttcagcttgtccggaatcgaggattcggctgagtagtcgagcggggtcacgttgacgaacgcgctgatgggcaagccgcgctgctcttggtcgatgatggccttgtatcccttgatgatgccgcgcttctccagcttctgcacgcgcgactgggcggcggagacggacagtccggtcgcctgggccagttgcgcgagcgtggcgcggccgtcggcctccagcatggtgaggatgcgctggtcggtctcgtcaatcgcggtcatggtgtcttctccgttcgttgtgctctgtgttcactgtacctgttgccggaatgcgatggctttccgattttgcctggtaatttcagtagttcttcctgtgttttctgttgtgtggtggaatgtttatgcctaaagtcctaattgaatgtaataattccttctgaaataagagaacgacgaaataattccattgaggagggatgatatgcagaagttttccaacatgcctctgtccgaagttgcatctgctgctgtgcctgctgtcagacgggttgctgtgccgaccgccaagcccgcgagcttgtccgccgaagccctgaatatcccgcgctccggcatccgagacgtattcgaccgtgtagagcgcgtgcctgacgcgatttcactgaccgtgggggagcccagcgccacggccgcgccgcatatcgtggcggccgcttgcgaggccgcacaggctggccgcactcggtacaccaacgtgctcggcgtccccgaataccgcaaggccgtggccgattactccgcccgtgtgaagggactcacttatgatcccgaaaccgagattcaagccgttgacggtgccacgattggcctgtttctggcgctgaaagccgtggtaggcaccggcgatgaagtgattattccctcgccgttcttcacttcctatgacgccgaagtgatgctgtgcggcggccgcccggtcaccgtggcgctgcgtccggagcacggcatgcgcgtgaacgcggcggacatcgaagcggcgatcaccccgcgcacccgcgccgtaatcatcaactcacccggcaatccgaccggcgcggtaacttctgccgctgaactggcgcgtattgccgaagtatgcaagcagcacaatatttgggccatctccgacgaggtttaccatccgttcgtgtttggggaaacgttcggggaaacgcttgggggagaggcagccgtggcaccatcgattgccgcggtgccgggcatgaaagaccgcaccattgtggtggaaagcctgtcgaaaacctacgcgatgaccggctggcgcatcggctacctgctggcacccgaagcggtcatcgaacagaccggtaaaatcgccgaactcatgcactcctcggtgaactccttggcgcaatacgcaggcgtggcagcactggccggtccgcaggatcatgtggccgccatgcgcgaggaataccgcgccaagcgccagatcgtgctggacggtctggccggatgcccggtattgcgcttgattgaaccgcaaggtgcgttctacgcctttgtggacgtacgcctgactggccttgactccggtgaattcgcagaccgtctgctggacgaagagcacgtggccgtggtccccggcgaggccttcggcgaggaggggcgcggcttcgtgcgcctctcctacgccggagatgccggcgagctgcgtgagggcgtcgcccgtctgcgcgcattcgccgaacgggtatggaaccccatcaccggacaccacaccgccacttatcaccccatggaggtgttggcctgaggcttaaagcgaggctaggccgccaattcagactcgtcggcgcgagcgatggcctgctcgtaatccttggtgcctttgaacacttccttggtccacgggttgatgccctgcttcttggcgcgtagcaggatgtagccaagtgccagcacattggccgccaacgcgattaacgagactgcaaggttcacattcggattgttcacggactgggtggagaacatggaatagtcctggaacatcgggaacacctgcgcgaacatgcaccagatggccagcgtgttggcgcggttctgaatccaaccgcccttgttccagaagaagttggccacggtgggtgccagcagcagcgccaggccgcaataccaggcgtgggtgggcaggcagttgtaggtgtagcagaagttccacaggtcgtaggccacgatgaacacccaggtcatgtccggccagagcatgtcgtccttcttcttggaggcgtagatgccgaaccagccggtcatgcagaagatgttgagcaggccggccacgccgttgaagacgttgtgccagccaccgtacagggtcacgccttcggtggagatccacgtggtgccccagccgcggatggcggattcgaagtcggacactacggcaatgaggatgttgatggccacgatcacgaacgggaagcacttgaaccagtgcgatttgccgatggatccccacttgtatttgagggccatgaaaccgatgcagccgatggtggccgcgtacagcttggcatagtggaaccagctggtcatgtgtacgtaggtcgggttgttgagggcccagtcggcacccatggcggcggccgtgtagatggtgatgaagtagacggtcagcacggccggtatgacgaggaaggcgataacgccaccggttttggtgcggcgggccagttcgttggcgccgataagacagcagaagacgagtatccatccgatccattggtagatggcgttgtcgccgtagacctgaaacagcataagcggtcctttccgtgtgtgcgctgtgcgcctcgcagtcctccattgggttgctgagacgcctatagacgccgctatgttgacgcagcgtcaatttctctcacggcacagtctagcctcaagttgacatcgcgtcaaaacaaccgcattaaggctgccgcgtttcgtatcgttacgcgtaggggctggctgaggcgtaatgctgaagagtaacattgaagcaatggcaatcaagccgatttgaggaagagaagcacacgatggcgtactgcggccactgcggaaatagagttgataggccggcacgattttgcccggcatgtggagcgtctgtagacagcgcaccggttgcgtctgtaccagtgccggccgcatcgtcagccgtaccgactgcgtcgataccggcacctgctgtgccagcgccttcagtaccaccatcgataccagccgcgccggttgccccatcggtttacgccgcgcccgctgccccacagccggcaccaactgctcccttgccagctttgccgattcccgctcctgccgcatatcaggcgactgatgcaaccgccgtcctggcaccgccgcgcaaatccagcaagaagctgatcgccgttctctgcgcattgcttgcgacgattctggtggcggccttggcattcatcgtccccaacttcaccgccgtcaaagcgatgctgggcttccagcccaccaatccgctggtcgtcaccttcgacgcgatcaactcgctgtccactctgcgcagcaccaaatacgaactcagaacccacagcagcactgacgactcccttgacgcgcggatgtctggcatgtattcgctggggcaaaaccaccaatgactcctccgcgtctgtgaccatcaagacagatgaacaggcaacaaccctcgcttggcacaaaggcgcattcgccgggaaaaacgtttggtatgatgacgacccctactacatctactacccggccgaccaatatgaagatgacttaaggaacggcgttggtagtgatgtggcggacttgatattgaacgtcaaggatgcgttggtcaagaacggtgcttgggacatcaccggcgcggagcgaacgttctacgatcagctggacaagatgaacgacgatgggtactcgaacgacatcgaccgggccaagggcacgaaaacgtctgccgaggtgaaggccgaggccagcaaattcatccaacaatatctcggcgtggagctggaagataagaatgtgcgcagccagctgttcccgaatacatcgtctgccaagtctgccggcaacacgcagctctcgtatcaaatcgatgtcaaggcattggcccagcactttgtgaattactggatcagccatgaagcgcagtatccgcatctgaaatcatgggtgattcagcagatcgaggataccggtgtgggcgatgctgaaggcgagtaccgtcaggcgctcgacaatgtgcgcaactgggacttcggcacggatgaagagccggatatgccgactatcaccgtggatctgaactacggcaggaagcatctgatgagctcgattgccgtaagcgtgtccggcaaggacgaatacggcgactcctacaaaggttcgctgtcgttgacgctcagccagcagaacgcggtgtctgtggacgaccccgatttgactgatacggtgagcaaagccaaggacaacaacgagctggatctgtcttgagcagaatcagaatgtgcggaacgccgtgaacagatcatcgacgtgacgtcgcatgtgattcacagaacgggttttggggcttttccgttcgtcaggtagccgaagcatgcggattgaccgagccggcggtcatataccatttcaagaacaaagtcggcttgctgattgccgtgctggagcatcgtgatcgggaagatatggctacgtttgcccattctcttggcgttgaacctgaggatatgtggagcggcaacgcgcagttcggcattcgtgatatctgtgctgcccttatggagcgcaatgcggctcagccagagatggtgcggttgtatataccgtgctacaaggcgaatcgttgaacgagcatcatcctgcctatgagtattaccaaaaacgagaacatcgcgtgatggacaccttaacccgagcagtcgagcgtgacggtttggcagatcctcgtcgcgaggcgcggactgctttgtcgatgatgaacggcattcgggtccgtttggctcagggatcgggcatcggtcgatttagtggccgattggaatgcctatgccgacttccggtggcctcgacagtcgtgaggcaataagacttttctcgtgagatacgctatcggcgtgtcgtcatctttttgttgcaatacgcagaaaatgcaagaacaaaaacccttggaatcggactgattccaagggttttgttgtgtctgtggagctagccgggttcgaaccggcgaccctctgcttgcaaagcagatgcgctaccagctgcgctatagccccgtgagaaaaaaagagcggctcgcggccgcttcatttttcctgtgggcccgggaggacttgaacctccgacctcatccttatcagggatgcgctctaaccagctgagctacgggcccgatccatacgcttcaaaagcgcacaagtgattacaataccattgaacggcggtatgtcaataacggcgtgtcgcgattgtcgcttgcgccatgattgccggcgcagcggagcatgacgagtgcgatgaggctgttcgcgtggtggaagccgtaggccatgcggatggtgaccttgatcctgttgtcggacgcctcgagcctggcgttggagtagcccagctcgatggtcctgaggatgtcgggccacgacggcggatcttccgggatggcttgccgctctcgtacaactgcacgatctgccgtttgaacgcctcgtcgtagtggcggggatgtttcgggtcggccatcgtcggcctccaatctcatgtcattcgtccctcatcggactgtctaatacgttgtagccaatccacggcgtcacatcgtcaggctgtccgggtcgaggaggaaatcgtagacgctcatcgtgaggatgccgtgctcgtcgcggacgggtttgaccacgtcgcgtacgaggacgatcttctggaagctgtcgtcgatctcgagcagcgaggcttctcctgcgcgaccttctccggtgtgggcagttggtacgcggattggtcagggcgccgatggaggaggccagcacgtcgaccaggtcgtcgagctcctgcgacctgcgcagcccgttgcgcatgcgcagcagcccgttgatcaccccgtacagacggggcggctcctcgccgcgcgtacgaacgcagttcatgaagaattacgagtgattcgtcgaagtcttcggcgttacggccgccgcctgagccagggcggcggccacttgttcgttgacggctccctgctgtgcgatggtgacgcggatgcctcgactggcatgcgcgtccacgcccgcaccggcccccgcgtcggctccggtggcgtcggcgctgatacgcaggctcggcaggaacggcttgccggcggccacacggatgccctgttcggccagcagtcgcagcgccgccggctcgtcgcgcaccggaatccacagattcagtccgtcaccggtatgcacgtccaaactttgacgcagcagcagcgcgtgcatcgtcttttgccgggtggcgtagatatgccgggcgttggtcaccgtgtggaacgcctctttgtcggccagcatttcatacagaatctcttgcaggaaccggctcacccatcccgatcccaagcgtcgttgggcgataatcgcctccacggcatcctccggcccagacagcgcagccaagcgcagatccggcccgtgcgacttcgaaaaactgcggatatgcaccacgtgttgcggcaatcgttgcgccaacgatgtcgcatacgcattggccacatcgccactgtgatcgtcttccacaatcagcggcataccaacgccattcgggtagtgcgcgagcagcacgtccgccaaagcgtcgatgcgttgcgggctgaagctggccccggtagggttctgggcgcgcggctgcagcaggatcatactgacctgatggccgccgtgcggcaccgccagacgctgcgattccagcatggtcagcgcacggtcgagtgcgtcgggcagcataccgaacccgtccatcggcacgccgaacgccatcgcgccatgtgcctcgatcatgtcgagaatcagcggatattccggtgcctcggtaatcacaaaatcacccggctgaacaaaagcgttcatggtgtgcgccaaaccgtcgcccgcgccggatgccatagtcatcgcctccggctcatacggccagttgcgtcgcaaaatctgttccagcatgggcaggatggtcggcccgtcgtatgaattgacgaatgccttgtgcgtgccgagcttgccgagaaacgggcggatgtccggcagcagcgaaaggtccggcgtgcccttggacaggtcgataatcggtcggtccggcgcggtggccggggcttcggccagcaagtcgccggcatcgtagcgatgcgtgcgcgactgccgcagtacgaatgttccggcgcgcccgcgggagcgcagtatgccggacctggcgagggcatggtaggcactggagacggtggccggactggtgcgtagcagtcgggcgagatcgcgtacggtgggcatgcgctggccttccgcaagtatgccggaggaggtcagcgaggtgaccgattcgacgatgcgttgcggggtggccgtcgcctcggtggtgaggatgagtgaggataactggccggcatcaacggccaggtcgtcggtggaacgcaggggagcggccgtaatgcttggctcatcgttgtagccgacggcatgtgcggttgttgatgcggttgatggcgatggcgtatccatgatctgcctcccggatcttggcggcgagcgtgatgagcgcgcgtctgcgtgaatgttgccgattgccgccggctgatgatcgatggcggttgccggcttgttgctggctgcttgactgccgatagtaacggtcactgtggcaacggtagtcaaatgttagcgccgcattgtgcaatgagtatgtttttgaataacataaacattacataatctggatacaattattgttcttgttcctatgtttcaaaatgatttcgtattcgccactactgtaacattattaaatgttcgagtttgacgcgaaatgttcaactctcataatgacattcacagcgcgttgctgccctgccccgatccacgggagacggcatcgggcacttcgagaaaatatcgaggaaaggacacatcatggggcatgatctttcgcaggatgcggaaatctgggacgacgcttacaagctggaccgcgcacacgtattccattcgtggcacgcacagcgcaacctggatcccactgaagtggtaaccggtcacggcgtgtggctgaagtacggcgacggccgtgaaatgctcgacttcaccagccagcaggtcaacgtcaacatcggctaccagcacccgaaggtgatcgagggcatcaagaagcaagcggaactcctgtgcaccgtcggacctgactacgcgaacctagcccgtggccgcgccgcctccctggtggcccgccgcgctccggaaggcttcgacaaggtgttcttcaccaacgctggcgccgacgccaatgaaaacgcgatgcgcgccgcccgcctgttcactggccgcgacaagattctgtcttcctaccgctgctaccacggcaacaccggtgcggccatcagcgccaccggtgactggcgccgtaagcccaacgactactctcgcggccacgtgcacttcttcaccccgtacctgtatcgctccgagttctccgcaaccacccaggaagaggagtgcgagcgtgcgctggctcacctcgagcacgtgatccagttcgagggcccggacaccatcgccgccgtgctgctcgaatccgtgccgggcaccgcaggcatcatcattccgcccaaggactacttcaagggcgtgcgcgagatcaccaagaagtacagcatcctgatgatcaccgacgaggtcatggccggcttcggccgcaccggcttctggttcgcactcgacgactacgactacacgccggacatcatctccttcgccaagggctgcaactccggttacgtgcccgccggcggcgtgattatgagcgacccggtggcccaccgcttcgacgacatcgtcttccccggcggcctgacctactccggtcacccgctggccatgggcgccatcgtggccacccaggaagccatggaagaggagcacatcgtcgacaacgcctacaccatcggcaaggacgtgctcggcccgcagctcaccgctctgtacgacaagcacccgaagatcggcgaggttcgcggcaagggcgtgttctgggccgtggaaatggttgccgaccgcaccaccaaggagccgctggacgacgccacgatgaagcagatcgtggccgaaggcgacaagcgcggcctgattctcggcgtgcacaacaaccgcatccacgtcactcctccttgcgtcatctccgccgacgaggcgacccagggcgtcgagatcctcgaccaggtgctgaccgcggccggttgctgattgggtgactcaatggctcggtgacggtttgtagccgttgccgacagcaccgttcattgctgatggcggcccgttcggaacgttaggttccgggcgggccgccatcgttgtccgccgttgtgcgagaatgacttgcgtgccttatcgccgtcgtcaatccaccgctccgaagtccggtgcgccgaaatccgttcggtccgctgccgccgggcagtcgttggatattgatggcatccatctgcacctgacgcgcaaacccatcaaaaacctgtatctgcgcatcaaaccgccgagcggccgcgtcgaaatctccgcaccgatgcggatgagcgagagtcgcattgcggatttcgtcaaagagcgacattcgtggattctcgcccagcagcagcgcatggctgaggcgcaacggcgctccatcatggcattgaacgagggcgccggcttcgagaacggaggtcgtggtgtagctggtgccagcggccatgatggaggcgttgccggtcgtccgaaaaccggtgatatcagtcgtccgggaattggtgacgccgggccaggccaagccggtacgaatgtccaaccgtattttgaccgctcccaaatctggatcgacgaacgcaaacgacaagcggcggccgcgatcaacgccgcgttgccacagctgctggccaagtgggggccggtcgtcggccggcagcccacgcatatcacgctacgggtcatgacctcgcgctggggatcgtgtacaccgcgaaccggccgcatccgtctgaaccttcaattgggactgatggaaccgcaattcctggaatacgtcttggtccatgagatgacgcatttgtgggaaagcggccacggtgccggattccagcgccgcatgaccgcctacctacccggctggaagacgctgcgccgcgacctcaaccgccgcgtggtgctgtgacgatgacgggtcaggcttcagtgccggcgatgtggctgatggcctgatcggattcgttcgcatggtccgaatgcgccaccatctcgatggccgccggacacccgctcaccgacgaagaccgctggccttggctcgacaccatcgccgcgtggatcgacgagcgcgtggccgccggcgagcccgccgtggtcacctgctcggcgttgaagaagatctaccgcgacaagctgcgccgtcaaggcgtggtgttcgtctacatgcagggcacattcgacgaggtgatggaacgcctttcccaccgccaaggccacttcatgaagccgagcatgctgcaatcccagtccgacattctcgaagagccgggcgatgacgaaattcacgtcaacgtacacatcggccaggccgatcccgaacacgaggccatggccgtggccggtgccctcggcctgtgagccatctctcggctccccttagtctcacttcgccacacgtgcggcgcatcgacgaactcgaacggcgcatcagcgaacttcagctggagctgaagcagtgtgaaggccagcaagggcgaaccggatcggtccaaacgggctactcaggccgaccagcccagccagtccgttcagaccgacctaactgatcagagcgggccctctgaccagtccgaaccatctgaccgacatgtacttgttgactaagtgtgcggcccgtcattcgttatggaacatgccggccatgtatacaggcaggtaggttacattcccttcgactgagacgttgcacgggccaagcacatagcctgtattgagatggtattcagggtgggcgagcacgttgtccattgcgcgatggcgtttgtaggatttgccggacttcacctcaatcggcagcacgtgatcgttgcggtcttggatgaggaaatcgagctcgccaagcttcttactgttgtagtagtacaggtcaaatccgtgagcgcgtagctcttgggccaccgcattttcatagattgaaccgtagttgatatcagggttgccgtcgagtacgtcgagcgcggttttcttgagaaacgagccggtaagcagacccacgtcgttgtaaaagagtttgaagaggttacgttccttgctcatctccaacggtgtgcacggttcgtccacgttgtacgcggcgacggctacatccgcattgaccagccaatcgaaatcggaagcaaccgattggaatctcatgttcttttcgattttggcgaaggtaaagcgcttgtttgggttatttaactcgctgggcaccaaatcgtagatagcgcggatatgcagccggtcttctttgcgcgcgtattggctgatatcgcggcgatattcacgctttatgttctcttgtatagtgcgcacgtccgcaacgctgccgtttgccacgaacgagtcgactgcggcaggcatgccgccgatgaccagatatttggagtatagctccatgagcctttgatgaatgaactcatccacttcctggtgcttggcaaagcattcggcaagcatatcgaatacgtcgttgccgatatgctgcgaccagcagaactcttggaaatccagtggatacatatccagctcggtcaggtacccgaccggtaccgagcgtatatcttcgagctcgactccaagtagcgagccggaaagcgcgtaatcgaaccgaccatcatctacaaggaacttaattgcggtgaccatttccttgcaacgctggacctcgtcaaagaaaatcagggttttgccgggtactaatggcgtatttacggccagttccagcctcatcagtaggtttttggcatcgcggggccgatcgaataatgcaacgaggtcagggttctcgatgaaattgagctcggcgatatggtcgtaatgctgttgggcaaagtgcctgatgatataggttttgccaatctgacgggctccggtgaccagcagtgcagtgcgtttcggcgcggatctccaagcttccagctgtgtctcgatttttcttcgcagcatgagaatctccagtcatttgtaggccttgcatctatgctgggcacgttttccaactgtttatagcgcatattttacacttttccaaccataagaatgcggttttggctacgttttccaacctcaaaatggggagttttatacacttttccaacttatgtatgtggagactctctatttcacgtgagacgaaagtggctcccctctttgaggggagccacggaatacggcttttacttatgccaggtgagagcgcatgaaccactggaacttttcgagttcctgcacgtggtcctggatgatgttggagctgatcacatccagctcgtccagctcggcgatggccttgcggtcgtcggcgatgaaggcgtcgtagtactcgatcagcgccttgagatactcctcggtgcccacgcggccctcagcgtcgaacgatttccacgtgcggttgcgcacgatggcgtcagcacggccatccggggtgccgcccagagtggcaatgcgctcggcggtctcgtcggcctgggccagcacggcctcgacctcggggtcaagcatctcgtgaacggcgatgaagttcgggccggtcacgttccagtgtgcgtgcttcaggaccagagcggcctcctgctcctggctcagtcggttctgcaggatggcgatggccttctcactggccgcttcatcaaggcccggcacaacaaatgcaagtgtcataatgttccttctttcagtaggtggaacgttgccctttcattctacgttttttggttatgccccgggccgaacgaataggtggtgaatatcacgtggctagttggcatcgtcgctttgtgattcggctggcagtggcgcatggtccggggcgccggctttgcggacttcgatggtttcgatgcggcggccatccaccttggtgatgaccatgttgtagccgtcgtcggaatgcagcacgtcgcctaccgctcccatcttgccggtcttggacaggaagtagccggcgaccgtctcgtacgggccgtcctccagctcgatgccggtcagatcggcgaagtcctcaatggtcatgctggcctcgatcgtggccacgccattgacgaacgcggtgcgggtggtgcgttcgccgcccttctcgctgggcagatcgtactcatcgcgaatatcgcccacaagctcctcggtcatatcctcaagcgtcacgatgccgtccgtgccgccgtactcgtcgatgaccacggccagatggatgccgcgcttacgcagcagttccaggcttggcagcagcttggaggtgccgggcagggagatgccttcgcgcaccacatcgcgcacgatcttggcgttcggatcgcgcacgtccagcagatcgcgcacatgcacgaagccgatcacgtcgtcgaaatccttgccggtcaccgggtaacgggagtacggctggtcgcgtacgaacgcggcggcctcggccaagggctggtcgccctcgatgaagaccacgtcggcacgtgggcgcatcacctcggcgacgatggtttcggacgcgtcgaacacatcgtccagaatcgtgcgttcgtccttggagaggttggtgttggagctgaccagcacgcgcagctcgtcgtcggacacctcggactcggtctgctgcgggtcgaagccgagcaggcggacgatgccgttcgtgttcttgccgatgagccagatgatcgggcggcagacggcggcgaaggcgtcgatggcgggcaccacggcgcgcgcgatctgctcggtgcgctgcatggcgatgcgcttgggcaccatctcggagatcacgatggaacagtaggagatgatgagggtcaggatgatgttcaccaggccgccggcgatgccggggtgcacgccccagctttcgaccgccggaatcaggtagggggcgatggaagaggcgccgaacgaggcggacaggaagccggagagcgtcacgccgatctgcacggtggacaggaaggtgttcgggtcacgtgcgattttggcgactttggcgccgcgagcatcctcctgctccatctgttcgatctgcgagccgcgcagagagaccaatgccaactcggtgccggagaacacggaaccgataacgagaaatacaaaaatcaggaggatgttcaaaccaagtgacatggcttcaactctaggggagcggcacgtcaaattggggtgtgctggctgggcagtaagaaactcggcaaagggaagggcactcttatcattaccgcggacgacgtgtcgaccggtgtttccgatgcgttgctcgccttcgacgatgccgtatgcgctccagcgctggacggcattactagtgcagagaggctgtttctcgcggctatggccaaggattcgccaaatcccacgcaggtggcgatattgcggatcgcacgctcagaagctcagcacttccactttgccggaatcgagctgatagcgggcgccgacgatcatgagcttgtcagtggcgagggcctgctggatgacaggagactgctccaccaaagtttcaataatgtgggccacatgcacgcgctcgatatcttcatgcgcgtcgagctcggcttcgcgcgcctgccagacggacataccggtctggcgcagaataatcgattcggcggcggcgatgtgctcgtcgaggtcgtccatcgcatccgcggcctccagtgagccgtcggcttcggaagtgatggtgtgcatcaggtcgtccagctcctgctcggcggcctcgattgcgccgcagtgctcgtgaccgagcacacagatcaggctgacgtgcagtttcttgaccgcgtactccagcgaggcgataaccgcgctatcgatgagttgcccggcggtgcgcacggtgaacaggtcgcccaggccctgatcaaaaatgatttccggaggtacgcgcgagtccgagcaggagagcaccgcggcatccgggttctggccatcaagcaacgtttgacgggtctcctgatcctgccatggatggtcgggcttgccctcggcaaagcgccggttgccttgcagcatgcgactccacgttgcgtttgcggtcgattcctgttcaaagtctgactgagccatgaaacctccattatcagcgggctgctgattgccatattagcgagtattcgcgcatagtcgtgattggggcaacggccatttgggcacaagggttgcgggtggtgtgataaggctcatacgttacacccgcgcgagccgtggctcaccacattacgataggtggtggtaaacgcttgaagattaacaattcccgaaaggaccgatgatgactcttctgcagcatgaactgaccgatttcaaggtgaacgcattccagaacaatgagttccacgaagtgaccaaggacgatgtgctcggccactggtccctgttcttcttctacccggccgacttcaccttcgtgtgccccaccgagcttgaagacctggccgagaactacgccaagttcaaggaaatcggttgcgagatctactccgtctcctgcgacacccacttcgtgcacaaggcctggcacgacgccaacgagaagatcgccaagatcgagtacccgatgcttgccgacccgaccgccctgctggccaaggatctcgacacctacaacgaggccgatggcatggccgagcgtggcgacttcatcgtgagccccgagggcaaggtcgtggcctacgaggtcatctcctccaacgtgggccgcaacgccgaggagctgctgcgccgcgtgcaggcctcccagttcgtccacgagcacggcgaccaggtctgccccgccaactggacccctggcgaggaaaccatcgagcccagcctcgacctcgtcggccagctgtgatcgacactgaataggcggtaatcttggccccctttctgaggggagctgtcgctgaaagcgactggggggagtgctcgcgagagctagcctgatccgatatgctcccctcagtctcactacgacagctcccctcagagaggggagccagtgtatgtaagggagttttcatgactcagaccaacaatctctatgacgtcgtcgtcattggtggcgggccggctggcctgacggccggcctgtacttggcccgcgctcgctaccgtgtgctgattcttgaaaaagatgatttcggcggccagatcaccatcaccaacgaagtcgtcaactatccgggcgtgggccgcaccacgggccgcgcgctcacccagaccatgcgtcagcaggctcaggactttggtgccgaattcctctccgccgaagccaccggtctcgacgtggatggtgacatcaaaaccgtgcacacctcacgcggcgacctcaagaccttcggcatcctcatcgccaccggcgccagcccgcgcaagctgggcttcgagggcgaggccgagtacgccggccgcggcgtggcctactgcgccacctgcgacggcgagttcttcaccggcaaggaagtactggtggtcggcggcggattcgccgcagccgaggaatccgtgttcctgaccaaatacgcctccaaagtcaccgtgctcgtgcgcgaaccggacttcacctgcgatgccgcagtggccgccgaagccaagaacaacccgaagatcgacgtgcgttatcaggttgagctgaagggcgtcaccgccggccaaggaggcctgcgagaagcctcaatcctgaaccttgccaccggccagaccgaaacgtggaagcccgccgacgccggcaccttcggcgtcttcgtgttcgccggctatgtgcccgccaccgatttggtgcgcggcgtggtggagctcgacgaccacggttacgtggtcacgcacgactacctcagaacctcggtgccgggcgtgtacgcggccggcgatctgcgcgtcaagaacctgcgccaagtggtcaccgccaccgccgacggtgcgattgccgccgtggaactggagcgttacgccaagcagatgagcgagaaaaccggcttggtgccgccgcgtcccactgcttccgcttatgaggagtccgaggccaaggccgcctccgccgcctcggccgctggcacgacgcccgccccggctcccgccaaacgcagcgccgatgccgcagccgcagccagcgccgccaagaagcccggcgaactgttctccgccgccgtcaagcagcagcttggcgtggtcttcggacgcatgacccgcccggtcacgctcgctctcgagctggacggcactccgctttcggcggaattgcagggtttcatcggcgagatggttgcgctgtccggcggcaagctgaactcggttgccgttgatgccgcagggctgatcacggcggtggatggtgcttctgtgcctacttctttggtggtcggcgaaccgctgtccgtcaccttgccggacggcaccgaactgcccacttatggttcgttggacgattccggccgcgccacattcgacgtcgccggcgtcctgccgctcgcccgcccaactgtgcgcatctgcgtgccggctgagggcgacggcaaggccggcaaggacggcaatggttcactggtcttcaccggtctggccttccacggcgtaccttccggccacgagttcaactcgttcgtgctcggcctgtacaacgcggccggtcccggccagccgctgggcgatgacctggtcgaacgcgcgaagtccatcacggacccgctgaacatcatgatcctcgtctcgctcacctgcacgatgtgcccggaaaccgtgcttgcttcccagcgcattgcctccctgagcccggccgtgcgtgccgaagcctacgacgtctcgcacttccccgaacttaaggaccagtacggcgcgatgagcgtgccctgcatcgtcatcacccacgccgacggcacccagcaagtcgaattcggcaaaaagagcatcccccaaatgctcgaactggtcggcgcgtaagccgcacgacctcaggtactcaacagcaacaacaacgattctgccaaaatcgtgacgtacatcgattgatgcgatcgatgcgcccgactccggcagaatcgttgttttgcggcagctcagcctcggtcttcgacggccttcgtgacgtttctgtcgccgaggtacttgaccaagctgatgctgatcagggccacgacgaacaggccggtgagcaccggaatcagcgcggcgtagcggtgggcctgatcaggcgcgtgggcaactacgaacgaggccaactggttgccggacagaccggcgaacgcccaggcgctcagcgtcagaccgtgcgtggtggagacggttttggtgccgaagtgctgatcaagcagcacgggcagcgtcgagaaaccgccaccatagcccgcgttgacgaggaacagcatggccagcacggcccacagcagagcgttgccgatgctgttggtgaagatctgcagcaagcacacggcaatcgacatgatgaagattacctgatagacggtctcgcggcgcttcaggtggtcggagagtgtggagaagcccacgcggccagccgtgttgaacacggagtccacggcgagcaccagtccgatgatgccggagatggcggcggcaaacttggcggggctcaggttggcatactgcgggaaggccctgagcacatcgtgcaggatgtccttctcttggctgatgagggccaggctgcaggtgatgttgatatagaaggctatccagatgccccagaacacgggcttcttgaggattgtcttgcggctgacgtgtgaggtcgcgggatcgtacacccagccggccggacgcttgatgagcaggaagccgacgaacatcatcaccgcgtagaccgcggcgaggatgaagaacatgctgaccaggccaaccgtgccgatgagatattccatcagtgggctggcaatggccttggccaggccgaagccggcgacggcgatgccggtggcgaggcccttgttgtcggcgaaccaaagcatcaggttcttgaccggagtcagataaccgacgcccaggccgatgcccatgatcgcgccataacagatgaacacgcccggcaggaagttcagggcgatgctcacgcccgtgccggcgaagccgaccacgaagcagaccatggagacgagtgcggatttcttgatgtttttctccaccattggcccggcaaacgcggcggacatgccgaggaagaagatggcgagtgagaagccccattccacggaggcggggctggcgtggagacggtcagcgataagctgcttgaacacgctccagcaatagacggtaccgattgggatatgaatcagcagtgcagggataatcgcgctggtccaacgattctcggtaaaccttgccatatatgggcggatcctttcgtaactggtgtacgatggcctgccggcccgaacgagagtcgtatcgcccatatccacgcacatcacgacggcatgcccctgtgaaccatccgggctgcacgaatcgaatcaaatcgaatcgtgcgaactgcgaacaattcgctaaacatccttggtgtgcatttcatcggcgctgctggctcttgtcgacgccgacaaacagaactataacgctgttatggggttgctgtggctgatttctgtggtcggaagctatgagctttctcacatcgaaaacagttatatgacggtatcggcgtgattgatacgtgacgtctgcccgtggacgcggcatatccctctcggaaaacaatgactccgtcatgtccatttcttggtttgacatgttttcgtttgcagcgtcggtgctcaccacggtgaccgcggcgttcgagtcgccgggcagggcctcgaccgagggtctcatcctcggctgagatgtgggcggtactatggattcttatcgataaggttcgtgatatgcggagatggtaacgatggtgaccttaaaggatgtcggcgaactggccggagtgaccgccaccaccgcctccgcggccctgcgaggcaaggattacgtcaagcccgaaaccacgcaacgcgtgcgtgacgccgcccgcaaactcggctataaaatcaacctgtctggccggtccctgcgttctgggcggtccgataccatcaccttccttacctcgggcctcgagggcgactatttctcccatctggccatgtgtgtggctgaggaagtgcacaagcgcgactcgcacatgctcatcgaactgtcccggtatcttaccgacgacaacgatctgtcgtacacgttttcggacggcatcatcgccatcaatgcgccacgtgcggtcgatatcctgaagcggcacccggccgtcatgctggaaaactacgacaccagcctgcccgtcgacaccgtgaacgcgccgagcgacgccggctcacgggcggcaatcgaacaccttatcgcgcgtggctgtgcgcgcatcggcatcgtcggcgacaatcacgatcccaacaatcccaacatcattcccggctcgcgtgatattcgtatgcgggccgccaaggagacgattctcgcggccggactgccgtttgacgagcgccgtgatttcatcaaatcctcgtggtcgattgacggcggtatcgaggccgggcgcggcttggccaagaaaggcaagtgcaagtacgacggtctgtactgcctgaacgacggtattgcgctcggtattctgcgtggtctggcggacgatggcgtaagcgtgccgggcgatgtgcgcgttatcggcttcgacggcctgagccagagcatgtacagcgtgccgactttgaccaccgtggccaccgatttcaagggcatggcggataccgcgctgaccttgcttatgcggcgtatcgagaacctggacgacgagttcttcccgcagaccgtgaatgtgggctataagctcatcgagcgcgaatccactgcggcgtagagtctttggccgtgttgagcttcaattgggtgattggactggcaccagcggctgatatcagatatgccgaaagcagcgatgatcggatttaagttgctggagatgacaggatggattgctctttacccctttcaccatcttgcaataattcttacatgtaagaactctctgttaacatgtaagaattattgcaagatggtgaaaggggatgctcatgttgccggccaaagaaagtttgacggttgagttcaagagtgagcagaagcgccctcaatcgcatgatgaaattgttgacaacgtagtggctctagccaataccgaaggcggcacactgtatctcggtattgaagacgatggcactgtgaccggcgtatgtgacgagcatcgcaatatcaatggacttgcggtactaattttcaataagactgttccgcagcttcccgctcgcgtggcgctcttgtatgagaacgaggtgccgatagtcagtattgaggtggataacagtcagcaaatcgtatctaccagtcaggggaagacattgcagcgccggctgaaagcagacggctcgcctgaggtcgttccgctgtttgtttcccaattcattagccgtttatctcagcaacggttctacgatttcagtgcgcaacctgccccagaggctcggttggacgatttgaatccagactcacggaacaagttgagaagccatattcgcagtgccaatgcgcaaaactcgttgttgtcttttactgatgaggatttcgatcgggcacttgagctggttgttgatggcccgtatggattgcagccatctgttgctggtctgctcaccattggttcggttgatgctattcatcgatcggttccagccgcatcggctgtttttcaagtgatgaaaggcatgtctccaaaggtcaatatggatccgttcgtgttgcccttggtggatatgtttgatcgtgtaggcgagctgatggagccgtggaatcccagccacgaagtcatgagcggcttgattcgggtcgatctgccagacttcgatcgaggggcattccgtgaggcaatgattaacgctttctgccatcgcgattatgcacgaatgggttcggtgaggttcctggttgatgatgatgggttgaccatagccaaccccggaggattcatagagggtgtttccgaagataacctgcttactgcacaaccgcgttcccgcaatccgcagcttgccctgattctgaaagctgccggatatgttgaacgcaccggacgaggcgtggataccatctatgccgggtcgattgcggcaggcggttctttcccggattattcacagtccagtgctgaggaagttatcttgttcttgcgccgcgtggtacctgacgaggcattcgtaaccatgattggcgacgaggaacgtcgacgtggggctccattgccggtctggtcactgattgtgctctcgctgctgcgtgagcatcgtaggcttaccgtggtccaattgtgcgatttttctcatttggagcatcgacgcatcgtgtccgctgttgagaatctggtggaagctggtttggtggagggggtcggtagcgggagctctcgttcgtatatgctgagtgcccgagtgtacaaacgttcagaggggctggcgtcttacgtgcgccagcgtgacatcgatgccacccggcgcagtggccttgttctggagttcgccgaaaaaaatgatggtgtcgtcactacggcggatgtcatggatttgtttggcctgagctatatcagtgcataccgggtgttgaagaagctagaggatgcgggcaagttgcgccgcgaggggaatggaccgtcatcccgatacgtgttggaatgattggtacgcgtgaaagtaagttctttcatcacctttcaataattctttcatgtaagaactctctgtttacatgtaagaattattgcaagatgatgcaagatgcacacaaaacggggaagctctgcttgatgtgagcggggcttccccatatgcgctggtgtgtagatcagcctgtgttctgcaggccggcagcgacgccggagacggtgcacaggatgaggtagatgaatcctgcctgttggctttgcgagagctcttccttgtccaccttcttgcgcagcgacctgagggcgagcacctgggtgacggacagcgcgtccacgtacggggagcggatgcggatggcctggccgagcacgtggcggtgctgcagcggccacttgtcgcccacgatgcgctcaagttagtccggtcaatggctttggaaaatcatggggagtgcggctgcgcgggttcgctcctcgacaaggtgacttgatttgggaccgccgttaactttcgtcagacacatcgtaaatcccgtccaagtatccgtatcgtccgttgtgcttgtccttcgagaattcgacgatattgatgttatcgtcaagaggaatgccagccatgtgattcgtgttttcgataatgatgatttgttgtgaaaccgcttgtttcgctagataggaaaacaggcccactttcatggatgagtcttccaggggtcgtattccttcgtcaaacccatgcagaggcgtatcaataagcagccaacccggagtatgctttgactgttcattgagataatcatgaaatgcgagcataacaacgctgttaagaaatgcgcagtatcccttgccttgttcatcagccttggaataccctgctatttcgacatcaaaagaagatctgctgaaatctgcagtatcagcaccttgaaaatgacattgttgcagaatgctgcgtatggtgttattcatggaataccagaaatcactctggaaacattcgcgtggcttgtatttttcatcattctgtgttgcttgaccagcgtcatcgagtgccttgttgaaacgagcatgcagcgctatgagttccgcatattccgcatgcaattgttctgcatgggcaatttgctcaatatcttgttgcatgtgctgcgctgttggttgaatgtcggatttgagcgaatgcatattttgccgatgctgctgtttctccagatgcagctcctgttgcacctcatcggctttgtcgacgaggatggctagatcggtttcaacgtctgcttggattctgtggatatgctcaatttctgttgagacgattagaatgtcctgttcagtcggcacagacatgtggatggggctgtggcaaaactgacatgtggcgggataggcatgtgtgcgggcatgtttcattgcctgtagttgcaaatcaagacgtgcagcgtctgattcgtattgactgataagtaccttacgttggcgaataagtacctcaaggtgctcatattgttgattaagctgagagatatgtgagatggtatgggcatctcgattgaggagagtttgtctttgctgttctacgtgtaatgcttttttgtgaaggtcttccaaataggtgtgaatggtcttcccctcatttgttgcgatatggcgcatctcctcaaggtgtctgatgcgaggctctatatcatccaactgctgatggatgaactgttccacggcttttctgcgggcgtgacgttcgctggcactctctgtctgtatggagttgtcgattttttcatcttgaactagcacgagcaacgaggacagactttgtgtgagagttgctagagaggtacttttggggaaaagaatggaggggcgtgcacgtcctatttggtcctcggggacaatcatgagatgtctgatggcattccatgtgaaagcaactgtatggtaggtttcgtttgtcgctattctacgggttgattcaacgcctagtaaggcaagaagaaccgtattgattgatttaccggcacgtgatgaaacggagtaggaaccggggacgatcattgggttgctggattttacatggatagtgttctgaacgtgaatcgaacgactaagcgaaacctcaccgccgttggtcacgaacgtgacctgtgcaatttcataggcagttttatcggtaaaggggagctctttccctccgcaggcaaattccacggtttttgcgattctggttttcccggtgttcgaagcgccgataatgcagttcagcccgcatgtgagattaatggcggattccactccgtcctttctgattgccgaaattcgacgtatccatgtgtttctcataactggttgttctctttcgttattcggttcatgatggtttcataatcgttttttatcaagagctgaacagcctgtcgataggaggcagcgtaatcgccgtgcaatgcttccgaatattggaaacattccggagtggcgcggtacaacaggcaagtggaatccacggttgctgctccaacgattacgagttgggctaatcctgcttgtattcgtttgcgacgagcatcatattcggctaaagcatgtggaccatcgccgtgaagattgcgctgtccgaatccgaatgttttcatataggtggcgataaggtcaatggctgtgatttcgtcaattgtggaaggtctagaaagaaggggaaggcataatgtcaatcgtgttgctgtttcctgtgttgtgttaaataatgaattattcattttcgtgtacccactccagcatatggtcgttgaccagcatatgacacagccctttcttttccgctgccttaatcattgatgggaattgggctataactgaaccggatagggggaaaccggctgcctgagatagcgttgctcgcatgcgtaacagtccatcggcgtaatcagatgcgcaggtatcgcatattccgtcataaagatcaaccttcagtgcatcaaattcttgctctccgttttctataacatcccgtagattcctgcgcattccttccgcatcgtaaaaatattcacgttgcttggcgtattcaggacgacatgtctgaggaagatcgtcggaacagttgattggcttgtgcaagtgatcggcataggcggcttgcatctgcgtgaggtatgtcttttcaagatgatcatctggtttatccggtggaattggataagccttccaggggaccgaagagcgcccaaggtgcaatttgccgttgttgatgcgaccagacgccagaggtaagttttcgaaaatatcgaatttcggctgaaagcttatgccgtcgatgagaatgtcacgtccaccggcattcgcctggagtattgacagaagccattttcctgtggcagaaggaagctcactgatatccgtaactctaatatttgccttgataagctccttttgaaaatcggcaagggcatcaatgctgatatcgcagcaaagacgttctactttcgagatatctaggcgctgataaaactcggcggctttccaggcaggaatcttcttgcgaccgttataaaaacgagtcagatcagtatcgttgattccagaccagaccccggtggtaatagtggtctttccgggtttgcggtttcgatgatgttggggaagtggatttcttagaccgtcatcctctaacacagcatcgaagaaatccttcataaatccctttttgtggtggtctacgccagatatataagggtttacgagctgacagaagactcccagagcataggtagcagtagtttcggccaagtgagtctccttctcgtctccatttgtcttcatccgtcgccttcccatgaggtcactgttcctacgatggaagccagattcagacgaataagccggtaaaacactggaatatcgccagtatacgccgcttacagctggatcagagaagcgcaactttcgtctattgaaaggatttgagaccagacacatcgtaatttcttcttcaactcgatgtcatgcgataaccggttatagaagtagggcattgggctgttcatccgttgtgccgcagtgaagctgactggggcttttaactaatcacatgcatgagatctgcctgcttattcatggtgacgcgtcggttttctcctgaactgacgcgtcatgcttatccagcaggttggatgctcatgtggtggcctatgcaagcaggtctcgaagacccaataactgggtgggatcgagactggaatgagaatttcattgaaacatgaggcaatgcgcgccggtaatgtgtccgtaactgatatatacaactgttcggaagtggaattacggacgatggttgaacgcgatagatgtttgcgcgcaatccgtatgggttgttcgccacgtgatattgcactacgtacccctcaaacgatacttcaggaattgtggaatgcggaggaacgttccgctcacgcttattatcgatcggaccgtgtcagcggagttatttgctcctatgaggatttggttggtgcagggcgggaaccccaggggtgttctgcttcttctgaggatattctcttatgcgcggaggatgcgagagaaagagctaactgtttgcaagctatctttgcggagatcgaaaaactgccagcaggtcagcgcaatatcgtcaggggtgtactggtaaagggggcatctcaatcagatatggcacgagagctgggcgtgtcccgagctgcggtgtccaaacagctttcaacggctgtgcgcaaaattcgtgccgctattcgcgacgaaagcaaagaaacgaagaacacgacaacatcatcagtttgtgaaagaaaggagcattaatggttcatttcagtgttatcagagtgaaaggaagcccgtcatatgacttcgatgcatgcggagacattttggctatggccaaagctgtaggtgtcatgacggaaaacatgcgcactgatcgctgcgacaatacacagtgtgatggaagtcgttgtaagggaaacactatgtttcggttggagttagacaccgaaaatcgcagagttcatcgcagacgccatgccagatgaaacgcccgaggttaacacctcgtggcgaaacggcagtgcaggtgagggcagatattgggtctgccttcagcaacaggtcccgaaggaggacatcatgactgatcagatggtgctgcagacgcagcagtggctgaacaagacatacgggaatgatccccgattcaagaaaatcaacccggacggcagaactggttggccgacaatctatgcgcttactcgcgcattgcagattgaattgggcatccagtccactgccgataacttcggtccttccacccagcggttattcaagcagcggtatccgaatggggtgcggcagcaggcagttgcggacaagagcacttccaacgtgtattccatcattcagggggcgctgtggtgcaagggctactccactggtggcaacatctcacagcatttctacgacggaacaggttccgcgatcaggaagcttaaggctgatatgggcatagagggagattccagcgtagacgttgagatcatgggggcgttgctctcgatgaagcagttcgtgctgctggcctcttatggcggtatcgactccgtccgtagggcacagcagttcatcaacaaagcatatcgtccatacacgggcatcattccgactgatggactgtacggcagggagatgaacacggctcttatccaggtgcttcagtcgcttgaaggtttttcacccagtgaggcaacggggaatttcggcaacggaactagatctcgtttgaaaacgataacagcaaataacgcatcctctaatgagtcgtgggtctggctcgccagcacggctttggcgtgtaatgggatcgggggcgggccgaccttcgtatggacgagcacgttcgccaatatcgtgaaagcgttccaggagcgttatgccattgctgtgacgggctctattgattcgaccacgtggatgagcctgttgacatctaaaggtgatcctgaccgtccgtgtgtggcctgtgacactaggttcgaaattaccgacgccaggttggcgacgttgaaggcagacgggtatgaaatcgtgggacgttatctgacggagcctggccagtcgtcgttggcgcccaaggattactttaaggccatccgtccgggtgagctcgagcgcatcactcggggcggcatgcggttcttcccgatcttccaggagtactccacgaagctggagcatttcaccccggcaaacggcgctgctcatgccaagaccgctcgtgaggcggcgcagcgtcttggcatccctcccacccatatctacttcgctgtagacttcgatgcgaccgatgaccaggtgaccagcaatatcctgccatacttccgtgcggtttgttcgtctcttggtggtggatacggagtagggatttacgcgtcccgcaatatttgttcccgcgtcatcggtgcgggatgcgcgagtaacgcgtttgtgtccgacatgtcgacgggattctcgggcaatctcggcttccccatcccggacggttgggtctatgaccagttcaccgagattgacgattacaagggccagggctgggatctggaccgtgttgcctattccgggaaggtatcagcatgcgcttcactgttgcctgccgtgccagtgcctgcgcctgatcccgatcccgtctcgccagaaacggatccgctgctaagatgggtcgccgtcacggagcaggagtgtcgcaaagcccttgccgctctgggtacccaggtagcggtttacgaggacagcatcggtcaattcatcctggaatggctccgcaaacctgaatactggtcggaaggcggtagcgggacacaagcaatgtggcacgcatatactcctgaagtttcgactccgcccgacttggacgcggcgcgtgtggtatgtgccaatgtatgcgaagcacagccttcaattaaagagaaactgccatcgactcgagatgttgcacacatggctgcaactgctctcggatacctgacatggggtatcgaaaacaatccagccaaatatggtctaggcgatttaggtggctggcctctcgacttgttgcagatctggggtgcctatcgccgtgacggcaagcatgccgacttggcagcatggctctataagcaccttgggaaagatgaaggattcgggtacgatgacgttcttgcggatgcagatgcatggctaattgcttctagtatgaggaaacgatccggttcgacggttctttctgctgctatgcgtgaaacgtttaagcagagtgagacccatcgtatcgttcgattctacgacgaacgttttgcatcaagcgcagataatgtggtgagtgcatattcaacaatggcggacggtcttgatgcacttggtttgacaaatattggaatgagcgaaagcatcctaaaaaaggctgccggtacagacaagcttcctgataagcaggaagctgaagtgagtgctcgggcgttcgctgcattcattgatcagccaagacggtagctcgcataatgcattatgtgtgggcagatgtgtcgtctgcccacacattcgctgttgtgctttcgatttggaattcctctgccagatacggggaaacttctaaaaggccgctatgccgaggaagagtcctgtaataccggtggccatcaatacgatgatggtgatgattccggcgaagatgcgtacaggaagggtttcttttccatggtttgatgggctgtccgcaactaatctcattactccagctgtaacccagcaaactgcgcccaggactagtgccaggaattctcgacaccattccgtttcaagtgcgggaatgccgacgattgatgacgggtcgcttgccagtcttggcggaatagcgcataggatacgctccaatatcaggtaaggggtatcaaaatggatcagagtcaaagcgaatgggagctgtagcgccagtcctatccaccacagcgtgcgtcggatggtcgcgagtctgtcgcccggcctagtgtccggcttgccgccttcgccctccgtcccggcaccgtccgcgggcgtgtggtccccctcgtgcgcgtccgtcgtcccgtccgtgtccctttccgcgtccatatgtccccctccgatcatccgagtctgtcgctcggcccgcgcgcccgttccgtgcgcgccgtcgccggccagtctagggccgtgcgacgcgaacggggaggcccgcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgcgccgtcgccggccagtctagggccgtgcgacgcgaacggggaggcccgcgccgtcaatcggcacggaacctccccgttcatcaagcggtcggacagccgcggatcagcccgtgttccgcaggccggcggcgacacccgagcaggagtgtcacaaagcccctgccgctctgggtacccaggtggcggtttatgaggacagcatcggtcaactcatcctgcaatggctccgcaaacctacgtactggtcggaaggtagttccggcacgcaggcactatggcatgcatacacaccggagccggttactcccagcgaattggccttgtcgcgtcaggcatgcggtgtcgcatgtgatgcacagcctgtcatcaaaggcacgctgcccaatcgggacatcgcccatatggctgccacatccttgggatacttgacatggggcgttacgaacgatccaatggactatggtctcggtgatctgggcggatgggctctggatttgctgcagatttggggaagctacctggcgaataccccgaaagaggacctggcgtcatggctgcacgctcatctcggcgagcaagacgctcgtatgggattcagttacagcgatgttctcgcggactgtgatgcatggttgctggcgcggtccatgcagagcaattcttccgaaaggtctttgtccaccgctatgcgggacatgttcgcgcaaagcgagacgaatcgaattaaacggttctatcagtcccggttcaagggaagtgcggacaacctggtcatcgcatttcgaaagcttgttgatggaatcgatcttggaatattcgataacgtatccggaagtaaaaaagcactgctcattgcgtcacatgcagaccgactcccgagtcaagcggaggctggtatattggcattatcctatgctgaatctcttgaaaatccgaaccgttaatcaatcatgattgtgatcgcattgcgtggaatgattcagccattccacgcaatgcgcctctggtaaaacgtcatagagtcattagagcggaaagtagcgttatcacaagaacgggaaagaccatgaccagcacgagaaacgatatgattcccacaaggacatgcgaggcggaagaggaatgatcacgaagttccggatatacagatcgcatatatgaacgcacgccaaagatgacaagcgccgcaatccagcagactacccccataatcaatactaaggtaagtctacgtacatactcagttgccgtagttaaattcatgcacgaagaggaagagaacgttaagactctgcagattatagtatcatcatcgccattggcgccccattccgcccacaaaataagtgctggtgaaagcagcagtaatcccagccaccatagcacgcgtctggccttgcccaaagccacatagcatctactcgccttaaggaatttggtagctgctttcggtgccaaagcatatttcttgccggaaaaattttctgacgtatcttccaggccatgttttttcccaatgtcatcgatcatagccggattcgctttgcaaatgtggcgttcgtttccggcatcgccctccgccttgatgccgtccgttggcccggtgctcccgcgctcattcgatggcttgtccatgtcccctccgatcatccgagtctgtcactcggccagcgcgcccgttctatgcgcgccgtcgccggccagtctagggccgtgcgacgcgaacggggaggcccgcgccgtttatcggcacggaacctccccgctcgcttttcccgatcggtcggccgggaatcagcccgtgttctgcaggcccgcggcgacgccggagacggtgcacaggatgaggtagatgaatccggcctgttggctttgcgagagctcttccttgtccaccttcttgcgcagcgacttgagcgccagcacctgagtgacggacagcgcgtccacgtatggggagcggatgcggatggcctggccgagcacgtgacggtgctgcagcggccacttgtcgcccacgatggccagaacccacttgcgggtgagctccatctcgttgagtaccttctcattgaggtcctcgcggtcgccgagggcaaggtacatcctggcgatgcgctcatccgtcttggcgatggacatctcgatgttgtcgatgaaggtggagaacagcggccattcctcgtaagcctgacgcatggtctccagatcgccgaacttctcgcatgcggtgccgagaccgtaccaggcggccaggttgatgcgggcctgagcccaggagaagatccacggaatcgtgcgcaggtcgtcgagcgacttggcgccgaggccacgcttggccgggcgggagccgatcggcagcaggccgatttcggtcagcggcgtaacgatcgagaaccacggggcaaagccgtcggtgttcaacaggtcgaggaagcggttgtgcgcggcctcgtcgagctgagcggccatgtcggcatacttctcggtcatctcggtgttgcgcttctccacgctcggcgcggactgcagcaaggtcgccgcagccacggactcgacgtggcggatggccagcaccgggttgccgtaacgggcgaagatgacctcgccctgctcggtgagcttgaagcggcacttgacggaaccgaccggctgggcgagcaccgcgcggttggcggggccgccgccacgaccgacggcaccgccgcggccatggaacagggtcaggtcgatgtcgtgcgactcagcccacttggcgatgcgctcctgagcggagtgcagggccagcgtggcggaggtcgggccggcgtccttcgaggagtcggagtaaccgagcatgacctcgagcttgttgccggtggccttcagacgagcctgaacctcggggatcttgatcatttcctcgagcacgtccaccgagttctgcagatcctcaagctgctcgaacagcggaatcacgtcgatggtgggcacgtcctccgggtgggagaaggccaagcggttgagctcgtagacatccttgatgttctgggcactcttggtgaaggagatgatgtagcggcgggcggccttgaggccgttgcgcttctggatggcaccgagggcgcggaaggtgtcgagcacctcgtgcgtcatcggctgcagttcgccgcgctcgccgtgcaggccgtgctcgcggatatccgcaagggcgcgggcgtgcaccacggagtgctgacggaactccatctccaccatgtggaagccgaaggtctcggtctgccagatcagatcctgcagcgggccgtaagcggaacgcttggcaccggcggcggccagcgaacgctggaccaccttgaggtcggcgaggaagtcgtcgcaggagtggtacatgaggtcggcgtcgcgctcgatggtgtagtgcagacgatcggccatcaccagcatgaccgcgcggtgcatctccttggtggagatcagggcggccttgtcggtcagacgctcgctcatttccttctggtggctccagaggctcttgagctcggcgctcggcggcgtggtctcggcttccatcgtgaggttgcggcccacggtgcgggtggcttcctcaagggcggcgatcacgtgatcggagaacttgcgggccacggcgcggctcaccttggcggtgacgttcgggttaccgtcgcggtcggaaccgatccagctgcccgggtggaagaacgcggggcaagcgggctcgacgagaccggccttatcgcccaggacccagtcgtcgaagcgacggtaaaccttggggatggtgttgaacagcgtgttgtcgaagatgtcgagaatcgtgtccgcttcctcaaccggggtcggcttcttcagcgcgatcggagaagtgcggaacagggcgtcgatctcgttgtagagacggcgcaggcattccttcttatccgagccgccgaggcgcttgtactcctcaagcaattcggaaacgcggcgaatcttgccttccacggccttacgacgggcctcagtggggtgcgccgtgaagacggggtggaattcgagctggttgagcagttccttggccttggccgggccagtctcattgatgagctggtggtaagcgacggtgagctcgttgatcgggtcgaccgcctggtcaacgggcacgttgttctcgcgctcgtggagcacggaaacgcggtagttctcctcggacaggtttgccagatggaaatacgtggcgaacgcgcgggccagcagctgggcgtcgtgcaacgtcatgttgtcgatgacgttcacggcctccttcaggccatcctggtcggggttcggatccttcagctcggcgaaatgctcggcgctggcctccaccgcgtaatgacgcacggtgtcgaacgtagacagcagttcggggttgtattcgcccagtacgttacgcaggatctcaagacacagatccatgtcgtacttcaggctttcgggaagatcatgctcctccgggccctttcggccggtcccggtagtgacgatggcggcgtcagcgggagtgatctgttcttcaggtgttgccatataacctcctttgccgaataacaggttgctcggtctactggtcgtctgcggctcctccgcagttgttgagaccagtcgttgcgagcccacagcccatattcaacgtggttgttgtgtgggcaatagtgtatccccgcgaaatcgctttttacgttacgaagtccatatagtgcgccaagttgtccacctatagagaccgaatatcggacagcatatgagacactgtccgattcgcggaagatttgagcgccttacgattgctggcggggaaggcagggagtagtaatgaaggatgtgagcgaacagaagaaaaaaagtgcgcccgaagcgaaaggcgcaacggctgtacgtaaattccacacccactccattccgctggacatggaagatattgcacgcgattgggaaaaaccggtggtggacgccggtatcgccgccaaagccagcgtgattgtacgagtcggcatgttggacctgggagccggcaccggctccttccgcgtgcgtgaaatgatgcaccgcatcgcctacccgctgggcgtgcacgtacgcgccgacgtgaacctgacggatatcgaggccacctgcacggatggtcgtaaccgcatcaccgaagtcgtggatttgccgagtaccggcgtgaacaccgaacgtatctggctgctggaacatttcgccgactggttctccgtgaatctcggcaaggggtcgatgtatcacgtcgattcgcaactgtccgatggcgtggtcaagcatttggacgaacgtgacgcttcgcagtattcggccgatctggccaagcgcctgcgcgaacgtgccaaggtcgaggctgaggcggccaacggcagcgtggacgaggcgctggatcttgcgtcgaaaaccaaggtactcgtgacctccgtggccaagtccttggacgatgacaatgaagaagcccaccgacttttggcggacagcgcggaagtcactccggtcgaagacaaagcggccgaagagaaggcctacgacgatgccgaagtgtttaccggtgactccaatgagtcggttgaatcggcgaacgcggcgaacggcgcaaccgccgaaagccctgctgcaagcagtacgaagcgtaagaatcgcgtgcccaaggaatacgccgaacacttcaacgagcgctccgacgaagagaaggccaagggcggtatcaccgtgcggcaggcgcacgagcgactcgatctgattgagcgccgcaagccgctgtacaagccgtggttctccggtctggcctccgccctagcctgcgcggccttcgtgttcctgctcggcggcggcccatacgacatgatcggtgcgttcgtgggcgcgggccttggccagtggatgcgtcgccggctgtttgcataccatctgaaccagttcttcgtcacctttgtgtgtgtggccgcggcggcgctcgcctgcaccggcaccctgcgactcatcggcattttcgacccagtcgcgctctcgcacgatacggcctacatcggcgccatgctgttcgtgatccccggtttcccgctcatcacaggcggactcgacatggcgaaaatcgacttcccctcgggcatccagcgcgtggcgtacgtgctgtgcatcatcctgatggccacgctggcaggctgggccgtggccgtgatggtgcacctgcacccggaaggctttgaaccgctggggcttgacccgtgggtcaacggattgctgcgattcgtggcggcgttcgtcggcgtgtggggcttctccgtgctgttcaattcgccgcagcgcatgtgcctgaccgccgccctgatcggtgcgatcacggacacgctgcgcttggaattgcaagacttcaacgtggcacccgagatggctaccttcatcggcgcgttcctggcgggcattctggcatcggcgtggcgttcatccgtgcgacgtggctggctaccgccgcacctcggctacccgcgcatctgcctgaccgtgccgtcgatcgtgatcatggtgcccggtctgtatatgtaccgtgccatgtggtacctcggcagcttccagaccatgaatgcgctggactgggcgttccgtgcgttcatggtgattatctgtctgccgatcggcttggcgatggcccgcgtggtgaccgacaagtcctggcgctacgacatctgaccgtcatcttggctcccctcaggtgaggggagctcggataaaacagcgtctcagtatggaaacggtggaaggtgcttgagcccttgtatccactaccatcaggcgaagtgcgttgcggccgtattcacggctgtgacggtctgtatgacgccgctccggcgtcaatcgcatatcagcacatagttctgccatggcggtagccgcttggcgtcatgattgaggaggggcgcagttggccaacgatttctggattctgctggccatggtcatctattttgcggccatgctgtccatcggattcatctactccaaacgctccaactcctcctccaaggaatactttgcgggcgggcgcggcgtggggccgtggctcacggccctgagcgccgaagcctccgacatgagcggctggctgctgatgggcctgccgggcctggcctacttcaccggcgcggccgacccgatgtggaccgccatcggcctggcgctcggcacctatctcaactggaagcttgtggcccggcgactgcgccgctactcggtagtgaccgacgatgccatcaccattcctgacttcttcgccaagcgtttccatgacaagaagggcgtgatctccaccatcgcggccgtgatcatcctggtgttcttcagcgtgtacgtgggcagctgcttcgtgaccgtgggcaagctgttcgccacgttgttcggtttcgactaccacgtcatgatgatcatcggcgcggtggtcgtgttcgtctacaccgtggtgggcggctacttgtcggtggtgatgaccgacttcattcaaggcatgctcatgttcttcgcgctcgcggtggtgttcatcggcaccgtggccagcgcgggcggtgtcgacaacaccgtggaattcctgcgtgccatccccggctacctgtccggcacgcaggtggccgcgcccaagctggacccggccaccggccagcagctcgtcgaggcgggcaaggccgtgttcggcgcgccctccgactacggcatcatcaccatcatctccatgctggcgtggggcctgggttacttcggtatgccgcaggtgctggtgcgcttcctgtccatccgcagcgtggaagaagtgcgcaagtcccgaatcatcgccacctcctggtgcgtgatttcgctgggttgcgcagtgtgcatcggcttggtggggcgtgcgatgatgcccaccgaactgctgacctccaccgatgcggaaaccatcttcatcgtgctggcgcagaccctgctgccgagcttcatgtgcggcgtggtggtctccggcattttcgcggcctcgatgagctccagctcctcgtatctgatcatcggcgcttcggccatgggcgagaacatcttccgcgggctgctgcaccgcaaggccaccgacaagcaggtcatgattgtggccagggtcacgctggtggtcatgttcctgttcggcattctggtggcatacgaccagaactcgtcgatcttccaggtggtgtcttacgcgtgggccgggcttggtgcctcattcggcccgttgatgctgtgctcgctatactggcgtcgcgccaacaaggccggcgccgtggccggcatgctgtccggcacggcggccgtgctgatctggcacaacctcgtcaagcccttgggcggcgtattcgccatctatgagctgctgccggcgttcatcatttcgctgctgttcatcgtggtggtttcgttgctgaccgccaagccgaacaagcgcatgctctacgaattcgaccactacatggacgatccgctgcccggcaccctgccgtccggcaccgtgctcgtcgacgagcccatggaagccatggagtccgaggtccgcagcggcaaatgacacgtgcctgctgtgcggtcggctcgtatggcagaggagtggcttttttgtggttcggcaggaaccattgaggccaaaacggacttcgaggggctgatttgacgttctggagagatctacttccgtttcaaggggctgatgcctgagtagacgcggctccaaaacggcggaatggcgttgacgtaagggcattgatacacgtggtctaccggatgatcagccccttgaaacggaagtagacctccggcggaggccaaatcagccccttgaaatgggttttgaataccgtagcgcggtgcggacggtgcggactgactctaccgggcttattattcctgcgtcgtcggaataattggcagcagaggctcgaatttcagccgtttgtacagtggaatacggcgtagctttcggacatcgctaatttgctgggtagtttgccgcatcgtgagctggaccgttttgcccgtaacctcctgtatcctttcggcaactcttcgggcaagggcctcttctcccgcttcgtcgccaatatctaatttggtgacttgaatgtacttccagccagcatcttcgatcatctggcggcgtctcgcgtcattcagccattgcccggcatgatgagagccttcgtattcgatacatatcttgaattcagggtatgcaagatcgagatatatgggtctggtgttgtttcctacgaatattggataattcacctgcgggcaattcagaccgtatttcaagagaaccaaacgagttcgtgtttccatggaggaatctgtgcccgcgcgcgccaaaagtagggcgcgacggcatttgttatacccgcggaacaaatacgaattggtgccattctctttgtcggctcgcacctgggcctcggcctcatcgagatacagagaaagggcgtcgatggttgttctgcagagccttcgatctcgtcgcatcatggaatcagcgagaacgatgagttcttcaagttcgagatacgtggagaacatggcccatgtgcaagctggtgaagtgcatgtgaattgtccctcgattatgaccgtgtctagtggaaaaggccatacaaccactttgacccccacaatgtgccgtttgtcattggcgtgtggaaccgcaacaatggttgtagttgcaaggcctctgtgtttgcttgatatgcggggtacttcaattgacaaaagctccaacgctgttgtcagggcatagggtgggcgccatgcgcttcgtcgttgaacatctgcgcacgtctgcattcgttggtacttctgcattgtcagctcggtcaatgccgttgagctacccatgatgatcaccccttcgtgatgttcgctttgtcctcgcagtgtagagtccggctaccggccctgtctaccgccccaatttttcggtggataaatgtggataagtcggtggataaactatgggtgttcatcgcagttgcaggccatcccgcaattacatggaacgtaggggtttgcaggcagccagcgggaatcgccgtcgacggcgcgattcaacttggacgaatctccatggcgttcatgcaaaggtggcatgatggccggtatgagtagcttggtgcgtattgtcaatgccggtgttccggggtctcaggaccgcgtggatgtggtgcttcgcgatggggttgttgcgtctgtcggccctgctggaacggtctcggcttcggacagcacgatgcagactaaggcgcatacgacatcgttggaatacgcggcgaatgccattgcttctggcagcgtctcaatcccaacgtcggccgccgcacccgccgacgaaaccaccatcgacgccgacggcctgtgggttattcccggcctgtgggactgccacacgcacttcacgcaatgggctaagacgctgggccgactggacctcatcaatgcccgttccgccgccgaagcgatggacatgttgcgccgtcatctggatgagcgccgcgccgccgacacgcttgacccagatgccttcgtggtgggcatgcgattccgtcactcgctgtgggccgacgacgagcagcccacactggccgcaattgacgccgtgaccggcgaacagccggtggccctctccagcgcggacatgcactgcggatgggtgaattccgccgcggcccgcaggcttggcgtacatgtggacgaatccggtctggtcggtgaactcgaatggttcaacgcctacaccgccttcgacaaggcgccgggcgctgctgaagagactgaccgtctgctgcgcgaggccgaacaggacgccgcaagcaagggcgtggtgggcatccgcgattatgaaatggccgaaaacatcgatacatggatcaatcgtttcgcggccggcattaacggtttgcgcgtggacgccggtgtataccccgagcggttgcgagccgccattgacgcgggttggcataccggcaaggaattgccgggcagcgccgggcttggccatgtgggcgccatgaagctcatctcggacggatcgctcaacacccgctccgcctactgctccacgccgtattcgggcatcgagccgctgacgtatggcacgctgagctacacgccgcagcaaatcgaagactatatgcgcctagccaccgagcatggcttcgacattgcctgccacgccattggcgacgaagcgaacaccattgcgctcaacgcagtcgccgccacgcacgcacatggatcgatcgagcatgcgcagatgctcaaacccgtcgatatcccgcgtttcgccgagctggggctcacggccagcatccagccgcagcacgccatggatgaccgcgacgtcatcacccgtttctgggccaacccggccggcatcccttatccgttcagggccctccacgacgccggtaccacgctgcgcatgggctcggatgcgcccgtggccccgctggacccgtggctggccatttccgccgccgtgctcggcaccgaaagctctgaccgcgagccgttccagcccgagcagtgcctcgatgtgcatacctcgctggcagcctcgaccgccactggccgtgaccgccttgcatccggcgacccggccgatatggtgttgttggacgccgacccatacgccgccgatactccggaagccatgcgcgctatgccgcaacacgtcgtaatgacattgctgtgcggggagcgtacgtattgatgcaagccatcggcatgaagtgaccagaggtccgtcttgatagccgcgttgcacggaaaaacaagaaatccgcccctcgaagtgaagataggacacagcagacgccgcaatacaaaaacgccgtgtcagttgcccagttggggctgacacggcgtcttgctacgagcggcgggaaaatcagtacttcatgcccatggcctcgcgcacctggtcgagggtctcctcggcgatggcgttggcgcgcttgttgccgtcgtgcaggatgtcacgaatggaatccatgtccttggccagctcggcgcggcgctcgcggtgcggggccaggaactcgttgactgattcgatgacgtatgccttgagcgcgccggcgccggaatcaccgatctcctcggcgatgtccttcgggtcgcggccggtcaccaggccggcggtggtcagcagggcggagacctgcgggcgggcaaccgggtcgaaggtgatgcggcgctcggaatcggtcgggctcttcttgatgagcttggcggtttcctcggcggtggcgcccagcatgatggagttgccgtacgacttgctcatcttgcggccgtcgagacccggaatctccggtgcctcagacagaatggcggccggctccgggaacaccgggttcttcttggcgtaacgctcgttgaaacggcgggcgatggtgcgcgtgatttccacgtgcggcaggttgtccttgccgatcggcacgacattggccttgcagaagaggatgtcgcacgcctgatgcaccgggtaggtgagcagcagaccggtcagcgcgtggccggacgcctccatctcggacttcacggtcgggttgcggtgcagctcggcctcggtgaccaaggacaggaacggcagcagtagctggttctcggccggcacggcggagtgggtgaacatcatggtcttgttcggatcgatgccggcggccatgtagtcgagcaccaggttcagcacgttgtcttggatgtgctcggtggtgtcgcggtcggtgatcacctggtagtcggcgatgatgatgttcgtgttgacgccgcgctcctgcatggcgacacgctcacggatcgagccgaagtagtggccgaggtgcagccggccggtcgggcggtcgccggtcaacatggtgaaggacgacggcttggcctccagcttggcgagcgtttcgtccgaacgctttttggccgcgaggaagctcgcgctcatctcattgcctgccgctgtcagttgctgctcgtcggtcatgcgaaaatcctttgaatatgccctaaataaacgctttttatggtaaaagtgtgagccgacaacgaacaagccactattagtggtactctctattgttgatgaatcgaacagcacagtaatcgcagggggtcagatgggccgcggacgtcaaaaagcaaaacagcagaaaattgcccgaaagctcaagtacctgaccaccgataccgactacgatgagctggcaaaagagctgagcgagcaggagccgggaatgggctctcctgacccgttcgccgacatcgatgaccagtatgcggacaaggatgtggattccgctgctgatgaccacgcttccggtgccgccgaggcagctcccgctacgcaggaggatgacctcgacgagtacgccaagtgggctgccgaagccgccgcaaaggcgaccagcggcgagttcccggcctccgcgcctgccgcaccgaagccggccccgcgcaagccgattccgatgcccatgccttccgcgctcaagcccaagaagagctgaacgccggtcttctcgtaataatccccttgtgcttggttgagcacaaggggatttgtggttatggctgatggtgccgccgctggtggcttacttacgcttcgcgcctcacagcggcagcaggtcgctcaggtcgtcgcgctcgccgaccgcgctgatgtggccggcgtccttttcctctgcccatgtggtgatgccgcaggccagccgcagccagacttccgggtccagctcgatgacgtccggcggggtcaggttatgcgggtccgattccgggccgtccaagattttgaccgccccccacggcgcgacacgcacctccacgccagggccgggtgcgcgccgctccagcagaaacagcgagtagcgcacggccatcgcccacaccgggcgtggcaagacaggggagacggtcagacgatgtggtgtgttgtccgccagctcccgggccgcggcacgccattgcaccagcgcgtcatgcccgcgtttcaggtctttttcaagaattactgccatgtatcccatcatggcaccggagccggaagatcttccataatgcaaacgatggcatacggtgtgatgcggaatatcggggcatgtgctacgctctaaatgagaacgtatgcaagaacgctccgccatcgtcgttacggagagttcatgcttacgtttgtgcgacgatacctatcgcgcggcataataaacacgggcacttatcccggaaggaaagtcagaatgaccgaaatcaccgcaccgaagtctcctgtcacggcggaacaattcgccgacgagattcgtgaacaactgaaatacactcagaacgtcaccaccgagcaggctacccctgctgacgtgtatgtcgccgcatccaaggccgtgcgcaaccaccttgccgactcctggttcaagacccaggccgacaccgtgaacggcaacaccaaggccgtcggctacctgtccgcagaattcctgatgggtaagcagctgcgcaacgcgctgctcaacgccggtctgaccgagcagttcgacaaggccgtggaagccctcggcttcaaggtccaggacgtcgtcgacgccgaatacgagccgggcctcggcaacggcggcctcggccgtctggccgcctgcttcatcgactccctcgcctcgctgggcgtgccggccttcggctacggcatccagtacaagtacggcatcttcaagcaggagttcgacaaggacggcaagcaggtcgaaaccccggactactggctggccaacgaagagccgtggggccacatcgactacaaccgcgaccagaaggtttccttcggcggcaaggtcgtcgagaacgccgacggcaccaagacctggcagcccgcatggtccgtgcgcgccgtgccggtggactacctggtccccggctacaagtccggccgcgtgaacaccctgcgcctgtggagcgccaagagctacgacgagttcgatctgctcgccttcaaccgctccgagtacatggaagccgtgaccccgcaggtcaaggccgagaacatctccaagattctctacccggaagactccaccaaggtcggcaaggaactgcgccttgagcagcagtacttcttcgtctccgcctccctgcacgacgccatccgcgtcttctacccgggccaggacaagccggatctgacgactttcccgaacaagatcgtcttccagctcaacgacacccacccggtgatcggcatccccgagctcatgcgcatcctcatcgatgagtacggctacgactgggataccgcgtggtccatcaccaccaagaccttcaactacacctgccacaccctgctgccggaggcccttgaggtctggccggccagcctgatcggcgagctgctgccgcgtcaccttgagatcatcgagaagatcaacgcgcagttcgaggacgagctcaagtccaagggcgtcgacaagaacaccatcaaggacatggccatctacactggcgacgccgtgcgcatggcctacttggccacctacggcggctcccacgtcaacggcgtggccgagctgcactcccagctcctgaaggacgtcaccctcaagaacttctccgacgtctacccggacaagttcaccaacgtgaccaacggcgtgactccgcgtcgcttcgtcaagctcgccaacccgcgcctgtccgacctcatcaccgagggcctcggcaccgacaagtggctctccgacctggagatgctcaagggcctcgagccgctggccaaggacgatgaattcgtcaagaagttcgccgccgtcaagaaggccaacaaggtcgacttcgccgcctacgccaagcgcgagtacggcttcgagctcgacccgaacaccatgttcaacaccatggttaagcgcctgcacgagtacaagcgccagtccctgaagatcctgtccgtcatctccacctacgccgacatcaagtccggcaaggtcaaggccgaggacgtcaccccgcgcaccgtgttcttcggtgccaaggccgccccgggctactacctggccaagatgaccatccagctcatcaacaacgtctcccgcgtggtcaacaacgatccggacgtcaagggcaagctggccgtgtacttcccgtggaactacaatgtgcgcctcgcccagcacctgattcccgccaccgacctcgacgagcagatctcgcaggccggcaaggaggcctcgggtaccggcaacatgaagttcgccctcaacggcgcgatgaccgtcggtacgctcgatggcgcgaacgtcgagatccgtgagcgcgtcggcgccgagaacttcttcctgttcggcatgaccgtcgacgaggtcgagaagaagtacgccgagggctacaatcccgcctcctactacgaggccgacccgcgcctgaagcacgccatcgatatggtggccgacggcaccttctccaacggcgaccgcaacgcctactccccgctcgtggccgactggctgaccaaggactggttcatgaccttggccgacttctccgcctacatggacatccagtccgagatcgaggccctctacgctgatgagctcgaatggaaccgcaaggccctgctcaacgtggccaactccggctacttcagctccgaccgctccatggaagactatttggaacgtatctggcacactgctcctctggcctgacggccgccggagcggcgcgccagctacgtgctggtttctacctcgcggctgtcgccgctcggcgtcgcctacgggaagcccaccgggcttcccgcttaacggctccgcgtatctggcacactgctcctctggcctgacggccgccggagcataagaagccccgcaaccgacatccatcggttgcggggcttcttgcgttgaaagaccgccctatcaggcttcggccggggcggctttcgcctcgtcatcggcctcatcctcggccttattcagacctaggtcgaccggcgaggagctgttctcccacggctcctcccacggatcgtaatccgggttctgctgcttgtagatgtacaggccaacaagcgcggcgagcaatccgccgaacagcagcgcgaagaacttccaaccgttagaagacttgttctccatgacggctcctttccctagggatcgtctggtcggtatgcccattcagaccgactctgctccctattctaggccgctgtttgtgacgattgggtggaacccgatgtctatttagaagtgcaacacccttgttggtcctgtaattctaacagttctaaacccgaaaaaaatacatgactaaacacgaaacaccgacttgacgaaatacagcaacgcggaccgtcctccggtcacccgcgacgagccgacgctgggctggtgcgaggagagcctcgacggggagagcgtgaccctggaatcgtgcgtggcgcgcacctggtgggtgacccagtggcccgaccggcccgtgccggcgggctggacgcgcgacatcctgcagggcggcaggatgatcgccctgacccatatctggaggcccatgagcatggagaaaagcgagaaggacctgcgtgaccgcgagtccagcatcctgcagcgcgacacgttgcagaaccagcggaaactgtcgcgcgacgaacgccgtgagcgccgcgagcagcggcagcgagaggcggagcaggacgcgaactggcccgacaccgaccatcaggggtatatcgccctgttcgccccggaccgcgacgcgctggccgtgttcgaacgcgacctgcgcgtgcgcgtcggcaagtaccatctgcgcctgtccggcctgcgcggacagcagcggcaggcgttgaccgcggtcctgccgctggggttgtgaccatgggcgcgcacggccaggaggactggttcgacgaggtcatgcccgggttggacgacgggcggcctggtgggaaacggcgattcccatggcccggccggcatgggaaggacgacggggacgaggccgaggcccgcaccaggccccgtatcggggtgcgtgtgggcgtggcgacggtgatcgtcacgggtctcatggtcggggccggactgacggcgggcatggtctccgcgaaccggcgcgaacggctggccgacgcgtcggcggcgtgcgaacgatccgcccggacatggtccgcgggatcggccgaatggggccgtgaccgcgaccggatcatgggatccgtcgacctcgacgcgctgcgcgccacggaccccgatatggcggacaccctcgaacggctttcctccgaccccgtcacgccggccggctgcacggccggaggcgacacggcaacgctcgacgcggacgcgaaacgcatctccaaggccgccgacatgctcgcgaaacggtcggaacggctggaaaaggccgtggcgaaggccggccagacggtcggcgacgccgaatcgtcacgggccaggagccggctcgaacatgccgtggccgacgcgcggggcctgctggcggggagcacggcggaccagtacaaggtgccgtacctgtaccgtcggctcggacagctcacggaacaggcggcggggctgctcgacgacgggtccgcgtccccggaggacatggaccggctctcccagggcatcgactccatggtcgcctcgctcgcctccggcacgcgatgacgggccgccatacggttatcggcccggcgcacgcgtgtacgggcaaacggatcaggaaacaggaaggaatcggtcatgccgtgtcggtcagagcgttccggactcatcgaacgcgccatagcatgcgtccatcgcgtcgtcccagccgggcaatccggttttcccgaatcgttgtgttggcgtcgtctgggacggcgttacgagctgccgggcccggcctcgtggatcgtggcggcggtggcggtcgtcgtgttcgtggccgtgctgatcgccgcgagggatctccttgtgccggccgtgcttctggttcctttggcttgcgtgatggtccttgtggtccgtctgctggcctccctcgcgcgatcaatgggggcgggccgatgatgcacctcatactcgtgatcgccgtcgtcatcattctcgccgcgtcctatctgctgacgttcgccctgtgccgcgcggccacgcgccgcgacatgctcgaggcccgttggcgtgaggagtcggccggttccgtgggtgaggagagccatgagagcgcatgaaacgcttgagcgtgccgggcgtcatggcggcttcccgccccatgggttcgcttcgggcctgttggcggcctgcccgtcggacggcagccacgacttctacctgtcgatgatgctcgacgttcccgtgccgcgcgtgcccgtgctgcgcgcacgtctgcaagactcccgccgaggggcgcaacgcgcatccgacgcacaggaagctggccgcgtggtgcaagtgcagcgtgggcacggtcaaacgccatttgtcatggctggaagggggacgtgtggtgatggagcagcggttccgtctgcgtgacggctcgccggtcatgccgcgctggcgccgttgacgatataggcgcccttcgtgggtgtcggcgtcggcgatcatgtgctttttccgttcagggaggtttcgtatggctgatgctcctgccggggtccgtgccggcaaggccgggggtccgcatgggttgcgggtcccgtccccggccgatccggggtatgtggagtggtgccggtccggcatgccccagaggatccgtctgctcaagctcgccgccgagaaacgccgccggatcgagcagggggtgatctgtccgaaatgccataggcgccgggtccgtgccggcgacacgttgtgcgcccagtgccgtcacttggaggatctgccccgctgccgggaatgcgggaggcggacgagccgtcccgtggacgggttgtgcgcccgatgcctgaaactggtccgggaacaggccaggccgatgtgcccgaaatgcggcaggtgccggtgcctcgagggcgaggacatgtgcggcaggtgccgggcgcaccgtgtgttgccatcctgttctcgttgcggcgcgccgcggcggaagggctcgccggacgggttgtgcggccgatgccggcagctcctttcggggaaggcgaggacatgaatctggcggacgtggccttggagaccctgtacgtgctgggtgtactgatgtgctgcgcgctcctgtcccgcgaggagggctcgcgcgagggcctgggttcgcgtcgcgcccgcctgttcatgctggcgttggcggtggaggcgatgcaggcggggttgggttcgctcgcgttccgggagccgtggggcgcgccgttcgcgccctggcaggcgttcgacctggcgggcgcggtcctggcggacctgttcctcgcacgggccctgttgcgcggcggcgggaatcccggtccggactaccggtgacgcgtaccgccggtccggcttccccttccgctcccccgatatcggcggattgtcgggtggatggcatgccggccggcgggatcgccggccgtggcataggatgtgttcatgcggaccgttcccctctcccggaaggggtgccggcggttggtccgatgataggaaaggaacgaggatgagcgaagaggacaaggtgccgtccccggacggcgcgggcgtggtgcccgagcctgagacggttcgcaggcgtccgaagtggctggcacccgtggccgtgggttgcgtgctggcgctgctcgccgtgggcggcgtggtcggctgccgtgtgtggtcggcgcgcgaactggccgaggcgagggaggcttgcgccgtggcggcggacggggtgcgtggcgcggcgaacgactacaacgcgctcgtcaacggccaggccgccgacgcctcggcggtcaccgccgaccaggtgaaggacgcgaggaccgtggacgcgctggccaaggcgttgaagaccacggctcccgagtatgaggggtgcgtggccgattccaaggccggtctggacgaggcgacgtcgaagctcgacaggcaggccgcctggtacaggacccatgccgcatcgctcgggaaggccgtcaaggcggtggaatcctcgaggctcgacaggacggtcgaggacgcggagaagctgctcgccgattcgaagggcagggtcgccgacgagaagacccgtagcatgttggagcaggccatcaaggacagggacgcggacgcgatcggcgaggccgtgaacgcggtggacgggtcggtcaaggccaaggcgaaggccgacgccgacgcgaaggccagaagggaggccgaggagaaggcccaggccgaacaggaggcccaggcggcggcccaggcgcaggcgcagcagcaggcccagtcctatggcggcggcaccggctacaccggcggcggctacacgggaggaggctacaccggcggaggcacgtacacgccgcccgcgaccggaggcggcaacggtgggggttccgcctccagcggaccaatcagcggagctcaagggtgcggcaacagctgtaccggcacggatgacggttactatcatcattgattcgtgaataatatgccttgttcgattagttcgaacaaggcattattgtttctgttgaattcgcttataaatattcaacggcttaggagatgggagaggtccttcgcttctgcgaaggacctctcccatctctcttttactccctgtgtttttcctgtgatatcggtgtggttttccggggtgtgcgggtgggggtcgtggagtccggcctgtggggccggttccgtgaggggcgggagaggcccgtcctgttgatcaacacagggaggagacccttatgggttttcgtcatgatagggcgtcggccgggcggagtcatgaaccgctcgcgcgtggcgcgcatggggcggggccggcacgcacggtgcttgccggcctggtggccgtggccacgctggccacgggcggcctggtggcgtcgaccgcgtatgcgggcggcgcgggagacaaccgtccgggcggcgcgaccggcggccttcccgcgggcatgttctggcagtacaaggacgacgcgtccggcagcttcggtccggccgcgaacgcggacggctcgccgcgcatcgagtcggtggaggccgcgtacaagcgtgccggcgtgagtgtggtgaacgacggcgtgtacgacgggccgggggcgatccgcgatacgttgcggggcgcgttgtcgaagtgcgtggccggcttccgtcagcgtcatccgggcgagggcgacggcgactgccgtgtcgtgggcgtgggctcggtcgcgggccagcagggcggcagatgggtgtacaacgggtccggcggctattcggcgtccgaatggcactcgtcctgggactcgcaaatcaaaccgtataagtattactacgcaggtacacaggagtatggtacttccactccgtttgatgatgatccgtcgaacagcgtggacaagatcgcgtattcgaacgcggctgcggccggcgcgacgccgaacctgatcatcatcgtgctggacaagtaccagccgaagccgccggagacgcctccggccccgccgacgaagaaggtggagcagggcacgagcgctgatggcatgtcgaacgagacggtgatctcgacgggcactggcgtgggcggcaagaggatggtcgtccaggatgcgatcgatccgaacggcatggcgtacaaggtcacgggccagaaggtcacggacacgaccaccggccaggacgtgtccgcgaagttcacgttcaacacggcggacgggcagccggccccgaacgatgtggccacggccacgtggaagggcggcgacctgccggaaaggcacacattcgagtaccgtctgaccatcacggtctcgctgccttccacgtcgaaggtcacggacacgccgtccgtcacgtggaacgacaagggcacgggcaaggccgacggccacgggttcccgacctggcggccgaacccggacaagagctggatcctgtaccgtgacggcaagtggcaagccgtggtcgatccgggcgagacgaacaagaccggcgcggacgacatgaagttcctcgacggggacacggtcggcagcgcggtgaacggcaccgtggaccccggtctgaaggaggcgcccgccaagctggagctgaccgacgactgggccgccgccgactatctggtcgacccgcaggacgcgtcgaagatccgcgtgttcgcggccgaggccgagcccgaccgcaccgacacggtcgacggcgccacggtgaagcactacacgcagaccagcgtcgcggacatcgcgaacaagggcaccgacgtgaccgacatgttcgacatcaaggtcgagggcaccgtggcgaccgccaccgcgaaaccggactatttgaagaccctgaagagcatgaggaagggcctgcagctgaccctgctcgtcccgttcaccgtgaacttcgcggacggcaagggcgcggcccgggtgcgcgaggacttcggcaggaagccgggcgacgaggtcacgttctgcacctcgccggacggcaaggagctgaccaacaagggcagccagaccgtgaacgggcagaccgagccgaccaacaagccgaagatctgcggctacgtgcctccggtgaagaaggacgtgatcgcggaatcctcgcagggcggcggccaggagagcgtggacggcaaggtcgtccacccgggccagaaggtcgagtaccagctgaccaccgagccgaagctgcccgccgacctggccaccatggtcacgagcgtggcgttcacggactcctatgacgagaacctcgtgccggacaagcagaccgtcgagatgatggacctgaacaccggcaaggtcgtgccgaagtccaagtacgcgaccaggtgggatgaaggcaggcacctgttccagctgaccgtgaaggaccagtcgctgatcggccagtggcgcgcctcctccagcccgcgcgtccagatccgcttcgagggcaccgtcaaggaggatgcccccgccgaccacaagatcggcaacaagtgggtgctgaccctgaacaacagcctgaccccgtcgaacgaggtgttcaacctgccgcccgtcttcaacccctcgaagaaggacacccagtccaaggagcagggcgacccgaccgtctcgatcgacggcaagacgatgctgctgggcgacaccggccactacacgatcgacctcgacgccacgcagaaggaccaggcctacaaggtatggcgattgggcctgacggatgatttcgatgacgagtacgtgagcatcgacccgtcgaggatcgagatcacgggcgacgacggcaaggactacaccaacgcgttcaacatccaggtgagggacggcgtcgcctacgcgtacgcgaagaccgtggacaccgagatccccgcgaccggcgagaccgtgaagggcgacccgcagccgaccgatctgaaggcctacgccgggaagtccgacaaggaccacgacccgttgaaggacccggccatcgaccagtcgctgctcggccagcactacgcggtcaccctgccctacacggtggtcaaggtcaccgacggctacgtggtgaagaacaccgcggtccagatcgtcaacaacgtgaggaagaagaccaacaccgtctccaacccgttgaagccgatcaacccgaagaaggacgtgaccgtgaaggtcggcggccacagcgtcgacggcaggagcgtctacctggactccacgttcctctaccagctcgacagctcgatcctgcccgcggaccgcgcctaccagaagatcgcgaactggggcatcaccgaccagctcgacccggcgtacgacaaggcgaccggccagtgggccgtgtacgcggcccgcgacctgtaccggggcggcgaggccatcgccaggaagggcgagagaatcgccggcagcggcttcgacagctcgaggctcggcggcgacatgttcaccgcgaacatcgacccctccaccggcctcgtggacatccaggccacccaggcgtacctggacctcgtgtccgcggacgacgcgcacgagcagggctggcgcgcctacgtgcaggtcacgcgcgtgaaggtcaccgaccgccacgagaacgtgttcaccgagcacgtgaacggcaaggacctgaccagcaacatcgtgtggacccgcacccctgacctgaccccgggcatcaagctcgagaagtgggacaggaggagcggctggccgaagggcgaccgcgacgactccaaggacgcgctcgacggcgccaaggacggcacgaccatcgtgttcaccatcaagaacaccagcaaggacgattccggccacggtgcctggttcaaggcgagcgacctgaagcttgaggaccacaccatcgtcggcgacggcaccgtcaccgacctgaagtacccggaaggctgggacagcctgatcctcaagcccggccagagcgtcgaggtgaccggcacgctcaccggattcaccaaggacaggcacaccgaccgcgccaaggtcaccggcaccccgttggtcgaatgccccgtggtggacaaggacccgttcggcgacgcctccggcaagccgtccacaggcggcgaagccggcgacggcgacggtcccaggcaggtgaccgtcggcgatcgcacgctgtgcgaggacacgcccgtcgagtccaacaccgacgactggaacggccgccggtcgctgctgggcgagaccggttccgcgatcctgcccgtcggcgtgggcgcgctgctcatggccggcatcggcgccgccgtcgtgatggtccgccgccgcaagtcggcgcatgacgacacggacgcggccctcatgccgcgccacgccgcctgacccgacggggcccgtccgatgcgcgtcgccgcgtggaagggccccttcccggggccggcgtcccgaccgggacgccggcccctcatccatgcaacgacatcgatcactcccctcctgttggggagggggcgggcgcggcatgcggccgcgcccataggagaaggacacgatatgaggaacatcatccgcatcggcgccggcacggacggccggaaccggttcgtcgcgatcgcgttgggcgtcgccctggcggtcgggccggccgtcgcgctgcccgcggcggcgctggccacgccggccacggacgccgcggccgcgagcacgacggccggcgcgaccatcacactgcaaggcgcagacggagcaagcctggccggccacacgttcgacgtgtaccggatcggcacgtacacggaccagatcctgaacggcacgcggatcagcagtctcggcgtgcgcggcgacacggcatccaacgcgtgggcggccgacgcgatcggcatcgccaacgcgtacgatccaagcacggccgacgacatcggcaaggtgtacggctatgatgacgcgggcaacatcgccaacatcaagatggactcccagaccaggcagttgcgcaacatcagcaaggccctggcccagtcctcgaggcggccggccgccatccagggcggcgcgaacctgacgaccacccagtccacgctgacgatcaacgtgccctccgagggcctctactacatcacggacagcgcgggcaacccgattatggtcggcacgaaatccggcaacgcgaacatcatgaagaacgacgcgaaggacccgcagtggcggaccctgggcgtcgcggtcgtcaaggcgaaaagcgtgagggtcgacaagaaggtccaggtgcagcgcaacggcaccacggtaggcaaggacggcaccgcctccgatccggtcggcgtgaccgtcggcgacaccgtcaccaacacggtcgaggtgaccgtgccgaacaagcaggccgcctccgccgtcaagttcaagctcatcgaccagccaaagggccagacgtacgtgcagggctcgctgagcgtccggctgaagaacgcgccgcagaccgacatcacggccgacgcgatcgtctacgacgggaccacgcagaacaacgcgaaaagcatccccggcgacccgaccctgaagaccgcggacaacaagcccgccgacccggatctcgccatccccgcaggcggctggggcatcgacggcaggaaacttctcgacaaatactccaacaggacgatcgtcatcacctaccgcatgaccgtcgacaaggccagcgtcaccgatccgccgaccaacaccatccacacgtacggcacattcaccgacggcatccacttcacgaccatcaccgaccaggacaaggccgacatcaaggcctacgacttcaccctgcggaaggtggacgcgggcaacgtgaacacgctgctcgacggcgcccggttccagatccagcgcaacggcaaatggatgaatctcgactggaacaccggcaaatggtcggatgcggccgaccagggttccgccaccgtgttcgtgaccggcgacacgaaccatgacgggacggccgacaacagggacgacgcgagccagaggggcctcatccggttcaagggcctcggctacggcacgtacacggtcaccgaaacccgggagccggccggctacgccagctacgcgaaaccgacgttcaccgtcaccatcgacgacgcgggcaccagcatccagtacaggggcaccggcaccgtgccgaacctgaccagcaggctggacaacaacaccgtccaggtcaagaacgtcgcgaatctgacccaactgccgcagaccggcggcgtgctcgcgttcgcgttctggctggcctgcgccatgcccctgttcgcgatcggcggcaccatggccgtgcgcggcgcgcgcaaccgccgcgacgcgctgacgctcacgcacgacggcggcaatccggccgcctgacacatgtcccggccctccaggccggggttccgccgatagggggcggggtcgcgtcccctatcggcctctcatcaccgaatgattcttttttatccggcccgccacgaggggttcgtacgggtcttggcccatccgtcggaagacattgcgagggatgggggaaggaaaaccgataatgcgcacatggctgaaacggatggtcgccggcatcgtgtcggcgggcaccctgatgggcggcgggctcctgacggcgggcaccgcgaacgcggacgagatccgcatgcccgacatcggcaagaccatcacgagcctgacggcatcggccgccacgacgtatccaagggagctcgtcaacggcggattcgattacctgcccgacggcggatggaagaccgttgacgcgccaagctacatgacgaacgcatacacaagcgtcgacccgaacaacggccagtacatgaggaacgcgaaacactccgacgccgatctcgcctcctgggtggactggcccggtttcgaccagtccaaatttgcatggaagaccgaccagaaaggcggccacgaccaaggcggattgaaggaccgcgcggaagcggtcgaactccaacaggacagcatggacggcaacacctacgcggaaatggtcgcctccgaacccggacgcaccatctaccagaacctcgccaccatccccggcacactgtacaagatccggttgaagcacaccagcctgtgcaaggacaacgtcgaccagatgcaggtcgtcatcaacggcacacccatcgagatgacccgagtggccgcgaacggcaaggccggcgacaaggtcggcgagaagtccaagaccatcggcacgagggtcacgaacgagaaccgctggcatcattccgaccagtgggagacctatgagggctactacgtcatcccggacgggcagaccactacccggttcggtttcaaggccgtcaactatctcgaccccaccaagggcaatcttctggatgatgtgaccttcgcccgcgcctacaagctgtcctacgacaagaacgcgtcggatgcgaccggcaaggtcccgtccgacgagaccgccgacaccgtcaggcagaccaaggccaggaccacgggaaccgtgaagacagtcgcggacgagaacgtccggtacggttccctcgctaatggcgatttctcctacccctcgttctccgacattcaggagaacgagcagggaacctatgccgatctgcgcacgttcctcaaatcggatgacggcacgctttggtacaacatgtccgtcaccgatctttccaagtacggaaagatcgggcagatccccggtttcgactcttccaggttcgcatggtccagtaccgagaacggttcaagggtcgaattgcagcaggatcgcaacaccaagaacacgtatgcggagatcgtcgcccaacaggacaacaccagcatctaccagaacgtgtccaccggcaacggcggagtactgtacaagatccggctcaagcacgccagccgccaatcctcccatgccgacaagatgcaggtcctcgtgggctccgacacggcccacgcgacgcctgtggagatgacccgcgtcacctctaacggccatggcgacaaggtgggcgggaagtccaccaccatcaccacaaaggtatccaacaccgatccccgagaccatggcagccagtgggagacgtacgaaggctattaccaggtgcccgaaggacagaagaacacggtattcatgttcaagagcctcgaagggttcaaagagtttgagaccctgcccggcaacaacgtcggcaatctcgtggacgacatcgaattctcccgttcctacaagttgacctatgacaagaacgcgtccgacgcgaccggcaaggtcccgtcgaatcagcgtggcaaggagaacaccgtccagcccgccgaatcgaagactaccggaaacgtgaagacggtggcggataatacgtcgaatctgccggaccatctggtgaacggcacgttcgattatcgcggcaacgagatcatcaacgagaaccagagggtctacggcgacacaacctacctcgccataatcagcgcgaagaccggcgtcatcggcaacccgctgcacagcaagctcgacaactgggattccggcaaattcggctggaaatccaacgacgacaccgccggcgccgacaccgtcgaggtgcagcgccgcaaccacaccccgtatccgaccaacgcgggcaacgtgtggggcgagatcgccgcagccaagcaaggcaagtacatctaccaggacatcgccaccacgcccggcatcatgtacaagtggagcctcaagcacgcgtcccgcaacgcggaccaggacgacagcatgcaggtcatgatcggcgaacccggcaagaccgtcgcacagcaggcgacccgcaccacatccaacgggtcggacaagaccggcagcgtcggcaccacgatcaccacgcacggcaccgcgcaggacggcaagtgggagacctataccggcgactacctcgccacctcgaccacgacccgcttcacgttcaggagcgtcagggactccaacggccagggcctcgacttcaccgccgaaggcaactgcgtcgacgacctaagcttcgacaaggcgtacaagctctcttacgacaagaattcttcggacgcgaccggcagcgtgccatccaatcaatacggcaaggagaacaccgtacagcccgccaagtccaagaccacgggcagtgtcggactcgcggctgacaaaaccgcttccggcctgacggtgcatgatctgaagaagaacgacaagggcaaggtgccctccaattcgaaggcggattccacgcagccggccgcgttcaaggctccggacgccaaggtggagaccatcgcctccagggccgcgggcgacgagctggccgtgaacggcgggttcgacaccccgaagtggacgatcgccaaggaggggcagggcctgccctgggtgtatgtgaagcccaatgcgggcacgatccgctcctacgcgcaggccatggccggacagacgggcgtgaaggccggcggcctgaccgccgccacgttcgcctggcaggatctcgatgccatcggcagcaaccagaacttcgaactgcatcgcgagaaggacgggaacacggccgccgacgtgcatgcgggccgtaccgtcgcccagaccgtgaacacgacgcccggcgccagctacacgttcagtatccgccactccagccgctccaaaggcaacgcgggcggcgtgacattgctcaccggccccgacaaggatcatctcaccccagtcaaactgacccgcaccacggtctccaagaccggagcgaaatacggggacaagaccggcgatgtgggaaccgtcgcctacacgcactccgattccatggacgccacggaaggcagccacgaaccgtgggaccattccgacgactgggaatcctacgagggcacggtcattatcccagccggacaatcccgcacgatgatcgcctacaggggcgtcgccaaggacggtactcttactgcctccgccaatgacagcatcatcgacgacctgagcttccgcctcgcctacaagctcagctacgacgccaacggcggcgacaagacggacacgtcgcagatcaaggcatcctccgacggtaccgtgaaatccatcgccgacaagacctccaaggttccggtccatgatctggaggacacggacgtgcccggccagtaccgtgatttcatcctcgacaccaccaaggtcaagttctccgatgtgaagtttgagaatggtgcatggttgaacgcgcctatgccggactccggcgacggcgcaaccgccatgttcccgttgaagattggtgccagcgccaccctgccgaatgtcggcgagtggaccgatggcagcgggcacacccattcgatcaacgcgatcatctcgctgcattcgtggaacggcggcagcatcagccgattgtggacccggctggacggccaaccgtccacaagccgtgacctgttctggatcaacaccgtcggcaggaactccgacctgccggcgcaagtgatcaaggcactcggcggcatcgacacgtcgaagcgcgtcggatgccagtggaccgtgaacttcacgtacgaggacggcacccccgtgcccgacacgttccgtggagtcaccggtttcaacgatctggacggctgggacgctcaacccgatctgaagttcgagggtgttcaactggtctccggcttcgacggtgcttacaagacccgcgatgccgagctcgccacctatggggtcaacggtttcgcaggcgccaagcatgactcgggccctgagtcgaacctcgatagcaagcagcagatcaagcatcgtctggccgccacgtggaccggctccagcttcaccttcggctacgatctgcagaaccccgagggacgcgatcgcggctgccgaatgaccttcggcgttccggtcacccgcaccaaggtgctcacctatgatgcgaacggcggcaagggcagtgtgccctcgcataccgaagcaggcaaggtggaagccgcttccgccaaaaccgccggcagcgtgcatgccatctccgatgccaccgataccaccggttccgctgagggcaaggccgtgtcgggtgtactgacggacacgacggttgatgccggtgacggtaccagccagcggacgatcacccgatccgacggttccgtgcgcgtggagaccatcgccgacacgggcgccgtatccggatgccaggtctactatccggccgccaccaggatcacattggcgaccgcgaagatggactccgactgctgggattccagccagatcggcaagaccaaccgcacgttctacggttggagcgcgaacacggacgccaacgacagggacgtgcccgtcggcgacaccatggaccggaacacgctgaacgcgaacgtcaggacggagatcgtcatgcccgccagggcgaagaccgtatacgcattgtgggccatcaaccccaccctgtcgtacagcgtgaacgcgcccgccggcagcaacgcgcccggcacgcccgcatcgcagaccgtgccctacaacacggccgccgccgacaaatccggttgggcggccggcgacacgggcaagattcccggctaccggttcgacggctggtacacggccccgaacggcggaaacaaatacgatttcaacacgccgctcaccggcaacgtgaccgtgtacgcgcactgggtcggcaacgggtacacagtcagattcgccggcaacggggcgaccggcggcggcaccccggatcaggcgttccaatacaacatcggccagaacctgcgccggaacgggttcacgcgtgacgggtacacgttcgccgggtggaagcgcgccgacaaccagcaggcgtacggcgacggccagtgggtcacgaacctgaccacgcagccggacgggatcgtcaccatggtcgcccaatggtcggccaacgaggcccacatccgctacaatccgaaccctcccgcgggcaagaccgcgggaggccagggcacccccaactgggatggccacaccggagacacgccgaccatcggccagaacggctggacgatcgacgggtacacgttcgccggctgggccaccagcccggacgggagcggcgccaggtacgcgccgggagccaggtggacggcgaacggcacgctcaccctgtacgcgcagtggacgcccggccaggccggcctcacctacgacggcaacggggcgaccggcggcaagaccgacccgcagactggcaagaccgacgagaagatcaacgtgcgcgacaacggattcacccgcgacggctacacgttcgtcacgtggaacactcaggccgactgcaagggcaatgcagtgaaacctaacagcgagtggacgttgcgtggttccagcaccctatatgcctgctgggccggtaacgcgcaaaccctcacctatcacggcaacggcgcaaccggaggcaacacggcggcacaatccggcaagaccggtgacgaactgaccacaaacgccaatggtttcacccgcgacggatacacgttcgttcgttgggacaccgccaaggacggttccggcaccgcatacggcgaaggcaagaacggcgtcagccagtacgtgatgaagccagcaggcaacgacctgtacgccatctggaaggcaaacccggcaaccatccagtaccgcaacgactggccgaacaccacaggcagcacacccgacaccaccggcaacaccggcgacacggtgaccatcagccagaacagcttcgaccgtccaggctacacgttcaccggctggagcaccagcaaacgcggcgacccaagcctgcaaccgggcgacaaacacacgcttgaaccgagaaccaccaccgtgtgggcccaatggaaggccgaccccgcacacctggtgtacaacagcaacatcggaaccgtcggctcggaaaccaagacggtggacggtgttgtcgaccagaccgtgaagaccatcacgaacccgttcgaccgtcctggttacacattctccggctggaacacgcaggccgacggcaagggcaaggcatacgccacgggagccgactacgtgctgacggccaacgacaagtccacgccgaagaacacctccgtgctctacgcgcagtggaaaatcaacggtgccagcctgaagttcaacccgaacggcggcatcggccatgtcgatgacgtgaccggcgacgccttctccaccgtcaccatccccggtgacgcgaaggagccgaagatcacccgacccggctaccggttcgtcggatggagcacggagaagaacccgcccgcagggagcactttcctgcagccgggcgaaggcaaggtcacactgcccgccgaaggcagcaccaccgtgtacgcccagtgggagccgagcctgaccaccctgccgttcacgggcggacaggcccaggtgccgaccatctggctgtacgccggattcgcgctcatgctgatcgcgctcggcgtgatgatgccgatgctacgcatgcgcatggccgcaaccaagcgcaccggtaagcacatgccgatcaccggcggaaagcacgcgaagtgacggcagcggccgaaaccgacgtgtgggagagcgtcgcggatgcggtccgcgacaagcgggcgcgcgacaatcgcgcccgccggctcgtccgccattcccggatctacgcggtcgccgcagtcatctgcctgatcgcgggcatggtgcttgtcgccatgccccgcatccagcagacgctcggcgaccgcgccgttgacgagcaggcgcgatccgtcagccagacggccgcgctgtttccggaatcctcccgtcaaagcgtcatccaatctgccatcgcatataatcagcgtctttatgaaggcggtcagccacagataggcgaacctgtgttcgatgggaagaccgagggcaatttcgagggcgatgccgaataccggcgtcaactgtccgtgaatgggttggatgccatgggtgagattctgattccgaagatcagcgtcgacatgcccatcctccacggagctggtcaagatgtgctcgaacatgcggccggccatctggcgggcaccagtctgcctatcggtggcaagaatacgcgcgccgtaatcaccggtcattcgaatctgaaaggcgcgaccctgttcacccggctcggtgaactcgaagacggcgacccgttctatatcaaggtcatgggtaacacgctcgcctatcgagtcaccagcaaacgcatcgtctctcctaccgacacgaaatcgttgcgtgtccataaggggaaggacgaggtcacgctcctcacctgtacggggcagggcaatacgctgcgactgcttgtcacgggggagcgcaacagcatgcccgatcaggcccccttgcccggagatgccacgggggacgtaaaaaaggcggcttttgtttcgggcgtcaccgtgacggggatattggctgtcggattttcgctttgtcgcagtcggcgtgccgtgggtcatcatataggtttgccacagacacatgatagtgacaatttgcgttagtaaaaaaaggtgttactatatgtttgtgaaacaaaaacacgtaatctcccgacatcggggtaaacccgaaaaggaagacacatacacgagaaagaagaaactccccatgacacacggcatcaccaagatcacagtggcaaccaccgccgtgatggcaacccttgccgctccggcagtcgcaatggccgacgaaaccacaaccaccggcgaccaaaccaatcaggcaatcacacaggcccaagacagcatccagcaggcacagcagagcaccaccgaagccaaccaggccatcgcacaggcatccccgaccggcgtgaccgaagcacaggccaaggccgacgccgccgcagccgcactggacaccgccaagcagaacctcgacgccgccgccgcccagcagcagacagccgcaaacaaccagcagcaggcgcaggcgaactacgacgacgccaataaggcccagcagcaggccgcacaggatgcgaccggcacggccgacaagatcgccgccgcccagcaggccgcgaacgacgcgtccaacgccatcaatgacgccagcaaggccatgcggcaggcctccgatgaccagtcgaaggcagaagccgacaagcggaccgcacagaccgcgaaggatgaggcctccgccgaatccgcctcccatcagaaggacgccgacaaggcccagaccgatattgatgcggccgacaagcaggccacggacgcgcagaagaaggccgatgacgcagataccgccatcagtgatgcgcagaagaaggccggccgggccgacgcggacgcaaagaaggccgcggccgacaaggccgccgccgagaaggagctggccgcggccaagcagcagcaggccacggcgaccggcgacaagacgaaggccgacgaggcggtgaacgtcgcgcaagccaagctggatgcggccaggcaggccgaggccaaggcgcttgaagccaagcagaaggccgatgccaaggtcgagcaattgtccaaggatgatggaggtctttccgacctggccgcgaagctcaaagcggcgaagaaggccgcagccgacgccgccaccgcccagcagaaggcggaacaggcgcagaaggatgccgacaaggcggtgtccgactcctcttccaacgccgaggcgaagcagcaggccgccgccgatgccaagagcgaggccgacgccaagaaggaagcggcagacgaggctcaggacaagctgtctcagggcgcagtggcctacttcggcgacaagggtgcctctcaggcagtcaaggttctcaccgatccgaccgtcaccgagtatcttgacgccattcataatggtgccaagggtgatgcgaccacgttggacaacatgatcgaggccctgaagttcatccaggaagccaatcagcttcgcgcgaaggaaggcctgcagcccctcaaggtcagtgacaccctgatggcacaggccatggcggatgcggattatgccaacaacaacgtgaaccatccacttcaattccccgccagcgaaaacctcgcctggggttacactgatccctttaagggctggtacgacacggagaagtccatgtatgagaaggacatgtccgacggtgtcctggattgcaaggcctcggacggcaagcccgtcaaaccctgcgcttatggccattacaccacgctggtcaaccccgatttgaccctcaccggtttcggcgtcagccagaacggcaacatcacgggtatcggcgggaacacccatagtcagctgttcaccgaaaacgctaacggaatcggctccgacgcgggccgcatcatgaacgttgacgcatacctgactgatttgactgcctaccgtgattccctgaccggagccgacgccgcataccagaccgcattgtccaagagcaagcaggccgcacaggacgcttccgatgcggccaaggcgctggccgccgcccagcagtccgcacggaaggccgctgaggaagcccagcaggccgcgcagaaggccagggatttgcaggctgccgccgacgaggcgcagaaagcgtatgacgaggccgtgaaggcgaacgaggacaaggccaaggcgttggaggaagccaggaaggatcaagccgataagaacgcggcttattccgccgcccagcaggccaccaaggaagcccggtccggagccgacgccgccaccgacgcccagaccgcagcccagacggcagtggacaaggcgaacacggcagtcgccgccgcacaggcgaagatcgataccgccgacaagctgacccagaccgccgccaagaacaagacggatgcggaagccgcgatcaagcaggcgaacacggacaagacgaaggccgcagccgacctggccgccgccaaggcagccaaggccgaggccgagaaggccaagcaggccgcgctcgacgccaagaccgtttccgacgcgaaggttgaagccgccgccaagcaggtcaaggccgccgacgaggccatcgccgacgccaaggccgcatacgcgaaggcgaaggacgacctcaacgcggccaccggcaagctcaacgacgcccagaacaccatcaagcgtctgcagaacgccgaggagaacctcaagaaggcgaacgcgaagctgacggaagcgcagtccaagctggacgaggcgaacaaggccaaggatgaggccgacaaggcatacgagaaagccaaggccgactatgatgccaagctcgccgacaagcaggcgtccgacaaggagctcgccgccgccaagcaggccgaagccgaagcccggaagaaggccgaggaggaagccaagaagcagcaggaagcccagaagcaggccgaccaagccaagaaggatgccgaagccaagaagcagaaggccgaacaggccaagaagcaggctgcaggtgtgacgaacaatggtctggcctccaccggatcggacaccaccgcaatcgccacgctggcggcgatcatgaccatcgccggcgccggctgcgtgctcgtgaaggtgcgctccgccaagcatgccgatggatggcatgcagtcgaggactgattctcaccgcaccaaacgtgttttgcccgccttcgacccgaaacaggggagaggcgggcaaaaccgtattcccacataccgaagcaaaacggtagcttcttttgttactatcagaaaaaagtcagtgaattgcgtgaaagggtctggctatgaacgatgtgggccatgcgccactcccaggcgacgtgctgctacaccaatacctgcaaccaaacaacatcaccatgtaccgtctggcgaaagccatgaacctgccacaaaccaccatcagtggaataatacgcgggaaaagacgcatcaccacaagcctcgcataccagctcgcctacgtgttgggcacatcaccggaatactggctggaattgcaaatgcactacgatattgaaaactacgacaaattcaacgaaagcggactgacggccctcattgataatacggtcggcgacactgtccaatcagaacgatgacgagcagaagaatccgctaacgccagtttcgtccatgcccactttgatggcctcgattccgccaattcgttttccgctgccgcgcattgtactgctgaggatattctgtgccggcgcttgtccttgtattttctccctcggagtggctgaatagggcttgtttccattggtttgcgttcatggaattctttatccggccttctcatccccaatgcgggaacaggtggcggaagagcctctcgccggcctcctgctcgtcgagcacgcccatcgtgtattcgtcgacgatgaaccgggtcctcgccatccgttccgccgtctcgtccgacatggtttccgttttcgcatcgccttcctcgatgcgcgtggggacgcggacgagttccagatcggatatcccctcgggcatggtcccgtccggcagacatacgacgacctcctctcccccgccatcgagctcggtcagcttgcagatgccggtgccgtccaccgattccaggtattcgcccagttcggggatcccgtcgcgtgtgaatctgcacatgcgcagcccctgcccatccattgatcccccaatcatgccggatgcccggcatatcccgtcatcatgctacttcctttcgtccgttcatgaatcagacacgccatcatcgccatccggagacgacggcccgttgcccggctgtcggccgaagatggattccccgtcgcccaacgctcccagggatcgcagctcgccgtcgaaccggtcgcgttcggcttgttcgcgcagttcccgctcccagatctcgtagtcgtcggcgtgcagcccctcgtcgggcccgaccttccagtcgaagcgtcgcagccggctgatgccgggcatgacggtgccgtccggacgtgtcaacggatggttgacgacgaccttgctgcaggtagaccactcgtcggtgacggcgaacccggatccgtcgcccagcgtctcgtattcgcccacgagcctcctgccttgctcgtaccattcgcacatgtgcagcgtgaacgacccgtcctcatgctcctcgtacatgaccgtctcctcttccgcaatcctagagctcgatgtcctgggcgagcgtggtggccgcgtcgtttttgtgttcgatccaccatgccgcgtcgttcatccgcagcacctgcctgcgcagttcggcgaacgcgtcacggtcctcgatgcgcgcgtggcgggcgagcacgtcgacctggctgagggtgcggcgtcgtatcggctccgcccggtcgcactgggatttcgagccccacagttcgcagaacccgtcaagcctgttgcgctgccgggacgcgatgccgatgcaggcggggcatgacacccgttccgcgttcctcacccgctgttcgacgaccacgtacgggccgtccacgttgatccgctcctggtgcccgcatgcgtgcgtgacgaatctccaagccatgacctaccgccttcccgaaaacaagaaccgaaccagcattcgaacaaatgttctattaaggcggggacatgcacccgtttgacgcccggcgggaacgctacgaccgacgcggggcgcgccgcgactccggcccgtattccgacgatgtcatggtacaatttattgtacaaacaggaggtgcgtgatgacacaggccgtggcctacagcaatttcagggcgaatctcaagacctatatgcgcagggtcaacgaggacgccgacacccttctcgtgaccaacgcggacccggaggacaacgtggtcgtgatgagcgccgacgactacgattcgctcatggagacgctgcgcgtctaccagaacccgtatctgagcgataaggtgatgcgcggcatggcgcaggtacggcagggccagacgatggcccatgaccttgtcgaagcgggcgcgtgatgctgctctgctggaccgatgacgcctgggccgactacctgtactggcaggctcaggaccgcaggaccctcaagcgcgtcaacacgctcatccgggatatgcagcgtaccccgttcgagggcatcggcaagcccgaacccctcaaatggggcctgtccggcgcatggtcgcggcgcatcgactcagccaaccgtatcatctataccgtcgccgacgacaggctctgcatcctctccgcgaaggaccactactgaatgacatgggacggaacggcctgtaccaccttatcgacgttttcggtcgactcggctttctctgacaggattcgctggcagttcctgagccggttccaatagcgctttcgccaggctgcgaacagtcccgccaccaatgacagcacaaacgtgcatagccataacacgacgccatttacacccttcatatctttcaatgggccgaacccaaatacggccacagcagtggggacgatccctcctaaatcaagcaccgcattcgttgctttggctttggtgtcgtttttcctgatgaattcgggaagatatcgtttgacgcggggatcccagtccttgatgttgtcgaatgtgatcgattcggttatttcgttcttcagaaacaaggtcgaggaaatcacgtaccgccattccagcagggatgcggagtcggcaagaccggaaccgatttttccatcgggccagcaatatgcgagggacaacgcgaacagccagaacatgaccacgcacatcagcctgataaatgtatggataggcccttctacgtagtaaaggagaccggatagccccatcccgatcaacaagggtattgggacaatcttcagacgaaactttgacggcatgacatctcttacgatgatggcacaggccacataccagcagtagacgaagcccacggaaagcagccacagcgacgttcccgcccctgaaaaggccattccctttccgccgtagttgacgcaggccattgccacccccgcatcccaggacgccagcatggacatgagaaagatgcccttttcgaatttcgttgacctatcacggccgagcatgggaccgaataccgcccatgaaaaggtcgcccatgctgccgacatggctccagcgactatgacgctttcttcattctgatctttccagaaaaaatgcgttcctatgtagaaacccaccagagccacggccaggtccagcagcagcaatgccaatcccggaatattcttcttcatgctcttgcctgtgctgttttcggcttcatccggattcgacgtatatgaattcatgatcggcttcccttccttccacctgccgtctcaaccaccgtatatccgtgatgatccgttttcacgtgttttgttgaatttattaggacatcgcggcggcgcttgtgccggccacgaacgcgagcacgacgaatgtggtgaagatggggtcccagaagacggtcacgaggatgacgatcagcacgatgttcagtatcacgccgacgaggtttcccggcttgtccatgtcttttctgaacagatggactcccatgcagaccagcaggattatgaacgcgaatccggtcagcaggaaaaaccagtaccagggttttccggcggtggcgaaggcccgttcgatcagagatccgttcatgacatcgtactgggaatgcagccagtgcttgtagaatgccagcgcgatgatgtaggccagggatgcaagtatggtggctttctcttctacggggatttgtctgatcacgttcctgattctagtgaacgatcagtcccgccgcgaagacgatcacgccccagatgaacgtgagtcgtgcggggtccgccttgtcgccgtggccgacccattcgagcgccgtcttcatgccggcgagcatcgtgtgggcgagcatgaggcagaacaggaacacggagaccgcgagcagcggggtcaccgttttctcgactgccatattcaccattcccgctcccaggaggacgaacgaggcgacggtgcaggccacggccgccgcatccgcgcggcttcttttcccgtgtccgatcagcgggtatacgcataggcagcagatggccagcaggacgagcggtgccagggtcagcgcggtttgcgcgtccgcgtcggagaccattctcaggtagtccgttttcctcaggcgcggcagcacgtggtaggagaggaatcccagcacggccgtcgacatggcggcggccatcccgacgcgcagcagcactcccttgcatatcgccgcggcatcggtgccatgttcctgctccatgcccttgctccttccgttcgtcgttcccatgccggttttcccggatccggttcccggaccgtttccctgttccggttacgacgataaccgggtttcccggctcgggcacgttcctgttcatgcccgagtcctcgtggctgccaccgtggccgccggccgttatcggcggccccgctggtggtgtccgtggaggcgtggccgcttgcccgtccgtcgcgtcttccgttttccggttccggtgtcggcgggctgattgggagagtgtgtcatgctgtcggttctggtgttgctgctggtggtggccgcggcgtcgttcgcgtatcgcgcgttctggatgctgcgggcccgtccgtcgtcccggtatgtggggagccgtttccgtgacgaggtggtggcgatgagccgtcgccagcgtcgtcgcgcgttctggggcaatgtgctgctgtgcgtgttgtgcgtggccgcgatggtgttggtcggcgtgctggtgggcggcatgggcggctcggtgtgaccgtccgtcgtcgtttcgcttccggcccgtcggcgtgtccggcgggctttcgtcttgtgtgtgggcctgatcgtcggaggttggtgtgatgtctggttcggctggggatgctccggtgttggagggagaacaccggttgggcgagggcatgcgtcgcggcgtgttctgtctggggctggtgccggtggcgacggggttgacgctgcgcgaggcgatgtggatgcagtgttgtctgacggcgggtgtggagcccgggccgatgcccgcgcatgcgttccgtcgcgccgaccggcatgcggtggaggacgcgatgggcgtggccccgggtctgatgcgcgcgatggccgcggatgcgaaacggcgtcggcgcatggtggatgcggacgaggaggggcgtctgcccctcggttcgccctcccccgtggacatgatgacccgtgatttccgcgtgcggccggtcacggcgtggcatcagaccagcacggggcgtgcgggggtcctgtccacgctggtggcggggtcgggggcgcctcgcatcgacgggccggtcatcggcgtggatgtgctgtcgcgtgagttgtggcggttcgattcgtgggcgacgtatgacgcgccgggcgttcacggcccgcatatgacgaccagtccggacgtgttcatctgcggtcttcgcggcaacggcaagtcgttcgcggcgaaggtgatggcgttgcgtgagatcgaggcgggccgtcatgtgatcgtccagtcggatcgcgagggcgagtggggccgggtcgccaatcatgtgggaggccaggtcgtctcgccgggcggcggccattatctgaacccgttcgcgttgccggaccgtccgtccgccggcgaggacgatctgtggcgtcaggaggtgctttccgggcgcaaggcggcgttcatgagcctggcggaggcgttgcgcgaggatggaggcccgttcccgttggatcgcgacatgcaggtggtcgtggaccgtgtggcggtgtcgttcggcactgggccgatgacgttggaggcggcggtggaccgtctcgcggaccgttcgtgggtggatggggagtcgccgtcgatgacgggtttcgagcatgagccggcgttggcgcgtgcggcggcggccgcggcggctcgcgtgtatgcgccgatggtgcgtggcggcaccctgtcgggcatgttcgacagggagtccacgatccggttggacccgtcgagcccgatgatcgtgttcgacacgtcgagtccggcgttgaacaacgagcagctcaagcgcgtgttcacggcggcggtgagctcgtggatcgaccgtctgctgcaggggcgtgacgggaggcggcggatcgtggtcgacgaggaggcgtgggatctgctgtcgaacgcgcgtctggtggactcgttgcagaccaggcagcggtccgccggccattgggggtgcgcgacctggctgatcgtgcatggcgtgaacgacatgacgcatgtgttcggcgagggcagcgagctgcgtggccgtgtcgaggagatcctcaaccagatgcagacgaagatcatcttccgtcagggcgggtcgaacatcgacatgctcagccggctggtcccggatctgagcgaggacgagcggcgggtgattcccacgctgccgcaggggctgggggtgtggagggtcggcgcggagcatccgcgtatggtgcgcgccctggccggtccgaccctgtcggccctgttcgacacgagcgatctgaggtccgcggcctgaaccgcatcgtttttgttgtatccgttttccgtattcgttggtgaggaggccgctgatggcggatgtgtccggggatcgtccctggtatgaggagctggcgcccgatctggagggcgatgccggccggggcgtggaggggtcgcgtgtcgattcgcgccgtcgggtcatggccgtgtggcgtgggttcgaggactcgcgtgcgggcgtgtggctggcggagcatacggggcttctggccgccctgtcgcgtgaggggtcggtgctggtgcgtcgtctggccgtgggcgtcctgctcgtggcgatggcgttcacgctgctgctgttcgcggcggcgggcggcgatccggtggccggcgggctgctgtccatgcccttctggatggccgcgttggccgtgtgcgccgtgctgtgggcgttctgggacgcgtaccgtgattccggggaacggctcgtggatcgtctgtcgtcggctccgggcatggccacgcgtcgtcaggtcgcggccgcgtgcggggtgcgcgaggtgatgcgcacgatggtgccgagcgtgctgccggccatgctggccgcggccatgcgggagcgtcgcatgggcggcgacccggtgtggccgaggccctggcaggcggccatgtacgtgggcgaatgccatcacgtcggtgtctggctgtcgttggagatgcacgcgtacgtgctgggaccgaccaggtccggcaagacagtgacggtcgtgatccccgcggtggtggaggcgcccggcttcgtgctggccacgtcgacgcgcagcgacatcatctcggcgacccgtcgcctgcgggagaggggtgtggcggatccgtcgaacggggcccggtacggcggccgtggccgtgtccatatcttcgacccggaggggttgggcgcggcggatccgctgacccggcacaacatgcgttggaccccgttgcaggggtgcgaggacccgaccacggcgatgcgccgcgcgcagaccctggtgggtgtgggcggattgggccaggggtcgaacaacagggagtggggcgtgagcgcgggaggctatatccaggcgcttctgtatgcggcggcgatcagcaacctgccgatctcgaaatgctacgagtggtcggtcagcccccgcaaggcgctcgaggccgcggacctgatccgcgagcatacgggcgaacgggagatgctgcgctgggcggacacgatccgtggcctggagaccatggacacgcgccaacggtcgagcgaatggttcggcgtgaggaacgcgttcgcgatcctcgcggacccgaaggtgcgttcgacgatggatttctcgccgcgcgacccgcgtctgatcgatccgaggcgcatggtcgaggatcatgacaccgtgtacgtgctcagccggccgaaatcgcaggcgggcggaggcgtgaacgcgggcctgttcgccgtgctcctgctggacacgttccaggaggcgtgccaggatctcgccctgtcgcgcgaggcgtcgggacccaacctgcgcaagatcgagccgccggcccggttcgtgctcgacgagctgagcaacatcgagacgtggggcggcctgcgcaacgcgatcacgcagggcggcggcaacggctatcagttgctcgtggtcgagcagtcgcgcgacatgatggtgcgcgactacgaccgggagaccgagcagaccgtttggaacaactgcaaccggatcatgctgggcggcgtcaccgaccgggacagcctcgaatggtggggcatgcagatcggccggcatgaggtcacccgtttcgagtccacgtggaatccgggacagggcccgctcggaggggtcacggaacgccgcggcgcggaggagacggtgctgccgtgggagctgagccgtctgccgcgcgggtggatggtcgtccagcccgtgcgcgaggcgccggccctggtccgcgccccgcatttcatggaacgcggatggtggcatgacgcggaaggagacaggtgatggacgacacccgtgacgaggtggacgagatcctggccggcatgacgggaggccggaccggtacggccggcggcgtctcatcccccgtgccgccggccgcggactgggcccgtgggctcgacgccgcgtcggcgtcggccgcgcggctgaccgtgctcctgtcggacgtgtacagggcgcatcagggcaaggacccgtcggccagcctggccgcgcagatcgagcagaccgtgcgcaacctgaccggcgagcctccgcaagagccggaatacgggccgggcctgtggacggcgatgccgcaacgctcctgggagacgatgggcatggcccggccgatcgactggaccggcgcgccctcgcgcacggagatcgacctgatgacgatgcacgcgatccgctacggcgaatggctgtgccgcacgttccccacatgggagcagacgctgcccgcctgctggatcgagcatgacgacgtggtggctgaggtgttcgccctgaaatgccatgcggacctggccgcggcctcccccaacggcggcatgtacatgccggccctcatgcaggacatccaccaggccctcgcccgggtcaaggaatacctgacggcggccggcacgggagaatcctcccacgcgcatcacatggacggcgaacagcatgcctcgcgccgacgcgcccgggaggtcgaatacgagtcgtggtatcgccggcgcggcggatggaagacggaaccggcgttcaccggccgttggcggggcggcgaggatttcgtctcctccacgctccttgcctacgggacgcctccctcgcccgcctcgcatgacgatccctccgccgacgtgctcatggccacgctggcgggctgcgaggagcggctggacggctaccggcgttcccgcgacggcatccgccgcatgcccgacgggccggaacgcgaccgcctgtcacgccagctcgccgcggacaccggcggtgatctgcgggaactgtccgaccggtggcgtgactggaggtccatggagctcgcggcccgcgaccggctcgaccaggccatcgcctccatcgaacgacggctcgacgaccggaaggcacccctgtcccatgaggaggccgaggaggcgcgcgcactggcgtcacggggacgcgccctgctcgacgaggccggggacccgcgttggaaccccgactcgtaccggccccgggacccggacgaggagctgaagctcgcgaaacggctcgaaggcatcgcccgtgaacgggatctcgattccctggaacagctcgaccggctcacggccacgatacgcgcgacgatcggcccgaggggaggcatgcgcccatgaccatgccggacctgttcgaacaactcgactcccctgccgagaccggcgacgattggatccgccgcctgctctcggaaccggacgagactccctcccccacgccggccgccggcgacgacggcaccgataccggccatgagcccgatcttccccaagaggaggaaaggattgtcccgccgcaggcctcaggaccgggggccggtggcgatgtgacggctcccccgccttccggcgcgcatgcgatccccctgccggcatccgacgacacgtcgccatccgatgacctggatgacatgcaccaggacgcgattccgggattcggcaccgatatggatgccgatgagcccgcccgtgcgggccatgccgtccggatcgtactgacggtgctcgccgtggtcgccgccgtggcgctcgtcggcgtgatcgccgccggcgccgtcaccgcgtccgcccgccacggcgcggaacaggcgcaggccgtgctgcgggagaccaatacgattgcgactcggttcgccaaagcccacaaggcgtccgacctcgccgacgcgaaggcatggagccgtctggacgcgcggatttcggacaacgcgaggatactcgacgagcccgccgcccggctgtccatcagggatgctggatcgttgaaggaccgcgcgggcaaggccaataaggacacgaacacgctggtgtcggcggcgaggagggccctcgccatcaaacaggaggccgacgcgcgcgaatcgctcgcgaaggcggtcggcgaggccaccaagctccgggacggcgcgaagcgcgacgacgacaccggcacggccatcgacgatctgacgacgatcctcgaacgggccgccgagcccggcaaggacgtcaccgtcaaggagctcgaggatctggcctcccgggtcgagcaggcgaggaagaccctcgaacaggccatcgccacgcaggcggagcatgcgaaggccaagcgcgcggccgaggagaaagcggcacgggaacgccaggagagggaacggcagtccgaacagcagaccgtccccgacccgacgccgccacagcagcaacagcaatggataccccaataccagtcgggacagtcgggacagtcgggacagtcggggcaatcgggcggaaccggctcccagcccggcaacggctggagcgtgccgtcccccagcgacggcaacggcctgcccggcaacgatccgggactatagcccatcatccattcgaaaggagcaccatcatgacggacgagacaccacgcaaaggcgagcacagggaacgtcagggccttctcggccgagcgagagaccggttcgagcggatggagccgaaacggcaggcgctgctgctcgccgtcgcggccgtaatcgcattggcggccacgatcgcgctcaacccgttccagtccacgacatccgatcaaccagaacctcaatccgcccaacaggcgacggacggcggcaaggatacgaaaaaccagtcccggacggacccgtcttcggaaccatcgggattcaccggttccacggaggacatcgccaacaaggtccggtcgatcctcaactccccggacggcggcaacatcgacacgttcggccagacgctcattcgccacggcgacaaggacctgggcaacgcgaccgacctgttcgacgcgatcggccggcaggagaaggaatccactgtccgcgcattggccgacgaatggtatgccgaggcgttgccgaaggccgccggataccggctcgacgatctcaaatccagtctgcccaaagcggaacatgccgtggacaggcttcccgaccccacgccggacgactgcacgggcctggccaaggccgcgaaacaggcgcgaacgttggtcgacgccggatccgacgactacgacaagctcacctccgcacagcagaccctcaccaaatcgatcagcgcatgcaccgccaacatgaccgtcgaccagatcgaccgcctgttccctcaggacggaccatcggtcaccatacccgacaccggaaaggaagcacaatgacagcggacaccacgcggcgggagcacagcggttccggcatccgtctcggcatcggctcctgccccggcatagcgaagatcctgccggccggcatccgaggcatcacattgcccgacggcacacgcgtgcgcatgctgcgctgcgtgacccgggagggcggcgccgacatccccgtcgccctgatccccgccaccggggcggtccacaaccgcatgctcggggccgccggcggccagatcgtcgagttcgccggcaggccacgtctctaccggcccgagaagggcggccccatcctcgcgttcaccgtcaccgacctgcgcatccgcgacaccgatgaggcccgcatgctgcgtgccggccggactcacggctgagaccgccactctgcttcgagccggcgcgggaacgtcataagaacacgctcacgaactcggtcggcgtgatgatggaagggctgcctatcctcacgccggccgagtccatggtcacgtcccgacgccaactcaatcgtccttaccgcgttggcggaacggaatgtgctggcggacagcatcacattggtgtccatcatcaccctcgttgatcagttccacctcgccgcgcgttccgcccgaatgctcccgatgaggtcgtcgagcgcgcccatccggcagcatctgcaatccgcgatccaacagactcaagaaaaccgtccattgttccgtctgttcccgttggagatggacacgacagcatatcgaatcatgcatcattccagaccttgacgccgccccggtgaatctcattgcgccttaccaccatcagcctcataccggagaatcaccccatgtcaacggcatgccgtcagttattgtccaatggatttcaaacgccgcgctcgggctcaggattcccccgactctcccgtttcctttttccctgatcagtttttcgagtctaggtccggcccacactcaggcagactgccggctcccgggaaacccatccgagacggacacggccactcgttttcgtctcatcgtcagttccagaccgaatctccttctccatggagccctctccggcttcggtcgcgtgcggttctgtaaaatgcctgcctatggcgaagacggtgataagggtcatgttcgatgatgcgacggctgcggaagggtttctcgagcgttgccgcggcgagggactggacgccgtggtcgaggacgcgcggccgatcggcacggtgaagcgcaatgggcccggtctggcgtcatggctgaaagcccatccgggctggcatgtggtggcggagtcggtgaatcggcgtgcggcgtgggccgcggcctggaagattcggcatggggagcgtcgcggcttcgaggacgggttgtgggacgcccaggcgcagaaccgtgatggcaggtgggtggtgattgcccgccgcgcctcgaaacgccgcaatatccccggcgagggcatggacccgttgttctagaacgatgtcgggccgcttgtcgtggactgccagtggagattccccgtttccacctgttccatgggtgatggccacggaagcatgccggtccctattcccgtttcggcacccatgaccaccgttttgtgggtgctgtcatcgccggcggactccgccagtgagcggacttcgcggatacgggcggaaagcatggtcgcgatggccgtgattcgcgtttcaggtacgagtcccgtgactgacaggcggtgtcccacctgttcctcccacccatcgagcttgccaaggtcatatctggtccagtcggatatgaggcgcagctgtcggcgggctgtcggcgtcttataagtcgcgtagaacggtttggccttgtagtcgcggttgtctatggcgagctctccgcaccacagagaggctccggtgtcgaacaacggcgcgggccggacccgcagtgtctccacgtcgcggatgagaccgaagttattgtaatggcggtcgatgttccgcatgaggtagtccacgagtagccaatcgtcggtcgcatgcaccaccgccgccccttcgcagccgaacagttgcgccgccctgatccactggtccctggcgctcaggcgattatccctcttcaccgattcgagaatctgccatgcggatacgagttcctcggtgtccgtcagcatttcgggacaggtggatactggcctgttgtcgtattcgccgagattatatctgactgctggtatgccgagcctggagcaaaggtccgatgcgatgagttcgttgaccggttcctgtccggtacgtccggctttgatcagtatcctggtgccgtcgcccgcaatggtccatcgtttcggaaggtcgccgccggtggatgcgtcgggtgcgttgaggctgaacctgtgggaggaggaacgggcagtcaggagggttcgtccaagttcctcgtcaaacgggttggtgaagaagttcacggtatcccattcgaggtcggatgattcgggcttgacccaatactggtcggaaaggctgagtccatgcgagcggttgaggagttccaccgccgatcttattcccatcgagtcaagtatgccgcgtatcccatcccgagtgggtgggatggcccttcttctccaccaagcatcgatgcttttcgcgtagatcgcgggtttgccgtgggagatgagctcgagaggcaaccttgaacaatccagtatacggccgctgccgacggcctttcccgatgaaggatcgtagtcgaaggccagcaccggatgtcggcgacacatgattatccgtcgttccacgtccgtttccctccttgctccggtgtcagtcactccatcgtatcccgtttccccatcgtcaccatcgtagtatgcgtgccgccgtgtccaggctccggaagaggggctggtggccggcgaggtttcgcaggagcgtttcgagctcggggatgggcaggtatcggctcgcgatggtccagacggtcgcgacggcgatgagggtgagtatggcggtgacggtgatccacaggatctgcctgatgagtccgccgccggtggtggcgcggccggtgacgccggcgagcaccgtgagcgtgacggcgaggacgatcagggtgccggtgtcccatgagtccagggtccgggtcattgcgtcggcccatcgggcgagttgttcgatgatggttcctgccgtgtcttccattgcgggttcctttcctccatggctgcggggttcggcgtctccacgcggggcgtcgggttttccggccgattacggttggccttccgggttttgccggggttgacgacgccgcttccttgtccggtgatgcgtgcgtcgaggttgcaccaatgctgttcctgccggccggaccggcccggcggcctttgcccgatgggctggtcggggtcgtcgatgtgccacatgtcccggtagatggccacgtcgcgcagcaggttgtggtcgccgtgtttccgcgccgtttccatgacggtcctcgaccagggctgttcgcccgtggcggcctgtcgggcgagggcgtcggcccgttgggtgatgaggagttcgttctggcgcaccaggtcgagggcggcggtgtttctggatgccttgatgggcgggatgatgccggcggtccagtcgtcgcgcaccgcgccgttgagccggtcgagcaggccgctgctgagccggccggccatgacggcggcggggtcctgccggtttccgtgctcgtccttggggctgatgtcgcggctgacgatggccatggcccgcttggggtcggtcatccaggcgcgggaccatagcgcgcgcagccattcccagttcggggacctcgtgatcatgctcacgatgcccgggttgtggcattggcggagtttggcctcgaggtgggggccggcgatgaggccggctgcgtagtcgtgttcgcgcaggagtcgtgtcaggctgtatctctcctcgtgttcgtcgatgcgggtttcggtggcggtgcgcgtgtcggggcgcgtcaggagcgtggagagcatgcgttggcgggcgatggcttcggggtcggtgtccgatccggacagcatggcttccgtctgccgggtcttctcgtccttgcatgcgtagaggaggtggttctcctcgcggcctcgtgtggcggccacgtattgcaggttgcatgggacgcgcgcgtcggaggggaacatggcggcgcaccggtcgacggtcatgccctggcttttgtggatggtggtcgcgtacccggcctcgcagttcgttttcgcccagtcccggggtatggtccattgccttccgtccgcgtcgcggcatgcgatcgcgtccgtgtcgatgcgggtgacggtgaacgccatgccgttctcgatgcggtgtccgtcggggccacgtacctggtggtcgttggcgcgggacacgatccggtccccggctcctatcttcaggccgtcggacagcgtggcgaggcgggacgggtccccgtcggacaggccgagcacgcgccgttcgaggatggtgcgctggttcatggcgcgcacctgttcgttggtgccggcgacgaggagcgtggtcttgcccgtcttctgccattgcagggtcatccggtacgcctcctcctcgcattcccggtcctcgccccagtggagacggtggtgggccgcgtattcggcgacgagccggcggcatgcctcgacgctgtccggtttcgcgcggtcgccgccggcgcgcaggcgcagcgtggctttgccttcgtctgcccatctggcccgtccgccgtcggggtcgttcgcccagagcccggggtcgctgcggaagcgccacaggctggtgagggtcgcgcaccggtgttcccgttcggcccaggcgagcaggccgcccggggcggcgggcgcgtcgagctgcatggggtcgccggtcagtacgagcctggctccggcccgttcgcacagttcggcgatggcgtccagttccggggtgccgaccatgcccgcctcgtctacgatgacgagctgtccggggtggatgaggccggcctgttcccgggcgtcggattcgctgatggcgcggcgtatccggtcgcgttcggcgggggtgcgcgccgcggcgagccggcaccggtattcgcgtcgcaggtcgtcgatctgcgcccggtgccgttcggatacgttgtcgaggagcttggcgatggcgatcgcgttggtgccgatgctgtcggcgagctcgtccctggcccggacggacagggtcaggccgagcacggatcccctcccgtgccgggtctcccatgctcgggcgacggcgcgcatggtggtcgtctttccggtgccggcggggccgatgagcgcgctggccgcgtgcgggttctcgagcaggtatgcggcggccttcgcctggtcgtcgctcagccggtttccgccggcccgcatggactggatgagccgggtgccctccccgggtccccaggcgagcgggtcggtccggccgaacgtggccatgacgcgtttttccatgtcgaggatcgtctggctggtgtatcggtcgagtgtggggtcgtcgaacgtgctgcgtccggcgcggctgacgagcgcggggtcgtcgccggcctgtcctgcacggtagcgggtcggggttattttcacgcagcggcggatggcgagttcggcgacctggttggcggtgtcggcgcgggccgtggggtcgagccggatgtcggcgaggaggcgttcggcttcggcccggatgttgctgagcgtccatgtggcgcgggtgcgttcggtgtgtgccatggcagcgtcggcgagccgttcgagttccgtccggccgggtgtctggtggtcggcgagctgtccggcgaggcggatgcccgcggcccgggaggcggtctgtcccagttctatggtcctgtcccggtgcgagtcgaccgcctgccacatggcgtcgatgctggtgccgggggcttcggcccgcagtttgccgtgccatcgtcgggtcagttctgccagtccgggtcgggcgtcggtcttgggcttgcgggtttccagccagacctgtttgtggagttcggcgcgtcgtttccatccgatcgtatggccggtgcggcgttcctcctcgtcgatgatggcggcgagccgggtttcgatctccctgtcgcgtccgctgaacgcgtcgatgagctcctcgggcactccctggacctcgccggccacggccctggtgccgcgtccgcgggcgcgggccggttcgtgccaggcccagccgagtcgttgggtgagcaggtccttgacgaggttggcgttgtattcgctcagttcgacggtggccccgtagacggcgcggccgtcgagcgcggtccattggccgtccgtggtgcggcgcacccggttggagatgaccaggtgcgtgtgcgggtgggggtcgccgtccctggagtcccagtggtcgaaggcgaagccggcgaccccgtcgcaggccgtgctggcgacgccgccggccccggcccgggtggccgcgtattcggcttcgaagtagccgatggtcatgtcggccgcctggtggaggcattcgtcgatggcgcggcgcgtgtcctggtcggcgaacgcccagaggatgctcacgcttttgggcacggtctgggtcaggtcgtatccggcgatgggcggctgcccgtcgttgtcggcccgtatgccggcctggtcgaggctgcggccggtttcggggtttcggcgttcgttgatgagcatgcgcacggtctcggcgccggcctgccgtccggtctcgccgccgagcagccggctggccgatccgatccaccggccgggcgggttgccttcggcgttgtagtaggcggctgggtcggggcctgtgagcggtccgggcgtggcctcgtcgggtatggcgccgtcggcctggagcgcctcgcgcgtgcggtcgaggtagtagtcggcgctgctgagtttggtcatgctgatggccatgcgtgctcctctcccttccctgcggcgccgcgggccggtccgtggcggcgcaggagtcgttccgcgtccccgtcctcgccggtccggtcgcatgcgtcgatgatgcggccgatctggccgtcgggtcccgcctgcgtgagggaccgggggtcgtgggtggcggcgagcgtgagcatgcgcatgagcaggatgtgggtgcgggcgcgcgtctcgatgccatgtcgccgtatggtttcggtgtccagttcgatggcgtgcgccctcgtcagcaggtcgtcggcgttcattctgagcctttcgatggttccggcgttggcggcggagcgcagcgtgcgccgatcgcgcgccgtcttgtagtcatgtgccttgcggcatgcgtcgccgcagtattcgcctcgcgtgccggtatcgagccgtgcgccgcattcgtggcacgatcgccgtgggcgggcacttgtcccggtgcgggtgagccggttccacctgttgcggcaccggtcggagcagaagtcgggcacgggtccctgggcgggcttgtacacgggttcgccgcacatgcggcagtggccggccggcacccgtcccggttccgccttgcgcgcctggcgccggcatcgggccgagcagtacccgtccgcccataccagggtctcggggtgcgggcaccgggcccatctgcatcggccgggtctgggccattcgcttgtggcccctgtggtccctgggcggtcgctcatggcctggccccttcgtcgagggaccaccatccgtggtccgcgccgttgcgtcctcgatggtcctcggcccatatgccctcgatgatccggtccatgccgacggcccgcgggcccgcgccgtcgtcgtggtccaggtcggcgcgccattcgtcgtccaccccgggcccgggttcgggccacatgccctcgagcgtgtggtcttcgcccgtgtcggtcatggccgggtccatggtccatgggcgtggacccctccagccggtcaggcccgcgatccggtccatgcccttgcggccgatggaccgggccaggtccacggcccaccggtcctcgtatgccatgagcgtttccggttcgagccgcatgagcgccgccatgcatctgaccgaccagtagcacagttcgaccgtcccgtggtcggctgggccgacggcctcgttgcgccatgccacccgccggcgcagttcggcggccgcctcggcgacgtcgttcctggatgccatcaggagcgactcctgcgacatgcggcgtccgcgttcccgttccttcctcagctcctcccggcgccggttccggcatgcccggtggatcgacagcggcttcccgcggcgcgggtcccgctcctccaccgcgagcccgcacaccgggcatgcgggcggctcctggatcatgttcccatcgttcatggcgcccccacccggcccgcgtctcccgtcccgtcgataacgccgaaccccgatatcggacgcccggacggcaaacaccatcaaaaacgttgccgttccgccgataggcggccgccgcgaggcggtgggtgcaagaagtccatctccttcggagattgcatcgggatgtgctttttcttgggttttctgatggcgtcgtaccttgtgactggctgtgtgggttcttggttctgtcttcgttgtttctggtttctgtgtcgtgctttttcgtctgtctgggtgctggttttcatgtcgggttttatttcgcgtatgtgtctgttgtgccgctgtttgttcggggccggctgccgcagggaggccgggcatggtgcccccggcgggtgccggctcctgccgaacggggagacgtccacggtcgggagcctgctcgtcgactgtcggggatgcggcaccggtcccgggcgcgccgcgcgatgcgcatggctccgctccatgtgcgtttggggagaccggcccgatggcgatgggctctcgggccatggaccgcatgaaccgggtccacccgccgacctgcccatatggtccttggaccgtggcccggtggacagggacgccatcgtccggcccggtccatggaccaggggtggtccgcgtggccgtccccgcatgggctttcgcgtggaccacgtatttggttggtccgccgaatggaccgtggtccgtcagggtggtccgcgatgccggccctcacatgggctttcgcgtgggccgcatgattggtccggcatgtggaccattggtccattcgcatgatgtggtccggaagcgcgcagggcatgctgatggcccacacgcatcgacgtggcccattcggcctcctggtccttggtcccggacgccggccatggcccacacggcgtgggcctgatcgtggaccgggccgtcttggatggcccatggcccctggtcgatgccgccctccgtgtccgatcggcccgtccggccgatagtaaagggggcggggccgtcatcggactccgtcccctttatcgtgtgcgactatgccaggtccttttttattcttcttgccgctttcttgtggacggtgttgtcgtcacgaacggaaacgaggttgtccaatgtgatgtttcccgccattcgccctgctccgatcggttcaaaaaaatagctattatcgtgatgataatcgtattcacgttttgctggtcggtcaggggaggacagggcccgtccggccccgccatcccatgccggtcacttggtcggcgcccaggggtcgattccggtctggggcttcggtgtctggtatccgtcggcggggaagtgtccggtgttgcgtacgtagttgacgaggtcggagtgtgcgatgtccgcccaggggtcgtttgcggtgttgtcgagggtcttggtgttcatcttcgttttcctttccggttggtgacgaccgctctttgccgcggtgcgcgtcggggcgtcaatgggacgcgcggggccccgcaggggtcgcgtggaccgttgacgtcccggcgtgcgccgtggcatggtgcgccaaggaaccgatcgggaaggaaaacgaagatggacgccgggacccgggccacgtcgtcgtcccggcttggttggatggatgccgtctccatcccggttcgtggatggcgttgtcgttgacggcatatggatgcggaagggctggatgatggggacggctgatgtcgatcgcttctcgtaccggtttcgtcggtccttcgaggatggcgggcacgtcgacgcccgtgtcgaactgtccggatcgagatggctgtatgtttccacgtccacggctttggccggcatccgtcgcctcgttgccggggttctggcggacatggattcggtgttcggccgtctttgatggacgtcacccgttcctgtctgaaacgcgaaggcggggcctccggcttatggatggccccgcccgttttgcttccctgtgattttccgatcactcgtcgtcgggtatggtgtcatggtcgtagatgccgaccatgcggatggtgcgtttcgcctcgcgtctgaagtagaccacgagcacgtcgtcgtcgaaggtgtggaactcgaagtggtttccgtccccgaacgggctgcgctcgagcgggtggtcgtgccatccgctctcctccacgcgccccttggccgccagttcgcagatcgcctcccttatggatcggatgatggacgcgaactgttcgtgggtgtatttctccttgaggggcagcgcggtccgccagaaatgcggcgaggccttgacgctccagttcactgccccacctcctgtgcggtgaggccgagttccccgagcacgtcgtcggggatggttcgcgcgtcggtggcgtcgtcagcgaccagcccgtactcctgggcctcggcgagcagcatgtcgcggcgtacgtcctcgccgagttcgcgtgcggccggggaggagaagacgccgtcgaacggcgtgcggttctcgtgggcgacctgggtgaccatcatcttcatggcggcgggcgtggtgatgccgttgcgcgcgaaggcggcgtcggcacgcgctttgacgtcgtcggggacgttgatctggatcaatgccatggtaagcctccttctccttatgtgttttccatataatatcataatctgcttggtgttgattcgggaatgataccgataccgttcgtccatgtctcggcccatgccgtttatttgaatcgttcctggatgggccgcagcgccccggtggcggcgagcaggagcgcggcctgcgcctgccgtcccgtgcggatgccgtcgagccggtatcggcttgtcgccttccatatctcgttttcgcgtttcacgtcgatcaggagcatgtcccgtcggatcacggtgccgtcgatgctgcggacgctccatgtgcacagccaggcgtggatggcgccggcctcgatggggcagccggcccgctggcatgcgtccagggtcgtcctgctggggatgatctggcgcggctgcgcgccgatgggcgggcggatccgctcgtccatcgcatcgaacgccttcgccgctccttcctcgtcgccggtgtcgatccattcgtccatggcatgtcgccgcatgttggcctcttctccgggtgagggccggcccggcgtatgtgtgggccggccttggtcgtgtgtggtcgtcgtcagatcgccggctgctggggtgccgcgggcgcgaacccgtcggtgaaggcgggctgcctggtttgggctcccgtggcgttccacgggtcgctggcgggcgtcgtcggctgctggggctgcggctgggccatgggctggctcggctgtggagtgcgtcccgcgaacccgttgtcgcgcggcgccttgttgtaggcgacggtgccggcgcgcaggctgacggcgaggtcggtggcgcgcagttcgaggatgcttcgtttcgctccctgctggttcgtgtattccctttgcacgtagctgccggtgacgatgacgggcacgcctttctgcttgccgtcgggtccggtcggcagcatgctgtgctgcaggtgttcggccaggtatccgctggcggtgcaacggatccatgtggtggcgccgtcctcccattggccggtctgcgggttctgggtgcggctggtctgggcgacgtcgaacgtggcccatatgccgccgtcctgtcgggtgtggaattcgatgctgccggtgtttccgctgatggtcagcgtgacctggttgatggtcgccatgatggtgttcctttccttgcgggttatggctgttctgttttcgggaggcggcccgtgccgtcttccgtgtgggtcacctgtcgccggcgcgatagcgtcggcctgcccggctcattggttggtggacaggttgatggtgatgacggggttggtgatgtcgggcatggagtcggctggcggccagtcgtcgatgccggcggcctgcatgatggcggcgaggcagccgctgtgggcggcggcgatctcccattgccagcattgcctgttggacagggcgatgaggtggtcccacatggggtagccgttttcgtcgagcgcgggccggccggcgttgagcaggccgatgagttttctgacctgggcgcgcaggcgttcggcttcgcgtgcggtgacggtgtcgacttgttgccagatgcggcgggtggtctcgtcgtcgatgccgttcgcggcctgttcccatgcctggttcctgaggtcggcggcctcctgggtttcggcggggtcgagggtgaggcttttcctccaggtgatgcccatctgccatgcgccggagtcggtggcctgtgtctggctggtgatggtggccgttatcctgtactggctcatgatggtgtcctttcctgtgtcgtggatcgtctgtccggctatcccctgttttttctttttggcctttcggtcaagcgcagcgttaccggccaaagcgggttccgtccaatcgatcgcgccgggcgcagcccgtctgcgtggcgatttgacgggttccgcgacgccggtatgatcgtttcggcttcagccgaaaaggccaaaagggaaacctggggccgcgcccctttgggggcgttcctttttccgatagggcttgcccgtccatcgtgtttcccgcatgcgtgcgggagaccgatgccggtcggggccggcggctcgggccggcgcggggaggtccgggaggggcgcgtggcccttcccggccgccggaggccgtccccgatcgcctggttggcgcgggcggggactccttggccgtgggtcagccgatggggtggacgggtatcatgaacgttttgccgtcggggagcctgcagggcgcttcggggtcggcgaacatggcggcgtagcgtccgatctgctcgtcgtcgagtccgagggggccgtcctgcgggtggggtcccgtgatgacgaacgtgccgcggatgatgatgggcttgccggcgtccgcgaggcggctgtcctggctgaggcggatggtgcggttcggcttgaggttcctgatcgccccctccccgtcacaccagagcgtggtccgccggtcgaggggcaatggttcggcgtatccgccgatcgtcttcccgatggccgtgatgctggggtcgatgtcgcgcagttccggacggcgcaaaggttcgatgacgagcgtcttgatggtgtccatgatggtggtcctttccttgcaggggtttgcctgtcctcccgcatgggcgggaggacgctgctgttattcgtcgatatggccggcggggatggtcctgcgttgtgccgccctgcggcggcgttgcggggtgtcgatgctcggcggggtgcgccgtctggtcttgcggccgtatatcttccagtcgatgccggcggccgtggccatgatcgctatgacgacgacgttgccgatggcttcggcgaattccgggcttgcgaggtattggctgatgaggtccattgggactccttgtggtttgtcctgagtttgtttccggccttccttggccggcatgtcacgccgtttgcccgccgatgtaggcgtcggcctcggccatggatgcgcagtagcgtccgtagccggcgtcgacccaatggccttgggccttgtggagctggtgcacgtcgtacgggcgtgcgccgtcgcccgtctcctcgacgtcgtaccggtatccgccgcgttcgatgcttttgatgatgttgcgtgccatggtgcttgctcccgtctggtggtcccttgttttttcttttcgaccggttggtcaagcgcagcgttaccggccaaagcgggttccgtcattagcgatcgcgccgggcgcagcccgttgcgtggcgcgttgacgggttccgcgacgccggtatgatccagaggcgaagccgaccggccgaaaagaaaaaggaatgggccggcccgccccttggggcgggttccgtgcgggggaatcgtgccgtgtccgcggcgtggacgcggacgggatgcgatgatgacccctttgggggccttgcatcccgggagcggacatgccggcggcgcggctcctccgtctgatagggcttcgcccgtttcgccgtcgtcccgcttggcggggcgcggcgtctgggtggggtccggcggcgtgggccggccggggtttgcaaaggggcggcgtgagcccctttgcccgccgggggccgtccccgtccgcctgcctgatgcgggcggggactctttcggatgacgggcctgccgtcggcgttttccttctccgtcatgtgagggggtggcggctggcgtcccggttcatgaggtcgcgcaggtcgtcgagcgtgtcgaggcattggcggcgggtgttctccggtgtttcgatgccgtggttggcggcgtggtggtgccagaggacggtttgggcgaggctggaggccttgtgcgccacgtcgtcgagcatttcgtcgagcgcttcggccgtccattgctcccagtgggggtcgtcgtccggcggggcggacagcgcggcgtcgagccggtcgagcatggtttgtatggctttggcgtcttcgaggagttccgcgatggtgccgggttgtcctttcatcgggctcctgacgagggctcgcacgtgttcgtcggggtcgaattgttcggcgtgttcgtgcaccgtttcggggatgggccggcccgaaggcacgtctatgatgaggtcttccccggcggggctgctggtttcgagccattgcccgccggcgaatccggtgtggagcgtccagccctgttgattggcggtggtttcgatggtgttcgcgtgcatggtgtcgtgtcctttccgtcgtggcgtccgatggcgtgtgccgtcggacgccacggctgtttttttctgtcggtcagcgcaggtatgcggggtatcggccggatgcggccatggcggcgaccatgatggcgaggctggtttccgggtcgtcgtccagtgcggcgatggcggcgagggtggcggccttcccgtcgccgtcccaccatgcgaggtaggcggcgagggcgtagggttgggcgacgggcccgccgtgctttctggcgcggtcggccatcgcgcacgcctcccgcaccgcgcgggcgaggcgggtctcgtcggggcggatgtgggggtcgccgaacccgacgttgagcgtttcggtcagcagcgtcttgttgttgaacgagtggggccgggcggccatgtcgatgacggtcgccgtgtcgagcttgggttcgacggcggcgatgagtgcggcgtccctgatggccaggcgggccgtcatgagcgtggcgaggtcgtcgagccgttccgggtccgcatccttgccgtcgagggctcgcatccatgtctcgagcgcggggccggcgatggtgcggacggcttcgcccgtcccctgttcggttgcggcccgcttgagttcctcgatgatgttccgggttgtggtggtcatggtgttttctcctttttgcgtcttttgttttttgaccttcttcggtcagcggatgcgtaccccgcgtaaggcggttccgtcatgaggcgacgccccgccgtcctgcggcgtgtgcggcggcgttgacgggttcgccgacgcgggtatgcttcgatgggtcgaagaaggccaaaccacgtgtttttgccgtgcccgcccttggcgggctccatgcggcggcatggccggcgggcgcgcggcgcggtcggccgggcgcgcgggcatgggccccgtggggggccgtgcgcgtccgggcggcggcgatcgcgcggtcccgccggttccgtttcctttcgccgtcgccccgcgtcgcggggtgcggcgcctgggtgggctccggcggccgggggccggcccggtttccaaagggcggtttgagccctttggcctgccgggggccgtcgccgcccgcccggcgcgggcggcgactctcgtcagcggcgcggtggcgtgtagtcgagcgtcgtcgcgtatccgctgtcggcggtctcctcgatggcggtttcgtatccggcttcgagtccctgctggtacgcctcctcccacaggtcgtatccgatgaggccgttcgtgtcccagttggtgttgctgacttcgatggccccggtgccgcccgggatggtctcgtggtcggcggtgagccattcgagcctgccgttttggtcgatgagcgcgaacctgccttggcttccgtccgtgaggtcggcttgcccggcctgccatgcgagtatcgcgttgcggctgtcggacgcgtgtcggccgcgcgtgtacgagtgggcgatgccgttgtgggcgatgaagccggtgcggtcgcctttgcggaagcggaacgggtgcgtgttcccggtgcacaccctgccgtgggtggcgaggcggaagtgcaggaggaacggggaggtttcgagggtctgccagtggtccatgatgaacgcgagcgtcttcatgttgtcctcgttgcggtagcggtggaggcgttggccgtcgtgccatgcgatgcccgccccgtcggggttggcgtcgctcatccgggcgagctgggtgaggcttggcatggtgtccgcctggctggtgacgatgacgcacatcagattcgctcccttcccgccgtcgtggcgttcgtgtcgttgatggcctgtgtggcggcgacgcggctcatggcccggatgtcgcgggtcttgagcttggggacggggaacttctggaagaaccgccacatggcgtgcatgtaatggacggcggcgtcgagtcttccggaggtgtcgtggtgccacgggccgaacgttcggaattcgatggtgtggcggtgcgtgtcgttgatggcggtgtccttgccgcagtagtcgccgtggatgagctcgcaccagcgggtgtcggtcatgtggcgcatgttcagcgcctcgcattgggtctcgtcgagcgcttccagcgcccagtaccagcgggccggggtctgccggccggtgcggctgatgtgcatgtgcccgcccgacaatgtgttgtcggtgtcggtggcgatgcgttcgacgagtcggcggatttcagcgaggtcgctcatggtcatgggttcgctctggtattcgagggagccgtcgtggtggaggctgccgtccgggcaccagccggcgatgagcctgtggttcctgagcatgtcggtgtcgtggttgccgtccacttcgatttccagtccgaaggtgaacggctcgcggacgggccgtccctcgtacgggtcccggtagcaggggtcctgcgtgttcgcgcaggcgtgccgttcgtagcagtaggggcagtagcgttcgtcgcactgctcgcagtattcctggcagtccgagcacaggcggtcgtcgcacatgcggcaccggtacccgcagtcctcgcacaggctgtgctcgcagtgctcgcagtagtatgcgcagtccccgcacatccgcgaaccgcattcgttgcatgtgcgcgcgcagtcgtcgcatacagtgttgccgcacccgcattcgacggtttccgtccccgcgcagtccccgcatagccatccgtcgcagtcgtggcaccgtacggcgcactcccccgactggcgttcgcagtgcccgcaccgacggtcgtccctttggatgtcatggttgtttccggtcatttgtcacgctcctatgtcgtcttgtcttccggacggtgcgcggcgggaccggatggccgcggcgcggcgcaagccgcgtggccggtcggcccggtgccgggaccgccttcggcggcggcaccggccggcagacacgcggacgcttgcgacgcgccggacgtccggtcatgctgtgtgccggccggccgggccggggcccgccttcgatggcgggaccccttttcgacgtgctcccgccggatggcggggcgcggcggcggatccgcgagcccttcggggcgagctccgttttcggcggcgacccggatccgactggacagggattcccaaaacaggtatcattgtttcctgtagtaggaaatcaaggtctggagggatcatggacggttcgttgtcgcggatgcgcgggaaggcggacttccgcctgatgcgggagctgctgggattgccgcaggagtgggtcgccaagcgcgtgggcgtggacgcgcgcaccgtccgcaactgggagagcccgaggtacttctatccgccgaagcgcgaggcatgggacctggtggagggcctgtggcggcggaccgacgcgaaggcggccggcctggtggagatcgcctcgtcggcggcccgcgtggcgcgggagcgcggcgtcgagccggcgccgctcatgctggcgtactggcgtgacgcggcccagtgggcgaaggcccatccggaggacgaggacgcgggcatgtggcggatcgagaacgcggcggcgcgcctggccgcggaccggctgcacgccatgggcctgccagtcgcgatcgcgtacgcggagcccgaggcgtgacggatgccccctatctcatgtcacgatagggggtatttgacttccatggttcgattgtatagtttggaatcaaggccttggcccatgctcctcttcccgtccggaggtcggggttgaagccgaagtcttatcggaggattggctgtccgcggattccccatgaaccggccgtgcggaacatgcgttgcgagaattgggagtctagcccctgcgaacgggtgatacggatcgacgcgacggcatcgattcgagttcgtgtccgacccttttgggtagtcatgcagaagaccgaaacaacagtcctccacaacccgggaacgttaccggtcttgacgttcccgggtttttatcgtctttcggagaggggcttcatgaccgccgcgtcgcatagggggtcggaactcgaccgctcccggaaaaagaaactcattcccatgtatcgcgcggcggccaagaagtacaggccgctgatcggccggcattcccttatcacctgcgaggatggcctcgtcatcgacatcctatgggagaagcgcaacttcgagcatctgtgcggcgtatggtgcgacaggccgccgcaggtggtccatgccggaaagaccatagaggccaattatttcttcgaccagctgatcaagggacgccttccctcctcggccatacattactccgattatccacggacaagaggcaaggccgaggtgctttcgaacgcgttggaccttgaaggcaacgtggatgtggtggtcgactccgacaaggccgaagtggtgtattacctcggcggcgaggcgtggtgcctgggattggattccgattggaacgggaaccggatgcggtcgggcctttgcaacggcaacgtgttctaccccaagagcattcgccgtcagtccgtatataaacgaatgaggacggacagcatcccccatcgcgtttcagcggtggaactggtcagcccctgagtccttgccgacgtacgcccgaagccttggcagcgatcgcatacgcggagcccgaggcgtaggacacgaacggcccatccgacatccgccgtcgcggccgtccgcgtccgacaacagatcctcattgactcttacgtacaaacgccgtacggttatggcatgacggaaatcaccagcaaggccagccgcttcgagatgcggctcacgccatcacagaaggaacgcctcgaccgggcggccgagttcaggggactcagcacctctcaatgggcgttgaccaacctgctcgtcgccgccgaccgggacatccgggagtctcatgtcctccatttggatgacgaggcgtgggattcgttcgtacgggccctggacgagcccatgccggaggagatggtccggctgctcgagagcgagccgatctggaaatgaccgatttcaccccgccgcggcgtctgaccgccgaggacgacgccgacggtttcgactgcggcctgccggttgtcaatgactggctgcggaaccagttgagaaatgccggcaagcagcatacggcggtcgcctatgccacgttctgcgacggcgcgccggccggtttctacacgttgggcgcgtacagcatcggccatgccgaggccaatggctggctcaggaggaacagcccggatccgatcccggcgatccttctgggcatgctcggcgtggccatgcgctaccagaccatgcacgtgggggcacagctgctcagggacgccgccatgcgggcgatgggtgcggcggagatagtcggagccaaggcgttgctcgtggagccggcctcggacagggccacgcgcttctacgagcattacgggttccgccacatcgaacggtcgggcaggatgttcatccctctccgttcggcgtgaacgggatgcccgtagaagagggaggcggggagggccgtggacggttctccccgcctccttgttttctctcgaatcgttttcgtcggcccgccgttcatttccttggcgggcgcgctctgccgtccgagtcgaattgggcgagctgtccgatggcgttgccggtgttggccagggccccggtgagcagtcggatccgttcgccggtgtcggcggtccggagggcgagtctgagctggtcgatggccgcgttcacgtggttgcggtagacgaggtcgtcggccgcgtccgaatgttccgttttcgcgggccggggttcgtccatgcgtggtttcccttccggtgtttggtccatgaggtcgagcgcccggacgccgaggccggcggcgaggtcgaggatgatgcggctgcgtttgctgccggtggcccatcggcgggtctcgatgcctccgatggtctgcgtggtctgtccggcccggatggcgagttcggcctggctgagaccttgtcgcgtccggtgccaggcgaggcgggtgccgtcccatccggcgggcggattgtccgtggcatggtccggttcgggccggccggctagcttttccatgctggtgtcgagcgcgatggcgacgcgggcgaggatcccggccgccatgttcgcggtgtcgcgttccccggaatcgtattggcgcaggctccggtatggcacgttcgcgtgtgcggcgagctgcgggcagctccatccccgttccgtgcgcatcctccggatcacggtggtcgcgccctccccctcttggggcgtctcgcccgtgagccgggcggggttgacgccgagggtcttcgcccattgccggatctggtcgggttcgagcgtggacagcggggtttcgccgttctcgatccgttcgacggtcgctgtgtcaacgccggtgagccgtgcgagggtctgttcgaggacgctttcccgttccctgatcgcgcgcagttccgccgcgccgatggggatggtcctgccgctgccgctcatctgtcgcctcctaggtagatgtcgaacaggggcccgggttcgacgaggccggtgccggtgtcgatggcctggatggcctcgagggtgccgatcatgttccgtacggcgggtctgcttcgggcggagaacgcgccgtgcccgtcgatgagttcgagtccctgttcggtgacgctgcggcgggtggatccgtgcagggcggcggcgagcacgctcggtctgacgccgtggccgagctcgcgttggatgttcgcgatgtaccggcatgcgatgcggatcgattcgcggcccatgggctcgccctgtccctcccccgtttccggtgccgtccgccgccggcggtacgggttcgacgccggttttttcacgatctccctaccgtcagcctggcagttggagcagttggagcagtcgtcgcgtctggtgccgggcgggtcgaacatggcgaggatggtccggcgcaggcatcggcgggtctcgcagtatgcgctcatggcgtcgagtcgggagtccatgagctgcgcggccctgatgcgtgaggggtcgccggattcctcggcgcggcttttcgcctcccatgcggcgtggcgcagccatcgccagtcgccggggctccagtagaggaccgcgtcggcaggcttgccgtcccggccggctcggccggcctcctgccagtaggcttcgaggcttttgcacggcccgtcgttgaggacccatctgacgtcgggcttgtcgacgcccatgccgaacgcgctggtggcgcagatgacgcgcgggtggccggcgaggaacccgtcctgcacccgtttcttgtccgcgtccctcatttcggcgtggaacgccatggcgtcgatgccttcggaacgcagtgtctcggcgagccgttcgcagcctttccggttctccttgtagattatgccgctgcccttgtgccgtttcgcccaggcgatcatggcctcgaggcgttcgccgggcctggcgcggaccaccgtgaggcgcaggttcggccggtccgcgtcggtcgtgaccgtcacggggtcggccaggtgcaggagttcgcggatctccccggcctgcgtccggcttgcggtggcggtcagcgccatggtcacggggcgcggggacagggagtcgatgaattcgccgatgcgcatgtagctgggtcggaagtccgatccccagtgcagcacgcagtgcgcctcgtcgacggcgagcaggctgatgcggatgcggtggctgaagtcggcgaagtcgggcgcgtgcaggcgttcgggtgcgacgtagaggatgcgcagttcgccggacagggcgcgcccgtacacctcggcgcgttccttctcgtccaggccggagtcgatgagcgcggcgggtatgccgcgtgatcgcaggtgccgcacctggtcgcgcatgagcgccctcaatggtgtgacgacgagggtgaacgtgccgggcctggcggcggggagctggtagcacacggacttgccgccgccggtgggcatcacggccatgacgtcgcggcccgagatgaccgccccgacggcctcctcctggcccgggcggaacgagtcgaacccgaaatagcgcttcagcgcggccagcatgtaatccccgttcccgaccattccgcttcccttcttttcacccataagtttgataccctcaagtatagcatattcatcgccttatgctggggtgtcattcccggctatcgccgtccccgcgcgcattcccgggtgtatggtgcggaagcggggtggcatggtgatcggtccggacggttgtggtttcgacatgcgttcgccttcggagatggaggcggatgacgcgcggcgtgaggcggatgaggcggcgcatgcgcctcgtatggcggtcacgtcgcgtatccgccgggtggcgcagccgccggatgggtatctgccgttgtccctgttcgacgaggttcgtctggccgatccggtgccgttgtatgcgttcgaggacgtcccggcggacgtgacgggcctcgcggtggattacctgtcccgtgtggcgcggggcgtgccggcgcgggatgcgttccgggtgccgttggcgggggcgcggctggtgggccggtctgcggatgcggaacggctgctcgccatggtggacgggttctccgaccgttcggtgcgggccgcgtgcctgctgtgcgggttcgacgcggcgtcgcgtcggggcccggcgaggtggcgggcgggcagggtcgtcgatccggggccggccacggtgtataacgtgcggcgcatggtggcgcgcacgttgaggttcatggaccgggtggggccggtcgtgtgggaggggttcacgttcgacggcggctacacggaccgggtcacgtccggcgacggggacctgctcaccgctgacggcctgtgggatctgaaggtgagccgttggccgccgaacccgacgtacacgctgcagctgctcgtctattggcggctcggcctgcattccacgcatctcgagtatctcggggtgcggcgtctgggcctgtacaacgcgcggtcggacacgatgtggagcgttcccgtggcccggatcggcgccgatgccgtgcgtgcggtggagcgggatgtgatcggctatgcggacggtctttgacgcgtggccggccggttctattcgcgggggttcgtggccgggagttccggcatggggcgggcgagtctggcggccgcgtcggcgagcagccggcgggcctggtccacggtgtgggcggcctcgtgttcgcgtcggtcggcgtccgcgatccttgccttggccttcgtgtcgattcccgcggccttctcctcggctgttttgaggatccggtcggcttcggtgttggcgtcggacaggagtttctgcgcctgttcgcggctttcgccgattctcctgtcggcttcctggtcgatcccctgtttgcgccgcgtggcctgttcgatctgttcgtccgcttttttcttcgcttcggcggtcagggtcccggctttggcccgcgccttgccgaggatggtcctggcttccgtttcggccttgtcgaggatggccttgcgttcgtgccttcggtgtctgtcatgatggttcctttcctgtcggccggtgcgtttcgcatgggtcacccgcgccggccgcgataatcggatccacgtcataggtatacgtgaatatgcgtttttttgatgattcacgtatacttatgttcatgcgtagggagttggcgatgaaccgcctgagggatatggacacgggtttcggcgtgcacgtgtatcgcaagccggatctggcgctggttctcggggaaacgggacaaaggctcgaccgcaccttgtcgagcctggtagcggcgaacgtgctggtccgcgccgcgcgcggcgtgtacgcgttcgcctggtcggcgcatctcggggaggcgacgctgcataccgtcgcacgccggctgcgcccccgacagctggtgtgggagagcctggagagcgcgctgagccgttggggcgtgatcagccagatcccggtggatcgcgtcacgttcatgaccaccggccgtgagggcttggccgtgaccccatatgggacgatcgagttcacgcactgcgcgctcgactggtcgaggatactccccaaccttgtgccgcgtgacggtgggatgacgccgctcgcgtcgaagcgttgggcgtatcgggacctgaaggccacaggccgtaacctggatctcgtggacatggatgaattggagaacgacgatggatgggagtgacatggcgttcgactacaaggcggtcgcggcgggcatcgcgcgttcggaaggcatgggtgccctgcttcccgtggtggagaaggaactgctgcattaccggatactttccgccatgcaggacggcggcttcttcggcccgatcgtgttccaaggaggcacgagcctgcgtctgtgccacgggtccccccgttacagcgaggacctcgacttcgccggcggcacgggtttcggcgtcgatgaccttcgggggttgggcgaatgcgtcaggtcctccctcgccggcatgtccccggacgtgcaggtgaaggttcgcgaaccggtccgggacgagggcttggtaaggagatggcgcatatccatccgcacggcggcgcaacgtcgtgatctgccgaaccagtcgatcaagctggaggtcgcatcggtgccggcgcatgagccgcagacgaggccggtcagggtcaattatccctccgtgtcggcgatcgccggggacatcatcctggcggtggaaagccccatcgagatactcgcggacaagcttctgtcgtttgcatgctcctcccatatccgccgtcgtgacctgtgggacatgtgctggctgtcgtccagggccgacgtggatgcgtctcgggcgttccggatggccacgctcaaggctggggaatacggggaggtcggagaatgggaggcgcgcgcaggccggctgcgtgagatcccgtcggtgttgtcttcggacgcctttctggacgagatgcgaaggttcctgccggcccgaatgctcgtcgccaccgtcgaatccctctcctggcgcgagtacgcctcgcaggcggtcaccgggctgtatgatccctccgggcccgcatgggcgtcgccgtatggctcgccgggtttcgggcggccgatgcctgagcccgaccagtcttccgccgttcccatgtggcgtgacgggggtcccgctctttcctgaggcggcgtcctcgccccattctcatctcatccgcagcgcgcgcagcatgcagcatggggttatggtatggttcggtgacttccatgaggcgggtcggccgcccgtagggcccgtagacggtgatggcgggttcgaccgggcggatgatgccggcgcgttcgagttcgagcagcgggtatgcggccggcgggtcgggattcgggtagaacctgccgtccggcgggatggccccgtcgggctcccaggagacgtccagcttcccgccgggtccggtgacggtcagtcccatgccgccgccctggtggcggccggcgagcaggcgccaggtctcgagcgcgtccgtctccccgccgtgttccgggtcggcgtgccagggtctgccgcgtgtggcgagcaggtggcggcgttccccgtcgaacctcgccgcatccagtcgcctccatgtccaccggtcgacctcgaagcggatgccgtgtcccctgatgagaggcggcacggccccggtgacggggttcacttgcggcctccgcggatgatgtgtctgacgcacatggcgagcaggacgaggtcgagggcggcggtgacgatccacagccatcccatccgcggcatgatcgcgcattcgatgatcaggaggatgaggatggcgaggcatgcgagggcgaggaggatggccttgcggcgttcgtcgtccatcactcccctccgtccgtctcgtcggcccagtattggtcctcgaaccagtggtcgaagcgcatgtcgcccgatccggtggcggggtccgaggcgagtgtggcctcgtcggccgccgggtcgtacaggcggtcgacgtcgaggtcgccgagccagtcctcgagccatgcctcgagtccgccgccctcctcgttgtcgtcgtcggcgacgagcctgacggccctgctgatgaggatctcctcgatgacgctgtgggccgcatggttcgcggtcgggtcggcgaggcgggcgcgcaggcgtatcgtggagccgagcatgcggtagaggaattcgcggtcgtaccggtcgaggtaccggtcgggcaggaggtccgtgacggggttcccgtcgtcctggccgaggtgcgtgccgcggggcatgcggcccagacgtctgatctcgatcctcgtcatggtctcgatcatggacaggttctcgtcgaacagcctgcgcatgcgggtgcccggcatggggtggtcgccgccggtgtcgttgttcataggttccttccttacttcgtgtatctcgtgtattccccgtggcgggtgccgatgagcgtgatctgcgcgtccacgatccttttgcgccgttcgagctcccgtatcccccggttcagccaggcggacagttcgacgcagccgacggtggccgcgtcgcaccggcgcaggtctcgggcgactccctggaccgcgagctggatcacgccgcagttcttgaactgcgtggcggcctgttcgagccggtcgacggggttcgggcccgcgctcatcgggcggtcccgtccgccatgcccagttcgagccgtcgcagccgttcctcgagtgcgttgatgcgcatggtctgggcgagcaccacgctcatcggcgcgggtcttccctccctgccggcgtcggcggccggggcgtgcgggcgcgtcgtcccggcgtccggcggttcgcgcttccaccgggcgatgcaccgttcgatgcgtttgttgccgatgatgcgcgggtccagccccgcctcgcggaagatcctgacggggctttcgccccgccggtagcgtgtgacggcctcgcgtttgaacgagtccgtgtaggtgatgcgcgtgcgggtgacccatgccacggcgtccagtccggacagcaatgccatctcggcgtccgagaaacccgtcatgcccatggcgtccccgcctccggtgcggtccctcccgggattccggacactcgtccggccggtctttccgtcctgtggtcctgcatgtgcggctccttgcctctccggggccctgccttgtggccccttcgcccatgccacccgtggccccttctatatcgggggattcctccgccgcgcaagaccgatcttccttcgtgtccgcagccccaaaacaaaatgttgacaatgacaataaacaacgttattgttgtcaacgtcagcaaaaatattgctgacggctgatagtcgaaggattatcgcagataaaggataagagaacagagccgctccttgagaagctcaaggaacagggatggcgcatcgaagccaagaagaaaggctggatgtgctacccacccgacaagtcgaagccgggcgttcccatacacaagacaccttcggatgccagatggtatgagaattgcttgaaatacctgagacgcggcgggttccacgagtgagcggtcgctaatcttgcggagacgaagtttcctaggcttgtcaccgcaagattagcacaccctctgttcccccatcaaccttcgaccgctagggcggctggatggcgtgcgcccatggaggcatctcccggcgcacgccatgcaatacatcggataggtgaaacatgacgagagcacgagaatggcaggtttcccttgacttcaaggcgagactcgacgaggacgcggcgttcgacctcatggaagccctcggaagatacggggcctcggtggcggtcgaccccgggcacacgggcggcggactgaccctcgccgtcgatgccccggacggggagacggcgctggccaaggcgcgcacgctcctcgaagagaacatgcccggcgcatcggtgacgggactcgaagcgagggaatgggccgacgccgtggcgcgaaaccgcgaacccctatacccgccggtggtgggctacgccgagatcgcgcgcatgaccggcgtcaccagacagagggcgtacgcgtttcccaggatcgaatcctttcccaagccggtgatagagacctcacagggccccctctattccgaggacgcggttcgcgcatgggcgcagacccgcgagctcagacccggacgtccgaaagcgatggaataggaaacgatgcgagagccccgcggccgcacggcgcggggtttattttttacaaggaggaagcggccgttccccgatggattcgtcgggaagggaatcggccgtcaccaggtccggtccggttggatcacgggacgtgtggcccggtccctgagccggaatgattgggtcattcgcgcatgggctccctcgagcatcacggtccaggtcgtcggggatacgatcctgagtccgatgccgttctggaatgccaggatgaggtcgttgcggaccggtgtctgtcccttgttccggttctccacggtgtagcgcacttcgagcaggtccttgcggatggcgtattccacgtccgtcaggagcagcccgtcatgttccccgtattccaatggacagggtgcgaattccgtgcctcggggtacgtgccattccctccattccgcgtgttcttccaagagcaaccccacatatccgacggccaaagcggtcagtacaatcaacacggcgatgacaacaaagctcattttcccctcccgcagaagaaggcatgacgaatatggacgaatctagaagcggacgagcattgaattccgcggaaaaggccgaggcggatgccccgaccaacaagcaggggctcgataccatcggcggcccgacgggaagccgccgatgattgtccgattccgatgaccgtcggcattgttttattgccgatatcgggctgatggcggataatcgggatcatgaaggatggaatcaatcaatgcgggggttccggcatcgagtccgttgatcatttcgacggtgtcggaatcgtcaggatcagaccagtggtcaataaggtggagataaagagggccaagcgtctgattgtcgaacagatccctcatcttgccgatatagaattcccaaagcggccggtcgaggatgacggcacgttgaggcctctttttataggggcgttctccaaggacggcctcataggcgccgccttcgtcacgccaggaatacaggcagcccagtcgttcctcgggtatttctccgcgtcggccggagcgtatcagtgcgcggagcttgtcaggcgtacggtcgccgaagtcgaggggatcgcagtcgtcgacgagtacaggcgcaggggcgtcgcactcgccctgaaaaggtacatcgatgcctgggccgccgatcacggcgcttgtctcgtattgtccgtgcccacgaatgaggcagcgcgtggcctcaacgagaagtccggccaccgcgtcctggagcccgatgtccttctcatgcttcaggtcgtatatgccgacggcggtccctgctcccttccctttgctttggaacgtgggcaggaggcaggatacagttgctgggcattccttccaatcgccaaacctgtttgtgttcaattagttgttgcgggtttagtcacgatgatttttcgggtttaggttttctaggcaatttccaatctaacgggtgttgcactttcatttagacaacgggcccttgcgcaggtgccgtaagactccgcggacaaagcgatgaggcttcccccgcgagaagggaagcctcatattccattcattctattcagcgatgatggcgcctaatcaccgatcatcctttgggaacagcgcatcgaaggcatgttccatcacggacttacggcggatcacaccgacgagtctgccatcagcatccaccaccggcagtttcttgaactgcttcttggcgaggattcgggccacctctccgacatgctggtcgggcgtggcggcaacgaccttacgcgtggcgatgtccatcaccttcttgccggagagcgcctgcaccttggaggccacggtttcgtcgtcgaacaccaccatcgtcgaaccggtgccggtggaaaccgtacgggattcataggtggcaatcgatttcatgacatcgccgtcgctgacgaagccgacgagcctgccatcgccgttcaccacgggaaggctggagacgttgaggcggatgaactcgcgcaccacatgcgtgatgtcatcgctgtccaggcagctgtagggctgatcgtccatgattccgccgatggactgttcctgggcctgcttgaacagggaggcggcgggggccacgtatgcgccggcgtagtgatgctcggcgggctggccttcagtggtttcggccgcgacttcggcggaggcttgcgcctcggaggccttggcgttgcgtgcggccttctccttggcacggctggtgacggtgaagatgcagatgatcagggcgaccagcgagatggcggcgcacagcaggtaggagaacgcgatgccgctggccgtggcggacttcacaccctgggacatgtgcgaggcggtcatggatgtttctgcggtgaccagaagcgaggtcgcaatggctgccgcgatctggcggccggtgttggcgatggcgtttccatgggcgatcatgtcgttcggcaaagcgttgacgccccaagtgttgatcggcatgttggcgatagcctgaccggatgcctgcaatgcgcagaacacggcgacaaacagcactgatgtcctggtgttgatggtgccgagaagaccaagagagatggtcatgagcgcaaggccgccgatacccacgcctcgcgggccgaatttgtcgaatgcggcaccggcgaccggactcaggatgatgccgaccgccgcggcgggcagcatgaccatgccggtgacggtggcggattggccgagcacattctggatgaagataggcaacgtcacgttggttgcggcgactgcggcgttgatcagagtgaccagaatcgcggagttgcggaagttgcgggtggcaagggtgtcaacgcgcaacaatggctcatcgagcttgacttgcttgtatacgaatgcgacgaaggccacaagaccaacgacgattgagataatgacgaccggactgctccatcccatcgtggaagcggacgagaagccatagagcaggccaccgaacgcgatggtcgaaaggatcacggacaggatgttgagctttgggttcttcaactcgccgacgttcttgagcatcatcgtgcctccgacaaggatgaccagtgccacaactgcgatgccaatgaacatcgggcgccatccgaaactgtcaatcaccagaccaccgacaaccgggccgatagccgggccggcggccatgacgataccggccatgcccatggcggtgccgcgcttatccggcggatagacgagcatcggcactacggcgaccaatggcagcagcacgccggagccggcggattgcagtatgcgtccgacgagcaacagcatgaaattcggcgcgacggcacacagcagtgtgccgaccatgaaagtggcaagagctccggcgaagagctttcgggtggagaatttatcaatcagatagcctgaaatcggcaccatgatgcccgagaccagcatgtagacgctggtcacccactgcacggtgccggtggtgatattgaaatcacgcatcagtgccggcaaggccggtgacatgacggtctggttgagcagcgcgatgaacgagccgacgacgatcacgcccacaacgatgaatcgggtgtgcgaatcaataggctttacggaactggtggcggacccgagttccgcggttttctgtgaggtcacagcatttccttctgttggtaacgtcatgtgtggcgatccggccccatgcttgtgtcaagacacgaggacaccgatgagtccggacgtaaaggaaaagccgccatccgttccgcattcatatacggcaaacgattcgcggctttgcgtaagttgatggctatggtgagcgattcatgcgacgtcgactgcggatgggccatcggtacatcccggcataaggcgtgtccccgctacaccagcatcgagaatagggccatttgtggattggcaaacagaacattgccgacgaacgacccacggcaggcgcgtgcgatgaacatcgcgtagcgatacaggttcatggcatctccttgatgagtcttcgtacggcaggcatcgagaagcctatcatcattcaaatcgacggtgaaacccacgcatgctcgacaatacacaaaatcttcacaagaggattgggcttacgcatacgctccgcctgaataacggtccggggatgaatcaggggcgagctaagggttgcgtctcgtgtttccgtcatgatttctggcaaaatagtgaagctgaacatgcgcggaatcgaccggaatcggaaagggactaatcatgcgagttctcggcaatatcctgtggatcattcttggtggattggccatcgcaatcggatgggcattggtgggactgattctgtgcatctccatcatcggcatcccgttcggcattcaagcgttcaagatggcgggactcaccttgacgccgtttggcaaaaccgtgcaatacggcggcggagtcggctctgccttggccaacatcctgtgggtggtgctggtcggctgctggatggcgctcggctatctgggtgcaggcgtgctcaactgcatcaccatcatcggcattccgttcggcatccagtcgttcaaaatggccaagctcgcgctctggccgttcggcgcacagatctacagtttgtgaattactcgaaatcacatacctacaaaaccaaagattgttgctgtaccaacgtctagtcgttggtacagcaattacggcaacatctccccttacaggaagaagtcgtcaatctctgcttcattgtgcaatatctcggtttcagagacaccaatgaatcttgccaaatcaacagatgcggcgaaacgtagctgtatatttaaatcaagattgaatgcataagtctgcagctcccctagtttccggtatttttcgagaagagtttccaatatttgcgcgtattgcacgtcgagattcgcgacgaacaagtccgctttgcgctgatattcagcgatgattgcccgctctcttgcactcaatatgttcttgccaagaccaagcacattcgaagcgacaattgacccgataagcgcgcccacaacgggaacaggaataagcgtctgaccaatcgccgctcctaccgccgcgccggtagcatcaagggcattgatagttaccaagctcaagaaaccgtcatcatcaatctctccggaacggaatttcatgacagcatctatgagtccaaaagttccggacgctatcgcccctgcgctcggagccgaaagatgacagacattggtcaatccataaattgcatagcccgaaaacccgcctttgaaggcaccctctgctgtcttgacgcctccttccttccaatcctcagcggtaaactgccatatttccttgccttcttcgtgcttttgatacacgaaaatgccgaagttcaatccaccttggatagcagcacccaccccggcagctttgttagcctcgcctagattcggctgagctttgtgatatgcagcagccttatccgtattggccttattggagatttcgctcttttgctcggatgtctgccgtttaatattgtcggtttcttcagtaaaagtccggtcaatcgcttctctttggacctgatcatatttcaataccgatgattgcatccatttgtcccaggacagtccccggatgttactttcctcttcgataagctgcttaattttctgcacttggttactggttagcggttgtccgttgagaaagacttctttatcgccatgcatgaccgcacgaaaaatgtccatgtggtcctttgaaaacatcatatccatagaacggtattccgcagatgtcttcagctcgttcattaggttcgcatagaactttacctgcactggcttgccgttaatcaacaaatcagcaggaccattatcattaagcgtaattgttgatttttccaacccttcaaatgctcgtctggcgttagcgattcccgtctgcgcgaattcagcgataaatccatgcataccattttcaccaccacgcccactgttgacaatgttcatgacattttgattcgctaaatcaaggttccttagcgcattagcttgtcgctcggcgagatctttcagctgacctgtttcattattaagaatctgtctcaatgtgtccatcagagtagacacacgtagctgattcaaataatcaatatacgcggcaatgccctgagcaacattgttatcgatggcgtgcttgtcagcagtattcttgtcagtcatcgagttccagttccttgttaatcatttgcgctaaggtgagcgtcatattgaccagtaatcccgcctgcattttctcttcgtgggagaactggctgtaatcggcgcctgtcaccgcagcattcgcacgctgtacaccatctatctgagtttgcgttgcctcagtcaatgccgcgacttcggcattcttcgcattgaatttgcgaattaatacttccacattctggcgctcaagcaaaagcttgtcagcagtttctttgtttttatgattcgcataaataccagaaccaattgccgcagcgcccgccacgccagcgatggtccatccaaccggaccagccaggcccaggaacgcggttccggctgacatgccaccgccacctgcagccaatgcaccgccaccaagccaagccagagcagcactatttgctgcagctccggataatgcagaaatggcagtaccggtcgaagctacaccgaaggtggtggccacacccattgcagccgtaggtcccatggttgctactgcgattcccaaagcactgagggtggcccctgctccagaccctccttcagctgcttttgcttgcttttctgcctccttaatctcatcctctttattctcgaacgtcgttacttcggtattgatcttatgcagttcaacggcaaattcttttggcgtattagccaattgattgatatgttgttcaacatacttgacatgcacaatagcgatttttctcaagtcatacagcgcttgcgtacttttagctaaatcatccgctacgttttcatagcgttctacggcattgttgtaatcctcgacagccttagctcttagtttggaattaaacaaatcgaccttatcggcactatccttgacgtttttagcgattgagacggtaccctttgccatgctgtcagccgctttgcttacttcgccacttgcgacggccgcagactgtgccacgctccctgcaacagctgccgtcattttgcccgcatcgccggcaagcttacccgcatcgttgacgatcttacctgcccctttggcaacatctttcgtgatttttcccgctgtgccaccgatatttccggctattttaccggcttgtttggtgaaatcattaagacctttgcccaaattatcgaacatgttgcccatggttgttgctccccttttcacgcacctgccatgatgtccgtcatcgacggcaagtgcttcgttgcacttataggccaagtgtactcataattacgtagctgcggtacatgaccatacatgcacactgcgtagtttgacggattcgcgaagaagcccccatgaatgaccaaaacgtaacttgcttacacacaccgtgatttgacggatttggacgtaagaccttatggtgtgcacaccatgattcaacgtatcgcattcagcagcaacggcgtgaacgaacacgccaagcgtcagcagatgaacctgccggcgatgctcgaatgcgccttcaaacagggtttgcgcactgctcagttccagccaataaccggaaacaagcgcagcctgctcgctgccatacaaatctgatcagtacacctctcattggcgcatagctgaatcattgccggtgatatcgagccgactcgttcgcaccatgcctcataaacgcacctgcacgagcatgcgttcttggcatagtcgcaactcaatgcaccgcagcaaaacccattgcataccatcacatattcagaaagaacaacagatcatgaagtatttcactactgacacgcatttcgggcatccgctggtcagcgtgctgcgcggattcaccacgttcgaccctgggcacacgcagtatgacgctctcctctcctcgcagggacgcaaggccgccgaggattgggcgaagggcgtggtgcttgacgattcccggctcaatttccgcaaggccgcagacaccgatgcgcacgatgaagcaatcgtggccaatatcaatcggattgtcggcgaggacgacgagctgtggattttgggcgatatcggataccgaacatcggtccggcatctgaagagctgcctgcgtcagctgcgctgcaggcatctgcacgcggttatcggcaatcacgatgactggtggctggacgatgcacccgcgcgagatctgttcgaatcgattgagccgaacagcacggcggagctgaccggtctcggaattggccgcccgcaggcaacggagaccgtcaatctatcgcatttcccctaccgtgaggatcttgcctatggctggccggatgatgccgtacgtttccgcgatcaggcattgccgttcgacggacatcgtctgctgtatggtcacacgcaccagctgtctccggagggcgcacgccacgaagccctcaacgttggactggacgcatggaatctgcaaccggtaagcgaaacacagattgccgactggttccatgcacacgcgaccgattcaacgcacgtatcaccgctggatatgcccgactcccccgggccggcgcccattgactccgccgcacagcaggaaccaggcggctcggtttcggcagccgaatcataatacaagcaatattggggcgagcagaaccttatgccatcgctgacacctgtctcgccccacagcacaacgaaaggagcttggctatggcaaagctcattattctgcgaggactgcccgcttcgggcaagtccacgtgggcacgctcatggtgtgaggaccccgccaacacgtggccgcattgcgtgatttctctcgatgacattcggctcatgatcgccggctcggcacaggtccgaaaccgactgcaatccgagcacggcaagcgattcaatgacatggtggttgccatgggacggcacatgattgccgacgcattggatgcggggtgggatgtggtggcggatgcgcaacacgctaatccccggtatgcagccgaactggcgctactcgctcaacgtcatggcgcactgtgggaaacgagggattttgacgttcctctagacgaattgttgcgtcgcaatgcggcgcgtgataccgctgaccgtgttccggaagattacattcgttcgtcctggaagcattttcacaccgcgatgttccgcccgttggaaccgggcgatccgaatggaaacctgttggagcgtatgcgcgcggacccttacgttcgggttattccggtgcgcggcgaaacagacgtgtatgcgtgcaatttcactgcagaggcatttcgtgaacatcggtggacggatcgcaccatcaatgcgcgagggctttttgtcggcggcaacggtcaggtggtgcaacgcgggttcgagaagttctttgctgtggacgagacggaggagacatcgttcgcccaagtcgtcaatcacgctcaagaacatccagagtcgttgcccgtgcgcgttgagcgcaaggagaacggatttctcgggctcgtgggcgcggcgggaactcctggattgttccgcttctggtcgaagtcggggcaaacggattattccgcgcttatcgagcgcctgtttccttcagattcagcggtacgtgccgaattgtggcgtatgttgcatgagtggaatgtcacggcggcgtttgaagtcatcgatcgcgagtccgaccggcacatcgttggatacgaatcatccgggctgcgcttgctgcatttgattcgtaatgccgaatcgttctccatcgatgccgctcacgaggaaacgttcactcttgccggcggcttcgtgcggccggaaacggtggcgatctgccattcgccggaagaagtcgcccaggcaatcggcgacgccaaggcaagcccgcatgaaggcgtggtgctatattttgccgacggttggatggtgaaggtgaagtcagaccggtacaagttggtcaaggcgatgcgccctcttatgcaacgcgtgctgctgcgtggtcgttccttcaacaagtccggcgacattgccgatttggctcgccgtatcatcgattacgcacacgaacaccacatcgacctggcctacgagcggcaggcattcggcgagcgcgatatcgatatgaccaaggtcaatgacatcgtggaccacgtgcggtgactgctgagttctagcgcaatatcttctgaccaacgtatgtatcacgaaagcatgtgtcgtgaaagcatgtattgcgctagaaccaaatcattctcgtggaggccggataatgaatctctatgctttgaacatgacgcaccatatgccggcatttccttgcgcgaacaactgttcattacgaacattgtactgatgccgttacagaacagaagagggtgctgtcctagcgccaaccatccgacccggttctgccaggcaccgaaccgattcgacaaggacgccgtgaaagacatcatgttcggacgggatgacacgaagaaggactccaacggagtgaccgtcatcccctattccaaactagacgagcgtgcactcgtggaactcgccgcataatccatctcaatactgcatacttgaaaccgcctatagctgctcttcgtaaacactgaggcggtttatcgtgtctctttgcgtctcgtcacgatgtttatcgcggagcgggtatcgccgacatccgcgacatctatgacaaggtcgtgctcgacgaaatcgatgagagcgatcagccggacggcgacctgttccggaaaggcgatgtggaaatacaggggccgcagggctggtcgtacagaccggaaaacgtccgctgaaaatacaggtatcgaaatcattgaggaatgttctcgtcacaggagtcgacgagaacgcggaagcccaagaaaggtggacgcaaacacctcatctcaacgaggttcatagaggttcgtaacatgaagaaaggtccgggcaaccaacactgctcggacctttccgcaacactccccctcagtcgctttcagcgacagctcccctcagagaggggagccgaggaaaactacttggagacgttgaacttgaactccacaatatctccgtcggccatgacgtagtcgcggccttcctgacggagcttgccttcctccttgatcttggccatggagccgtcggcggccacgaaatcgtcgtaggagacgatgtcagccttgatgaagcccttttcgaagtcggtgtgaatcacgccggcggcctgcggggcggtccagcccttgtggatctgccaagcgcgcacttccttgacgcctgcagtcaggaaggtctgcagtccgaggatgtcgaagcccacgcgggccagctggtcgagaccggactcgctcaagccagcgtcggccagcatttcgcgggcgtccgcctcgtcgagctcggtcaggtctgcctcgaactgagcgttgaggaacacggccggagccggggccacggatgcggcgagcttagcctgcaggtccttgttggccagctcgttgtcgtccacgttgaacacgtagatgaacggcttggcggtcatcagatgcaggtcgtagacggaatccttgtcgaagcggccttcgcgtgcggccttgtcgagcgtctcgccggcttcaaggatggtctttgcctgcttgactgcgtccatgtaggccggctcgatcttcttgcccctcagatccttctccagcttgggcagcgcgttttcgatggtctgcaggtcggcgaggatcagctcggtgttgatggtgtcgatgtcgtcggccggatccaccttgccgttgacgtggacgatgtcatcgtcctcgaaggcgcgcacgacctcgcagatcgcgtccgcctcgcggatgttggccaggaacttgttgcccaggccttcgccttcggaggcgcccttgacgatgccggcgatgtccacgaaggtcaccgtggcgggcacgaccttttcggtgtggaccagcttggccagcacgggcaaacgcttgtccggcaatggtacgatgccggtgttcggctcgatggtggcgaacgggtagttttcggccagcacgttgttgcgggtcagtgcgttgaacatggtggacttgccgacgttgggcagtccgacgattccgatagtaagagacatggttccctagcttagtattaggcttcgatggcgtcgacggccttgatgaccgcaccgcggaacgcgctttcctccagcgaggtcacacccttgattgtggtgccgcccggcgagcagacggcgtccttcatgacgcccggatgggtttcgtttttgaggtatagcgcaccgacgccttccaccatcttcgcggctagacggtaggcggtggcacgttgcaggccgtatttcacgcccgcgtcgccgagcgcctcgatatacatgtcggtgaatgccggtgcgcagcctgcgatgcacatgccaatgcccatatgcgcggaatcaacgcgttcgatgaggctgatcgatgagaacagccgctcgaacacttcggcttgcgtgtcggtcagcgtgttgtcggcttcggtgacgagtacccccttgccgacggccatcggcgtgttcggaatggtgcattggatatgcgccgcgttgaaatcggcgccgaacaagtctcggtatttgtcaagatcccagcccgccgcgatggatacgacgaatttgtcttcgtcggcaatcgcgccgatgactggcttgatgacactttcgatttggtacggtttgatggcgatgacgaccatgtcggacgctgcgacgacttcggccgcgttgtgcaatggctttgcacccactttcatcgtggtcttttccagcttgtcgtaatgcgcggcgcaagccacgatgtcggcaccgtcgacggcgccggctgcgacgagtccttcggcgatggcctgcgccatattgccgtatccgatgaatccgatggttggattggacatggtgtcctccttgtcgtcttttctaatggacgtaattgttttggatgcgatggtttcggagaatttcgggaatgtcagaacagttcttccaggtctcccctgttcaacgcctcgtcgaacaggtgcttgaacaccacggaaccatgtacgccgtcgtgctcgaattcgttggtggtccaatagtgcgatcgtcccacacgggacagcgtatcgaattgcagaccggagtcgacgtacatgtcgtcaaaatagacggcagcctgcagcggaacctcattgcgcgccaactggtcggcatcgtagatcgtgccgaaatgcgtgtcttccataagcacgtccatggctggtttgaacggacgcaacgcacgttcctgctcgaacatccacgggaacatggcctcgccggtgaaattaagcggacgaatgtcacccgcgaattccggatgctcgccgcgcacgcgctgtgcggcccagcaaatcggcgcttccagctcaccgttggcgtagatgaactcctgcaacggccaatacaacgggcgagatgaagtcgcatccatcacggaagacaggaattcgtcagacagttccgccgaggtcgaggccgacccgtcgccgtcaaggaatgcctggtcaagaatccaatgcacgcgttcgaaactcggcttcatgccgaaatcggatcccaagcattggaagcgttccaccgtgagcggatcgccgttcggcaatgtgaccttgcgcgattgcagaatgtcggcgacggccgcggcacgttcgatatcgatcgggtaacgctcgtagaactgcttcgtctttgccgccatgcgcgggaatgtatgacggtacacgtcggtcgcatcggcgggaacatgaggaatgccgcccgtggtgaaactggcgataactccttgcgggaacagcgaaagatacgtcaacgtcaggaatccgccatagctttggccaagcgtgacccaacgtgcgcccccgaattcggtacgacgcagatgctcgaagtcacgaacgatcgaatcggcgaggaaacgcttcaaaaacgcggcaccggccttgccgtcgccatccatgccctcaatcacatgcgtatcgacacgagacgaacgcccagtaccacgttgatccggcaacaccacgcggaaatgcttgatagcctcctcaatccaaccatcggaacttggaccgagcggacgcggaccggaaccaccgggaccaccctgcaggaacacgagcagcggcagatcatcatgcacatgttcgggagcggtgaccacacggtagaacaggctgatcgattcgccatcgaacccatgaccgggctcgtgacccgtccaatccaacggcaccttgatggaacgatcctcaatatgcaatccgggcacgtagtattcgctcagcaacgtcatgcattcacctttcctttggcgtcatcggcatattcaatgcgagtagtgactttttgatggcttccatcccacccacatgcggagacaaccttacctcacaaaagcggctttaccttaccgctatttcattcctgcgcatgatggcgtcacagcatatctggcgctagggtggagcatatgtcgaatctcaagcagcgtctcttgtcatggatgcatggccatgttttcgcaggcgatctcatcatcacgcttgttataggtgttctgctgttcggcgtgaccggcggcatcacctataatccgggattgctgtttgaccttaagccttccacgcagatgacatgggaagcggcaatgcttattccgctgctaatccgtcgatggtggccacagaccggagcgttgctctgcgtggcattgaccttggcgcatctcatattcggcccttgcctgttgggtgccgatattctggcattgttcatgctgtattcagtgatcgtctacggcaatcccaaaaacacgaaagccttcattattctggcgttgaccatcggtcttctggcttcggcgctggcggcatggaccatgaccaatggaccactgctcaccggaggcaaagtgcatacatggagcagctggaatgactcaaatccaaatggcgttatggtcacggaagacactctcggttccatctacacaggaacatccatatcggaagtcgccgacatggtggcgcattccatgctggtgctgacgccgattttcgaagtatgtatcatttccaccgtcattgtagcgttctggcagcgtgcccgtctggcaaccattcgcatgatgcgggaacgcaatgaggcaatcgccgcgcgagaccaggatgaacgcgatatcgccgcgttggcggaacgcgcacgcatcgcacgtgacatgcacgatgtggtggcgcacaccctgtcaatcatcatcgtgcagtctgatggtggtcgctatgcaggcacgcatgatcccgcggtggccagaaacaccatggagacgattcgacacgaatcggaacgcgcactgcatgacatgcaacgtcttctgggagtattcgggggttcaccgcacgccgattataacgatatcggcaatcttgtggaacaagcgcaaaacgtctcccccgacattcgaatccgacggaatatcaccggcaccgccagcccggaacaactcggcgaacaagcctcgatagcttcctaccatgtagtgcaggaggcactgacgaatatccgcaagtatgcggggccgcacgtcgatgtgcacattaaagagtcatggaacaacggtttgctcactttgaccatcaccgacaatggtcatggcgcggcggccaatatcgacgggcatacgccaggttacggcctgctgggcatgaaagaacgcatcgaatcggccggaggctcgttgcaggctggccctaaactcggcggaggcttcgaagtcatggccaccctgccttacggcggtaaagaacaggtgacagaagaaaccggcgaacagtatgcctcggaacagtccgaatcgtgcaacacaactgccatatccagcaaagcgaaactatccgacgaagcaatcgcacctcacacagtcgtcaacatatcggcgcgaatcccagatcagccatcggagcaaacgaaggaaaccaaccaaccgaccggtcgcgatcatcgttcgaatgcccttcaacatttgcgcatcaccgcacccaatctgcatgatttgctcaaatcattgaaactgaaatccgtagaacttgcaaatacatccaattcgcgagggctgaattgggtggaacgtgtttccgcgtggacgcagcgccattatgcgctcatggattccgttggtgccgtggcattggtcatgctgctgaatcgcatgtcggttacgttcttttttgatagttcacctcatgcgcagctctcaaatgcgatcgccgcatgctgcttgctggcgctggctcttcgacgcaggttccccgagacttgcgcgcttattgtgttcgtattgtcagttgtgcaattggtgtttttgggatcgattgaggttggacatatcgtagcgtcgctgtgtgcgctgtattcagccgtattgtatgggcgtgaacacgcatggcgttggaccggtcttgccgccgctacctgttcggtgctgatgggcttgaaaatcgcggctgatcaacacggatacactaccttgttcggcgccatcgccgcttttgcaggcttgacgaaaccggtttcagtcacgtcaagtactacggcggcgttctttaccggcgttatgtatacggttgcagtgctgatgctgtgcgccggcattatggcgtgggcacgttgggctcgttccagtgattcaaacgcactggtgttgcaggcgcgagaggaagcgctggtggccgagcaggagaagcagcgtattctcgcggcgaatatggaacgtgaccgtatcagtgccagcattcaggctgaagtcaccgccacgttgaacagcgtgattagtcaagccgtcgatggtatccgcatgctggatagcgccgaagcacaaggcaaagagcctaccgccgacgagatttccacagcgttcaaagccattggcgaacaggggcgcgccgcgcttaaacgtatgcgcgaactgcttggcgtgcttcgtgagactggtttcagcgatgacgctcatgccggtagcgcgaacgaactgcagttgaggcccgcagcaccgttggaggagcagctgcagcgcgcatctcaatagccgattcaagttttcagggagatttaagggtttgtttcgcgctgtgagcggaacaatgccgataaggtggagagtatgagtgaagaacagaagattcgtgtggtcattgccgatgatcaggaattggtacgtgccggtttcgccatggtgatcgggtcccaacctgatatggcggttgcggcgcaggctcgcgatggtgcagaggctgtggcgttggcggaaacactgcatcctgacgtggtgttgatggatgtgcgtatgcccggcatggatggtattgaggcgactcggcagatcagttcgttgcagcatcgctttgctgccgatggaacgcaatcagaagtcgcccgtaccaaagtgatcattctgacgacattcgatttggatgaatatgttatggctgcgatcactgccggagcttccggttttctgctgaaagatacggaaccggaaacgttgttgaattcgattcgcacggtttttcaaggtaatgcgattatcgcaccgtccgccacgaaacgtcttatcgagaaaatgatggaaggcgatttcatggctgcgaatgttggcgcacatggaaattccactacttcttccacttctgattcgacgtacaccgatccggaattagatgaactgaccgatcgcgagcgcgaagtgcttattgagatcgcgcatggattgtcgaatcaggagattgccgacaagcttttcatcagcctgccgacggtgaaaacgcatgtggcgcacattctgtcgaaaatcaatgcgcgtgaccgcgtgcaggcggtggtgttcgcctatgaaaaccatttggtctgattgatttgttgttttgcgtatgcatgatacgcaaaaagggctcctaccatgtttgtggcaggagtccttttcgttgtgtttgctatgaagcttaggcttcggcgagcgcctcaacaggaggcgtgctcactgccctgcgtgcggggaatacgctggcgagcagtgctgccacggctgccacggcgagtacgatgccattaatgccccattcgaacgggaacaccactttgccgtacatactgaacaccacgtatgcgcccagccagccgaacagtgtgccaagtagtacgcccgagatgccggataccagcgagatgagcagggcttccaccgcgagggagcgtcgcagctggcctcgggtcatgccgatggcgcgcaatgtggcggattctcgggtgcgttcgatcactgacagcgacagcgtgttggccacgccgacaagtgcgatgagcacggccacggcgatcaatcccaccagaagcatcatcatggagtcgatcatgttcgcccatacgatgcgttcggcgatcggtccggtcactgtcgcatcagcgctcttctccaatgcggcctgcatgtcgttgtagatgccgtcaacggaaactcctgacttgtcagtatctgccttgaccagcaacacatgggtggcggcatcgaggtcaccattggtgaaatggctttcatccacgaatccgacagctccatactgtgcggatacgcgacggtagtcagcttggtttgcttgcaatgtcagcgaacgcgtagtgacgccgtcctgattccattcggtggagaaatcagccgtgccattggcgaactgcagttccttgccggtttgcgcattgtatgttggcatgagcacgctatcactgtcgatggaggcgttacccaagttggcacgcatgacctgcttgacctgatcgatgttcttcacaccgaccagcaatgcggacgtaggctgggttccatccgctttctccaaggtcacggaaaccgccggcgcatacaatgtgtcggacacgccgttgatgtcggctacatccttgaccatttgctggctgatgtcatcgcccatggccacgatgtcgacgctataacgggtggcgagcgcaccattcatagtctctttggcgctagcggcaccggttgcgatggtggagaccaaggtgacaccgatgagcagagcggcaccggttgctgcgatgcgtcgcggattcttctgaatgttggcgtgtgcaactgttgcggaaggacctgtcagcgaggccaacgctccaacgcccttcatgagggtcggcatccagaataccgcagtgaccaccatgccgaggaacaccagtgcggcaccggcgatggctatgagcagaatcatcgtgaattgatcgccgctcgcatcctcgccgccgttggtggcctgcacctgccagatggagaatatggccatggcgataccgaccaccaccatcagaataccgattatggctcgcgtaaggctggaacgatggttgtcggtcagttcaatcgggcgcaatgcctccaatggcgttaccgcggtggcggaacgtgcggatcccatggatgcgagcaccgtcaccacaataccgaagagaataggtacgacggcggcttgccaggagaagttgaaccgcataccctcttgcatgatgtcgctgacgcacatgccccacatgagcaggcttcccagcaccacgccaagcacggatgcgacgaagccgagcaccaccgcttcgaacagcacggaaccatacagttggcctttctttgcgccgatggtgcgtagcaaggcgagtgtgcggcggcgttgcgccacgagcacttggaacgtgttggcgatcaccagagccgccacgaacatggcaagcacgccgaagcacataaggaatgtggtgacgatgttggtttggttgccgcttaaggatttgatgctttcgtcactgatttgctgtcgtgacatcagatcgaaatgctttggcagcaacgctttcacaccgttgatggtttttgcggatacgctgtttccatccaaggcaaggtcgagatacaccattgttgttccggtggcgttgaaatcgtccactccctgcattgcggcaagcagattgttggatcctacgatcgcaccaccatagtatgagtaggcgccgttcggatcggatgtgagtcctaccacgcgcacgttgtccgccttggctttgccatcgtcgcctaccgcatatcgggaggtcaggcttacagtgtctccaacgccgacgttcaactgtttcgccatgtcttccggcagcgcgacttcgttggaatccttcggctggtccccttccgtgatattcacggggagcatgttcttctgtgccgcggtggagatgatctcgccgctgacggtgctgtctcccttggaaacgctgacgccggtttccaccgaggcgcggatgccgtcgactccttcgatgccggcgatctggtcgagatgaaagtcgccgacagtgctggaatacgcctcgttgagttccttatcgctcaggtcggagctgttgatgctcaccgcatagttggcgtttccgaacatggcggtcagctgccgtgtcagggagtcgttcatggcattgccgaacaggaaggtgctggcgatgaacgccgtgccgatcatgatggcgatgcctgcgggtatgagcatgcgcttggtttttcgcatgagtttcaaagtgatggaccacatggtggattctgttcccttcttcgaatgcttctacagtgcgtttagcgggaatgtctcgcggaagccacattcattgtggcggcctcacgttccttcatcagcagttcactcatctggtctgctgtcggcttgtttacgtccgccacgatctggccgtcggcgaacacgagcgcacggtcggcgtaagacgcggcgaccgcatcatgcgtgaccatgatgatggtttggccaagttcgttgacggaacgcttcaggaagccgagcacttcggcgctggagacggagtcgaggttgccggtcggctcgtcggcgaacaccagcttcggcttggtaatcagcgcgcgggcgatggccacgcgctgctgctggccaccggacagctcgttcggacgatggttgagccgttgcttgagtcccaaggtttctacgagcagatcgaaccaggcacggtcgggcttatcaccggccaaagtcagcggcatgaggatgttctgctctgcggtgaacatgggcaacaggttgaagctttggaagatgaagccgatcttgtggcgacgtagcaaggtgagctgcttgtcgtccatgcgggtcaggtcggcgccgccgaacaagatatggccggaagtggcggagtcgagaccggcgagcgtgtgcatcagcgtggatttgccggaaccggatgggcccatgatggcggtgaatttgccgcgttcgaaactcacgttcacgccgcgcagggcgtgaaccatattgctgccggtgccgtagttcttgaccaagtcgacggcctgaataacgatgccgcgcgatgcggacgggttctgcacgttcataatgcctctccatattgggccgggccttatgcccggatgatgattccaacttatgaagaaataacggcgcgccccatcgtgcgccagactgaattgggcggtcggccacgcgccggccctcatccttgaggattatgtcgtctcaggtctcacactattcatgcctctgcgcaaacagtgtgaggcatacagacgcaagaaagcccgcactgcatgacatcagtgcgagctttctattccttgggtcaagcgatcaggcggaaggcgccccatgcggctcgatgattcgtgatgcaccccattagcatcgcgccccttctcatcgggccgtcaaccttcctgtcgacctcacttggccaagccggaagcgcgaagggcttcgaagccgcccttcaggtcatcgaggatgtcctcgatgttctcggtgccgatggacaggcggatggtgccttggtggatgccctgatcctcgagctcctccactgtctcctgggagtgcgtggtggaggccgggtgaatcacgaggctcttggcgtcggccacgttggccaacaggctgaacaggtgcaggttgtcgatgaacacgcgtgccgcgtccttgccgcccttgatgtcgaaggtgaagatggagccgccgccattcgggaagtacttcttgtacagctcgttgtccttgcggccttcgatggacgggtgggagatggactcgacttccggaacggtcttcaggtaatcgatgaccttcagcgcgttctggacgtggcgttcgacgcgcagggacagggtttcggtgccctgcagcagcaggaaggccgcgaacggggacagggtggcgccggtgtcgcgcagcaggatggcgcgcacgcgggtcacgaaggcggcgccgccgagggcctcatagaagttcaggccatggtaggacggatccggctcggtcagggtcgggaacttgcccggcacttcggcccagttgaacttgccgccttccacgatcacgccgccgagggtggtgccgtggccgccgatgaacttggtggcggattccacaacgacgtcggcgccgtgctccagcgggcggaacaggtacggggaggcgaaggtgttgtccacgatcaccggcaggtggtgcttgtgggcgatggcggtgatggcctcgaagtcgggcaggtcggcgttcgggttgccgaaggtctcgaagtagacgagcttggtgttctcctgaatggcgtcctcgaactcctgcgggttctcggcggagacgaaggtggtggtgatgccgtcgcgcggcagggtgtggcgcagcaggttgaaggtgccgccgtacacgttcttggctgcgacgatgtggtcgccggactgggtgatgttgcgcaccgcgtattccacggcggccgcgccggacgcgacggccaggcccgcggtgccgccttcgagggccgcgatgcggtcttcgaacacgccctgggtggagttggtcagacggccgtagatgttgcccgggtccgccagtccgaagcgggcctcggcgtggtcgaagttgtggaagacgtaggaggtggtctggtagatcggcaccgcgcgggagtcggtggccgggtcggcctgctcctggccgacgtgcagctgcagggtttcaaaacggtacttcttgttgttctcggccatggtattctccttggttgtgctaggtcgcgaggatttttccttgccacccgcctgccgtgttcgggcggttggcgaggtgttggttatgaagttacgacgcttgggccgcgcggcgcaagctgaacgttatcggacttgcctataagggcttataaagccttggaatcattgacgtgagcgactgtcagaagtcacgaaaaagtcgttgaaattatcgcgacacgccgggccgcacgcatgcgctttcaaggtcgactgcggtcacggtgatatcgctgccatgcctttcgcgcatggctcaagtgtccgtgatgattgcttgttccacccgtcaccaagacggtttgcccgctcggtgatgacgtctgtttcatttttctgccgcccggttacatggtttacatgacgaacgactacagtcaaacatcgccaatgaattattccgccaacatggtgaagggattcgaacagacatgaccgatgtaactctgtatgaccgtgatccgaactatattccgcgcgtggccgccgtgcacgacatgtgcggctacggcaagtgctcgctgaccgccgcgattccgattctctcggccgccggctgcgatgtgtgcccggtgccgaccgccctgttctcggcgcacacacgctatgcagtgttcacgttccatgacaccacggatattctctccggttacttggatgcctggcagaaggaagacgtggagctggatggcgtgtattcaggcttcctcggctcccccgatcaggtggcgatcattcagcgtctctaccgcgaatatccgaacgcgctgcgtctggttgacccggtgatgggagacgccggcgaaatgtaccccacgtacacaccggagctgtgcgaggcaatgggcgcgctggccgatggtgccgacgtgttgatgccgaacctcaccgaagcgagcattctcaccaagcgtgactatcctggccaggatattgatgaggccacggttaacgagctgcttggtgctctgctggagttgggtgccaagaacgtggtgctgaagggcattgaccatggcgatggcaaaatcgtcaactatgtggccagcgcttccaccggtgttgccggcaagatcgagctggctcatgagaagttgccatacatgattcatggcacgggtgacgccttcgcctctgccctgtgcggcgcggtgatggccggccgcggcctggccgagtcggccgaaatcgccggtgagttcgtgcgtcacgccatggtcagcacccgtaaccagccgcatttcgaggatcgtggcgtcagtttcgaactgaaccttggcgaactcaccgatttggtgaagtgaccgcaccttggctcccctctccgctcactgggtctgacgtattcagcgaacaatccgatgggttgttttttcgtcacagggaagtcgactggtgagccttggtaaaccttctgaactaatggtggataaccgagttttcatccacacgttatccacaacacgccaaaccgcgtcatagtatccacatttgccggttgcgcttgtgctcttacataagtaacccgcacagtggaatcatgaacgctttaccacctactcagccgacgacgaagtccggcatcgacgccggtcttgcctttcaccagcccatgctggcttcacctgatccgcaggcaatgctgccttcggaacggattgcggccacgatgggcgaccgcaatctgacgcccaaacagttcggcgcgctcggcgagcagtatgccgccgcgtggctggaggaacacggttggacgaccttgagccgcaattggcatacccgttacggcgaattggacatcgtgatgctcaatcccgagtacacggtggtgttcgtcgaagtgaaatcacgccggtccatgcattacggatatccgcaagaggccattacgccggcgaaacagcacaatctcaggaaagccgcctgcgattggctacttgaccggcgtaatcgggtgccgcattcggcggtccgtttcgatgtcgtcaccatcgtgcttcgggtgggcaggccgctcgtgcatcacattgaaaatgccttctgaagcccccccaaaaaaaacagccacgttgcgaaacacattgtgaaaggagtagacatggctatcggcagcaccctctcagtcggactgatcggccttaaggccttcatcgtccaagtgcaggctttcatcagccctggcttgccatacttcagcatcatcggattgccggatgcatcgttgtccgaagcccgcgagcgcgtgaaatcagcgtgtcaagccactggattcggttggccgcaaacccgtgtgaccgtgaacatgagccctgcggccatgcccaaacgcggttcgtcgcatgatctggccatcgcggccagcgtcctatgtgcggcgggtgccatagggcatgattgcctagaagataccattgtgctcggcgaagtgaatcttgacggctcggtgctgccgattcatgggctgctcccgatcatgctgcatgccgaggaacgtggcgtgcgcaaaatgattgttccccatcgcaatcttgacgaggcttcgatggtggatggactggatgtagtgggcgtgaggcatgtgggtgagctcatcgaactgatgggcggcgatgccacctatacgattcccgatacaccggttaccgacgagaccaccacggatcaatcgcccacaagtcatcccaacgattgtggcgatatgaacgaggttctgggtcaggagcatgccaaatgggcactgcaagtggcggcggcaggcgggcataatctcatcatgaccggcccgccaggcagcggcaaaaccatgttggcctcacgtatgcccggcatcatgtgcccgttgaacgaggcggaacagctggaggtggcatcgattcgatcgctgtgcggcatactgcctcagtacggcatcaccgacatgccgccgttcgaggcaccgcaccacaccgccagcacggcggccttggtgggtggtggcagcggcatcgccgttcccggcgcaatcacacgcgcgcatcgaggcattctgtttctggacgaggcaccggaattcagcgcacgcgccctgcagacgttgcgcgaaccattggaatccgggtatgtggcgctttcccgttcaaaaggcagcacctactacccggcctcattccaactcatcatggcggccaacccctgtccgtgcggatactattacggcaccggcgaacgttgcgcttgccgggaaaaagaccgtatacgttatttctcgcgattgtccggaccgatactggatcgtgtggatattcagatggcggtgccaccagtctcgcgcattgccgcgcaaagcgagccaatcggcgagtccagtgccgggatacaagctcgtgtgattcgtgcccgtcaagtggccaaagaccggttcagacagtatggatgggtgtgcaacgcgcaagcttcgggcaaatggctgcacgccaatacatcgctgaaagcgatggaattggtcaatcgggccctgtccaatcatcaactcacattgcgcggggctgatcgcgccatgcgtctgtcttggacgctcgccgatctggccggccgcgtatcccccactgaacaggacgtccatcagggcatcgaaatgagaacgaggatgacatgagtaacgctactgatatccggcaatctggcggcaccgcaggaagtgtggatcacaccgatacgagtctcgccgtttcgcgcactattcccgtacctcccacggatacgttgtatcgtgccgcgctcacgttctgtcttgatggcgcggatgtgatgatgtacgccacgctcaaaggcgcggaaaacgccgaatccctctggcatgcgttggcgcaatcccatccaagccagccatctgaaatctgcggcccggcgctgtcacgtattgaccgcatgttcgtggacggcctcactcgatggggccgcaaggcgtcggcgaacgcgatgcgctccttccgcaatgcactggcctgctggcataaccgcatgatggacctgccctcgcaagacatcatccaactggccgactggttcactatggatggcacgcaatggattatcggccctggccatccatgttggccctcgcagttggccgacctgtccattcgctccgattgggcgccaccgctgtgtttgtggatcaaaggcgatccacgcgcattgaccagttgcgccaaaccggtcggcatcgtcggttcacgggacgtgaccgaatatggccggtatgtggcacacaccgtagccgaacaggcagccgttgccgggcatctggtcgtgtccggaggcgcgatgggcacggatgcggcggcacattggggagcgttgaatgcgctgcacggcagaatgcccgccaatgtgggcaaaaccgttgccgtattcgccggcgggctcaaccatatcggaccgatgcgtaaccgcacgctgttcgaacgcatcgaggcgcagggtggtgcactgatcagtgaactgtgccccgggacgattcccgaagcccgtcgttttctgcttcgcaaccgcattatcgcggccatgtcttccacattgattgtgacgcaagcccggttgcgttccggagcgctcaacaccgcgggatgggcatgcgaattgctgcgcgaagtgtatgcggttcccggtgacatcaatcagccttgcaacgccgggtgcaataagatgatcggcgaccaccgagcgatgattctgtgtgccgccacatccaccgaggatatatgccatgaacggcataagcccgttatggcagcatgcccaggcatatcgaaatccacaggtcaggactcgtccgaaaacgaggaggccatggaagtgccggcaacgactccgttatcgccagcatcctcggaatcatcggcgtcacaggagtcgtcacaagattcaggtcattcgaaacgttcgaagaccaagcatactcagcctacgcgcactcaatccaaggatgggccggcgagcgcaactgccgattccggtaacgacaaaagcaagggtgaagagcttccctcgtcgcatcagatgccggatcttcgtgtcaagccgaagcccgatcccgagaaggaagcccaacaacgtatcattatcgccaagctgccggaaatggaacgcacattagtggcattgattcgtgaatgccgtaaacgacatctcatcgtcaccccggacgcactattgcgtgtggcgcgagagacggtacccgacgagattcccaatatcggcaccatacttgagctactcggcgcattggagctgaagggagtgatcgagcgggatgccggcatactcaagctgagcagccgtgtcggctaatcggcttccatgacacggctcgaaggctgttcggcgggtgtgcgagaatcgaacccatgagtccgaaacgtttggaagatatgtatgatgcggtgatcgtcggcgccggagcggccggcctgtcggcggcgttgggactgctgcgctcccccgagatcaccgagctcaaggaacaaggcgtggacccgaagatcctcgtggtctccaaactgcagccgctgcgttcgcacaccggttcagccgagggcggcatcgccgcgagcctgggcaatgtggagtccgatgactggcactggcattactacgacaccatcaagggcggcgactggctggtggaccaggatgcggccaaactgctcgccgaatacgcgccgcagaccgtgatcaacctggagcgtcagggcgtggccttctcccgtaccgaggacgggcatatcgcccagcgccggttcggcggccacacgcgcgagttcggcggcgccccggtcaagcgcgccgcctatgcggccgaccgcatcggccaccagattctgcacgccttgtggcagcagtgcgtggccgccggcgtcgagttcgccgaggaatggtatgtgaccgacctggtgctcgccgacgacggcaagcaggcggccggcatcgtggcctttgacacgcattcgggcaagattcaggccatccacgcgcgcaacgtgctgcttgccaccggtggcgcgggccgactgttccacaccacgtcaaattcctgggatctgaccggcgacggcatggccttgaccttggccgccggtctgcagctggaggacatcgaatttgtgcagttccaccccaccgggctcgcgcacaccggcatcctgctgtccgaggcggcccgcgccgagggcggcattctgaggaacgccgacggtgagccgtttatggaacgctacgctccggagcataaggatctggccgcacgagacgtggtctcccgctccatcatggcggagatcgacgccggtcgcggcgtcgccgacccgaaggacccggatggtccgaaggactgcgtctggctggatatgaccggcatcgaccccgaacgtatgaaggaagtgctgccgcaggtggtcgaaaccatcgagcagtacgcgaacctcgatccggccaaggacctagtacccatcaagcccactgcacactacacgatgggcggcatccccatcaccaccgacggcgaggtgtaccgttgggccgacggtgccgtgcaggtagtcgatggactgttcgccgctggcgaatgctcttgtgtctccgtacatggtgcgaatcgtctgggcggcaattctctgctcgacgcctgcctgttcggcacacgcgctggtcagacgatggccgcacgcatcgccgagaacccggttgactcccccatggccgatgattcggccgatgacatgctgaccgatgccgccgatcaggctgccgattctcgcaaagcggagcttgacgaactgctcgccgggccaatagatgattcagacgatggagtgcccaccgccaatccttatcagctcatggcccaactcggatcagtgatggagcaggctctggccgtacgttgcaccgctcagaccatcgatacggcgttgacccagatcaacggtgacatcacaccggttgccgataccttgcgggcccatgacaagaccgccgctttcaatcaggaggtcaccgccatctgggaagtccgtcatctgatcgaactggccgaggtcatgctgcacgcttccgaatcccgtcaggaatctcgcggatccatgcaacgccttgatttccccgaacgcgacgatgagcatttccttgctcactcgatggtcgccgatgatggttcggtaagtttcaagccggtgcacatcaccgactatccgcccaagaagcgcgagtactgatccgctggtggtaatacccaagccgcctagggcttgtggcacaataggttggctaatattggacttgacatcccactgtttcatggaggcagaacatggctgaggcgagcaacacgacggttaccctgcaagtgcatcgtttcacgccgcgacccgagcgtgccgaacgtgcacgcggtggcagcccgtttgccaagaaaggctccccgttcggcggcggctcggattcggcggcgcgccgtcgtccgcgcggcaagcagtgggtgcaggagtacacgattcccgcgcgcccttcggatactgtgttggattgtctgctgaccatcaaacgcaccgtcgacccgacgctggccttccgttattcgtgcggtcatggcatgtgcggttcggacgccgtggccatcaacggcacccccaccctgctgtgcacagccaccatccgcgattgggccaagcaacccggcgccatgcccgaagtcgatgacgaagggttccgacacaccggcaccgaggctgaggaatccgacgattccgcggaaaacgtcgcaaacgcggcggccgcccagaactcagccgcaaacggttcgctgggagtcatcgaactggcgtccctgcccggcttcccgccgcagcgcgacctcatcgccgacatcgaccctatgctcaaccagatcaggaagctcaccccgtatcttcaggcggacggcgtgctcgccaccaccgccgaaggcaaggtggacgtgttcgaatacctgcagaaccccgaacaactcgccaaatacgagctgctgagcaactgcatcgcctgcggcgtgtgcgaaggcgcctgcccggtgtacgccggcggcgacgccttcatcggcccggccgcgctgatttgggcctcccgtttcgtcaacgattcgcgcgacaccaaggccatggagcgtatggatgccatcgacaccgccgacggcgtggccgcctgccagtccgtgcgcgcctgctcccgccactgcccgcgcggcatcgatgtgggcgaggagatgtggcagatcgtggctaaggtccgcgagcgctaagccgcgccgcggctggctgcggcgatcgcctaagcacatgcgtcgatgcatccgctgggtgcccgcacgagagaagacatgaaagaacgaattatggacagaacgcagtacaccaacctcgccaaggcatgggaattcaccgaggaacacgcgcgcgaacgtgaatccgatgcgttgaccgacacccgtacggccgccgacgagtccggccagttgcagggttcggcggcgcaggcccgtctgctgggcatgctggtgcgcatcaccggcgccgcttcggtgattgccgtgggcaccggctcgctggtggagaccttgcagctcgcccatgcactggataacaagggcctgctgactgcggtcgattccaccgcccagggcatcgcgctgattcgcaaggcgttcgccgagctgcaggacgagaccgacaccacgttgcgtgcggtgaacgccccggccagcgtgtttctgccgcgcctcaacgccaatgattacgatctgatcgtggtggcgggcgacgccgagaactatgccgccacgttcgcccaggcctcccgtctgctgcgcgtgcacggcgtgatcgtgttcaccgatgtgctggcgttggaggacggtcagggcggcgtgattaatccggccgaccgcagcgacaaggccatcgccatgcgtgagctgctcaccaccgtcgaagatgacgaaggtttcgagtccacgctcacccctgacggcaccggcctgctcatcgcctacaaaaagtaactctgtccttggctccccccggagaggggagccactctatctcgcttacctcacaattgcgctgacggccacgtccacggcttcgtcggcgtcatcggttacggtgaccagtttcgggtcgatcgtcgagatcatgccatgctcggccaccggaccgttgagccagtcaaagagcccctgccagtattccttgccgtagagcaccaccggaatattcgccaccttgtgggtctggaccaaggtcaataattcgaacatctcatccagtgtgccgaagcctcccgggcatacgatcacgccggaggaatacttgatgaacatggtttttcgcacaaagaagtaccggaagctcatgccgaggttcacccactggttcaacccctgctcgtgcggcaattcgatgccaagtcccaccgatttgccgccggccagtgccgctcccctattcgcggcttccatgatgccgggaccaccgccggtgatgacggcgatgttgcgcttggctatctggctacccatgcgccgtgctgccttgtagatcgattcggtgcgctgggtgcgtgcggagccgaaaatagagaccgcaggtccgagctcggcgagcgccccgaaaccgtccacgaattccgattggatgcgcagcacacgccatgggtccatgtgcagccagtcggtgtcctgatcgggtttcagcaggttggcggtggtgttgtccgagggaatcatctggccgcgtagaatcaccgggccgcgatgataggtatcgcccagcggcgaggcgtcctccagatcgaccgggttcaccggtgtggccgcagcctcagttgccgtctcagcctccaacaccgccgcatcattcgcggctgtggcttccaatggttccatatcgtccacgactgcggacttggatgcggcctcggctagattctttgcttcagcggcctttttgccgtcgttcttcttggatttcttctgcttctttgccatccaatgtcctcctgtacggcgctatcgactcttcgcattctagcgcctgaagctctgcgtacgttttccgcgaaatcatccttgacttcgtgaagaacgtacggtgagtgacactgagcgtacgttttccgcgaaataaggcctcatctcgtgaagaacgtacactgagcgcgtctcagcgtacggttttcacgaaacaaggccaacaatggagtagggaccgtctaagccatcagtggcggaagtcgatttccacactggcggtgccgtcggcgagggtgccggggtgttccgtgggcgtggtgggctctgtggtgtggcttggctgcccgatgccatcaccatcaatcgattcgtcatcctccgcatcagccgctgctgcggctgcggtcttctcgaatcgcttggactgacggctcagcagcacaccggaaatcgcggcggcgatcagggaggccaccagcacgccgaagcgcgcctcagcggaaagttccgcgttcttgtacgccagcgaagcgatgaggaaggacacagtgaagccaatgccgcaggcgacggcagcgggaatcatgtcgcgcacacgcagccccttggccatcttgagcccgcccacatgcgtggacagccatgcggtggtgatgatacccagaggtttgccgaccaccaaagccacaatcagtgcgatgaccagcggcgaggccaacaatagcgggctcatcgactcgaagtgtacgccggtggcgaacaaggcgaagatgggcagggccagcagtgcggagaatggctggagcttgttggcatagcgttcggcacgcggcgagagttcgccgtgcatttcacgagagggggtcagcaggccaaccagcacgccggccagtgtggggtgcacgcctgcctcgaacatcatgatccaagcgaggataccgacgatgccaaccgcgatccacggcacttttttcagtcgtacgaggtatgcccagatggcggcgcatacggcgatgccgatgaaccaataccaggcgttaatcgaggagaagaatacggcgatcagaataatggccagcaggtcgtcgacggtggcaagcgtcatcaggaacgcgcggatcgaaccgggcagggccttggcgaacagggcgagcacggccagcgagaacgcgatatccgtggcggtgggcactgcccagccgtgcgacatctccgagaacgggatgctgctgccggtggtggtcagaatcagcgtgccgggttcaccaggcccgatctgagagaacaatgccgtgacggccaggaacaggatgggcggggcgatcatgccgcccaccgcgcacagcatcggcacggcggccgctttcggattggcaagcgagccggtggtgagttcctgcttcagttcgaggcccacggtcaggaagaagatggtaagcagaccatcctgggcccagtggccaataggcaggtcgagattggtgtaggggatgaacagatgcgtttccgctacggtctcgaacgcatgcgcggtggcgggcagattcgcgagcaccaggccggtgagcgcgaagccaagcatgatgagtccggaaatacggtctgaggcggcgattcgcctgatggtggaccaaagtcccttcttcgcgccggcggtcgtggccatcgcgtctccttgctgcactctcttggatgaaccgtatgtaatagtacggaatatctcaggacgttccgctccgggctgagtcgcgaagggcaaccttagcccaaccctgtgtggccgactcaaccgactcaaacgggccaatacaattggaaaagcctcggaagcatttcgctttcgaggcttactgtgcgccagacaggattcgaacctgcgacctgctgatccgtagtcagctgctctaatccgctgggctactggcgcatgttgtctttcagacaactcgatatataatacacgccgttcagctgaatgcaactcggcgtgttgcggcgagtcgcaccatcccgaccactaccgcaacggcgtatttactggcctcacgcctcgtgtgtacggactcggtcaagcaaaaccgactgcgcaactttgagacgtccctgcggcacatccacggcttcgcgcaggagtttgggcgtgctggaaccctctacggacgccttgtccacaatcacctgcctcacatcatccaaactcggcaactggaacatcgtgtcctgcaacgtacgttcgataatcgaacgcaaaccgcgtgcgccggtcccctgcttgatagcgatatcagcaatcgcccgaatggcctgttctgtgaattgcagatcgacgccgtcgacggcgaacagtttacggtactgcttgatcagcgcgttggctggctgggtgagaatcgccgtcagatcgtctacggtaagttccttcagcacactggtgaccggcaaacgtccgatgaactcaggcaacagtccgaactcggccagatcatcggcattgacctgttcgagcaattcctcgtctttcatgtcggcgtcgtgccaattcgcgccgaagccggtctctcgacggcctaatcgcttgcgaacaatgtccgtcagccccacgaacgcaccgccgcagatgaataggatgccgcgtgtgtccatctgcgcaacgtcctgctccttatgcttgcgcgtgccttccaacggcacggaggcgatggttccttccaagatcttcagcaacgcctgctgaacgccctcaccggacacgtcacgggtgatggaggtgttctcaccggatttgcgggcgatcttatcgatttcgtcaatgtagatgatgccgtgctgggctcggcttacgtcgccatccgcagcttggaggagacgttggagcacggtttccacatcgtcgcctacatagccggcttcggtcagggtggtggcgtcggtgatgacgaacggcacgttcattacgcgggccaacgcctgcgcaagataggttttgcccacgccggtggggccgagcaacagaatgtttgacttggcgacctcgacgtcagccaaagggtcattgctgcggcgggcagcacgcgtctgggtgggaacggattgcttggcttgtttgccggtctggccactgtgcccgttattcccgtcaagctgctcagcggactcctgaagctccatgttgacgcgcttgtaatggttgtatacggctacggataatgcgcgcttggcgttctcctgaccgatgacgtagcggttgagataatcgaagatctgagcgggcttgggcaggctcagcgaattgacctcggcatctttgacacgctcctcggagatgatgtccacgcacagggcgatgcattcatcgcagatggaggcattgggaccggccaccagttttcgtacctgatgttcggttttgccgcagaacgtgcaacggggtacgtcctcgttgtagctcaccacacgtcccatgattctcctttgccgactgcgccgcaccgtcgaaccgccacgctgcgcattatcattgtcatccttgaaatacaatacccccggtcgttgccgaccgagggtattgcaatgtccggaagttttactggcggtgttccaacacctcgtccacgatgccgtattccttggcttcaggagcggtcaggaaagtgtccacttcgatgtcgcggcgaatcttctcgacgtcctggccggtgtgcttggcgagggtctcctccagccattcgcgcatacgcagcatttccttggcctgaatctcgatctccgtggccttgccgaagccttggtcgatggccggctggtggatgagcacacgggcgttcggcagcatcaggcgcttgcccttggtgccggaggccagcagaatggcggcggcggaggcggcctggccgaggcacacggtctgcacgtcgggcttgatgtactgcatggtgtcgtagatggcggtcatggccgtcatcgaaccgccgggtgagttgatgtacatcatcacgtcacggttcggatcttgggattcgaggaccagcagctgggccatcacgtcgtcggcggaggcgtcgtccacctgcacgccgaggaagatgatgcgatcctcgaacaggcgggagtaggcgtcctgggtcttcatgccatacggggtcttctccacgaactgcggcatgatgtaacggttggtcggcgcgggctgggctgcgcgggcggaggccggcatgaaaccggctacgccctgacggccggccaagcggtcggcacgggcggcgaactttgcttcttcacttgccatgagtctcactccccctgctggttgttgccgatggtgtccggcgtggtcacgagcttgtccacgaagccatagtcgagggcttcctgggcggtgaaccagtggtcgtattcgttgtcgcgatagatttcctcgagggtgtggccggtctgctcagcggtcagctcgctcatggtcttcttcatgtccatgatgagctcggcgttgatgcgcacgtcagtggcggtgccgccgatgccgccggaaggctggtgcatgagcacacgggcgtgcgaggtcaggtaacgcttgcccttggtgccggagctcagcaggaactggcccatggaagcacacatgcccaggcccacggtcgccacgtcaggctcgatgagctgcatggtgtcgtagatggccatgccggcggtgatggagccgcccggcgagttgatgtacagccagatgtccttcttcgggtcttcggcggccagcatcagcagctgagcgcagatgcggttggccatatcgtccttgacctcttcacccatccagatgatgcggtctttgagcagacggttgaaaatcgggtcgacggggccggccgggacgtcatcgcccgccatgaccggcaaggtcgcaaaggtattgctcaccttgattctccttctaattactcgaacattgttcagactaccgccttgaagcgactgaaggcggcttttcgcgtgctttttggcgggcagcgtagggatttcggtttattcgagggtgtcgaggacgtcgtcaatgaggaggcgggtctgggaggcggcatcgtcgcccagacgcgggaagcgacgggcggcattggcggggctggcaccggcggctcgcgctacgttggacttgctggcaccatgggccacggctttttccgcgagccgatcgaccagtgaatcggcgacttggcgcatctgttcggccacccataattgggccatatccgcaggtaagtcgtagtcttcggccacatcgctggctgcctcctgaatggcggcccataacaccatgaatggctttcgatagtagtcaatctgctcagtgagcggctcagcggcaagcaattcaagtgccgagcgaatttctgtattttctgacatagctttctttacctcggctcccctctctgaggggagctgtcgccataggcggctgaggggagtttcgaccggggcagctcccctcagagaggggagccagaatatatgtatttacttacgactcagcaaccactttgatatcaacgacgacgtggccacggccatgccgaccggcacaaagaaggtaatcggcgcttcagagagctccatcaccaagcacatggccataagcggtgcctgttgtgaggccgaaagcaacgaagccgcaccgatcaaggcacacgcggttaccgaatcggtcggaaacatcagtatccatacgagaccgagcatcgcacccagcgtggaacctaatgcgatgccgggctgcagcacaccgcccgacgcaccggagcgaatggtcatcagcgtcaccagcgctttggcaacaaaggtgagtgccaacacacccagcaacatccagatattggactgggacagcgggaaaccggcgttcatcacggatccagaagggccgctcccaccctgaagcatggcccagaacgatgccattccagagcccgctcccccgccagaggccgaatcggatacattaccgccgcccgtcagcaagttccatggagaggcggccgctgaagatgccgactgcatggcaccagcagtgccggcggtttcaggaatgaatgtgctgaatccaagttgcgctgcggcacggccgttgcccatcacctgcggcacaacaatcgccaccaaaccggtgatgagaccagccagcgtcatctgccacagaatagccttaccggttggcttgtgcgcttccgcccattgcgaaccttttcggaacaatgcgccgcccactccacatgccgcaccgcagatcagagcgaacagcattaacgttggcgtggattccggttgcatggcggtaatgtcgtagaacaggcaatgccctttgatcgcaaccgccacgaatgcggcaatggcagacatgcccagtccaaacgcaactttttcgattgtcacatctaccaacaggatttcgacggcgaagaacatgccggccagtggcgcgtcatagacgcctcctagaccggcaccggcagccactgccaccaccatgcgccggtcgatgccgtcaacgccctcgatatggaacaggtcgcagaaacgttgcgcgagcatggcgccgagttcgcgtggggcgacttctcggccgatcgaggcaccggagccgacgatgaaaatctgcaataccacatgcgcaatggtttgccagaaaggcattcgctttcccgccacggccttcttgactgagggcaccgcagtcgttttgtgtcgcagcagataccagataatgcctgcgatgctgagtcccacggtcaccgatatcgcacggcgtgcagcgggcacgccgaatggaccaggcaattctgggccttcgatgtagccgagcagcacatgttcaacgccgtagagcaacagggtcagcagacctgctcccacaccgatgagcacgccgagcacaatggtcgccgcagcgagccaaccaaggcgtttgatagtaaccgttggctgcatgtcaacctccgcaccctatgcaacgagtatgccttgggaactcccctcagtctcgccacgctcgacagctcccctcaaagaggggagccaaagaaacagtccttttgccagaataggaagagcccggaaccatgaaacacgattccgggctcaaacaatcacgctaacgcgatgaggctatgctcactcagcatccttggcgtcatccttggcggacagttcgtcggccacggcggcagcagcggaagcggcctcgacggactcggactcttcgtcctcagcggcctcgcccaggaaggcggagaggtccacaacctcgccatcagcggtgaacttgacggcgcgcatgccggcgagcaggcccttggaacggccgacttcctgcacagcggagccaagctggccattcttgatgatggcctggatgaagttgttcggatccatgccgtactgctgggcgatggaagcgaggaagttgaacacgtcggactgggacacctgaacgtccagcttctcggccagagcgtcgagcaccatctgatcgcgcagatccttctccacggtctcctcggcctgagccttctgctccttggtggccttctccgggtccggggtcatgcccttgagctgctcttcgaccatgttggccttgacgcccttcggcaccgggatctcgaggccttcctgcagcttggcgatgaaggcatcgcgagcctcggtggcctgacgaccttcggcgtcctgagcggcagccttgcggatgtcagccttgagctcgtccagagtgtcgaactcggaagcttcggaagcgaactcatcgttcagctccggcagttcctcagccttgacggagttgaccttgaccttcacggtggccttctggccctcgtgctcgccggcttccagcgtgccttcgaaggtggtctcctcgccggcggacaggccgtcaagggcctcgtccagaccgtcgagcatggtgttggagccgagctcgtagctcacgccttcctgggagtcgacggtctcgccgtcaatctcagcagtcaggtcgatgttggcgaagtcgcccttggcggccgggcggtccacgccgaccaaggtgccgaagcgctgacgcagggcctcgaggcgcttgtcgacgtcctcatccttgacttccggcttggagatggcgatctcaagaccgtcgatttccggcagttcgatgtcaggacgacgctcgacggtggcggtgaacttcagcttggtctcgtcgttggcggactgcggaacatcctgcacgtcgaactccggctgagccatcggacgaatcttcttctcatccagggccttggagtacagctccgggaccgcgtcgttcacggcctcaccggcgacggcggcgaaaccgatgcgctggtcgatgatcttgccgggaacgtggcccttacggaagccgggaacgttcacctgcttggcgatttccttacgggccgcatccagatacgggttgagctcttccggttcaacagtgacggtgagcttcaccttggtgggctcgaggttacgaacgctgatcttcacgctaatgactcctcaaaagtcgttatttcttacagttctgccgtaaggcaacctctacatgataacgccacttacggacggtgcaatgagtttcacttgccagttccttgcgccctgctcgatcaggaacgtctcgacgtccacttccaccgggtcttccacccagcacaggttgcgtaggatctgtggcttgatgatcatctcggccggcgtgcgggtgtcttcggcgatgcggttgatcacacgccgcacccgttgcagacggtcataacgctccggatggcgctgttgccacagccgcatggatcggggcgcgttcaccacaccgttttcgtcctgttcgggggcgggcatggtaggccattgggcgggcttcagggccatggctcgatcgatggcctgcttccagaccttcggtttgaccgcacgctgaatcggcgcgtaccgctcgaacattttgtcctgctcggtgccggtatggatgcgcacacgctcgttcagggatcggagcgcgcggaattgggcagcattgtgcggcttgttggtcgccgcctcgatgattgaggaatcggccaataacaggctgggcgcaatatcgtattgccgggcgagtcggtcgcgctcctcccatagggatttggcgatggccaagccccttggatcacgactcagctgggtgatgcgcgagatacgcagccaaggaatcggatgcggtttgcgcggggcaaggcccgcaaccaaagcgtgagaaaactcttcagcggcccactcgtccttgcctgcggctttcaggtcacgacgcatcatggtttcaagttcgataagcacctccacgtcgagcgccgcatagttgcgccagtcgcgcggcagcggacggtaggaccaatcggcggcggaatgctctttggctagcgtgatgccgaggtagtgttcggtgacggcggccagaccaaagcggtgcaggccgagcaatcgcgccgctatttccgtgtcgaacagggctttgggtttgagcccgatttcggcgaatccgggcaagtccatcagagaatcatgcagaatccacgtggcgtcgcccacggcgtcattgaattcattccaatcagctccggcccgggtcagggcgacgggatcaagcaaggcgatgcctgcaccctcacgtttgaactgaatcagccaatcctcgtgtccatagcggaagccggacgcccgttcggcgtcggcggccagcgagcccgtcgcctcggccagcgcatcgcagacacgatgatagccgtccagcgtcgaagtgacatcgggtactcccccgcgaggctctttcagcagtcggggttcggtgtcacggacgtcactcaactggcgtcatcctcctcaaaacggatggtggatctgatgaatgcggcccacgagcggacttgtgcgccggcgtccatagtaccgtccggcccggtcccgtcaagcggggtccatgagacgcgaatctcacacccggcgctggtggagccggccatcgagccaaaagccgtgttttgggtcacggtgactgtgccggataccgaatccggctcgatgccgtcgaaatagtcgcacatgtcatcccagtacatgccgggggtcagagaatcgttttcggcggtttccagcggcagtcgcgcgaacgccacgcaacgccagttggaatcccagtcaatgcgcagctcatgagcataaagcatcatgatccagcctgtggcgattcgtgattcggcatcgctgccaagaccggcggaaaaggcatcgccgagggcacgctctcccgcttcgaattccacgccgataccataatcggccaaggtggaaggcacgggaatctcccgatagcgcacgtcatggatgcgcttcatggtgctgacggattcgacggctgcccatacttcatccggcacaccctgagggcgcacggggcgtccgtcgttggactctcccgtaggaaatgcgtagatgtcggccatatctctagggtatgggcgaacgggccgaatcgtggtatttacgcgcggttcggccctgcaatttaatacacggtgaagccgtggtccttgaactggttggccacccgttcgcgggtggcggcgttgggtcccttctggttctccagcgggtatgggatgcgcagttcgtgccacttcgggcggccaagctggtggaatcccagcacgtcgatgtgttcgacggcatcgccgaaggactcgcagatcttcgccacgttttcgacgttctcttcggagtcggtcaggcccggcacgagcacaaatcgcacccagatcttcttgccggccttggccagtcgctggccaaaatcgatggtgggctgcaaggtgccgccggtgaccttgtgataggtctcctcgtcgccggatttgacgtcgagcagacacaggtcgatgtcctcgagcatctcgtcggtgtagctcgtgttgaggaagccggacgtgtcgaggcaggtgtgcacgcccatctccttggcggcatggaacacacgcgagacgaaggcgggctgcatcatggattcgccgccggagaaggtgataccgccatgcgtggccttgaacaggtccttgtaacgatcgaccttcttgatcatggcgtcaaggtagacgggcttgccgtcgcgcatcttccaagtgtccgggttctggcagtactggcagcgcaacgggcagccggacatgaacacggtcatgcgggtgcccggtccatccacggaggtgttgatgtcccaagagtggacgaagccgatatcgccggatttcagggcggaaaggcggtcacgtcggtcgagtccgattggggattcaaagccggaaaggccacccatcaaagtctgcgaggcataggtcttcgattccttgagcatatgcctggtcgtggtgcggaacgtgggtgttgcgggcatcgttgtcctcctgttccaaatgatgcgaaagtctgtgggaaataaggaaggggtggagccgtgccccaccccttcagttagtcattgccgcggttcgcggggttggtcatcagtcgacgacggcaccctggtggaaggtacgggagatgacgtcgagctgctgctccttggtgagcttgacgaagttcaccgcgtagccggagacacgcacggtcaggtgcgggtacttttcggggtgctcgacggcgtcctccatggtctccttgcgcagaacgttgatgttcgcgtggtagaggccgtggccgttgccggcgtccaggatgccgaccaggttgccgatgcgctcgtcctcgtcgcggcccaggccatcaggggtgatggtgttggtcagcgagatgccgtcaagagcgtcgttgtagtcgatcttgccgacggagaacatggacggcagcatgccgtgggagtccatgccgttctccgggttggcgcccggagcgtacggggtgcccttggcgtggccggacgggaaggaaccggtgttcttgccgtactcgacgttggaggtgatcgtcaggatggactgggtcgggacggcgccgcggtagaccgggagcctcttgacctggcccatgaccgtggagacgacccacttggcgatgtcgtcggcgcggtcgtcgtcgttgccgtagaccgggaactcgccctcggtgcggtagccgacgatcaggtcgtcgtcggcgccctcaacgtactcgtactcgtggccttccagggtcttcgcgtccttgttgtagatcgggtagaccttggcgtacttgacggcggcgagggagtcggcggcgatggacagaccggacatgccgcagccgagggtgcggtacacttccttgtcgtgcagggccatctcgatggactcgtacgcgtacttatcgtgcatgtagtggatgatgttcagggccatgacgtaggtctcggacagccattcgagggccttctcgtagttgttcttgaccttctcgtaatcgagggtgccgtcggcctccggggtaatcggctcgatcacgcccttgtcgatgacctgcatgccggtcatctcgtcgcggccgccgttgatggcgtacagcagggccttggcggagttcacgcgggcggcgaagaactgcatctgcttgcccacgcgcatcggggagacgcagcatgcgatggcagcgtcgtcgccccagtggctacgaatttccttgtcggactcgtactggatggccgaggtgtcgatggagatcttggcgcagaagcgcttgtaggcctcaggcagcttcggatcccagaagatggtgatgttcggctcggggccaggtccgaggtgctcgagggtcagggtgttgagcagacggaacgaggtcttggtgaccatcgaacggccgtcatcgccgaagccggcgtcggaccaggtcgcccagtacgggtcgccggagaagatcgaatcgtagtccttggtacgcaggaagcgcacgatgcgcagcttcatgacgatgttgtcgatgagctcctgggcgtcggtctcggtgatcttgccggcctggaggtcgcgctcgatgtagcagtcgaggaaggcggagttgcggccgaaggacatggcggcgccgtcctgggacttgatggaggccaggtagcccatgtaggtccactgcacggcttcctgcgcggtctgggccgggcgggacaggtcgaggccgtactcgttgccgaggttgatgagcttcttcagagccttgatctgctcgtcgtgctcctcacggaagcggatccagtgctcgatctccggctcggtgaagtcgttgcggtacggcacggagtccttgtcgcgcttcttgaaggcgatgagcttgttcacgccgtacagggcgacgcggcggtagtcgccgatgatgcggccacggccgtaggcgtccggcagaccggtgaggatcttgttgtgtcgggcgaccttgatctgcttggtgtacacgccgaagacgccgtcgttgtgggtcttgcggtacttggtgaagatcttcttgatctccggatccggttccttgccggcttccttgatggcctgctcgaccatgcgccagccaccgttcggcatcatcgcgcgcttgcagggaacgtcggtctggaggccaacgaccacgttatcgacttccggggagtcgatgtagccggccgggaaggcgtcgacgtcggccggggtatgggtgtccacgtcgtagacgcgctgcttgcgctccacggccaggtagttgtcgtcgaggtacttccacaggtgcttggtcttctcggtggcaggagccaggaatgtctcgtcgccctcgtacggggtgtagttcttctggatgaagtcgcggacgtcaatatccttctgccagttgccctcggtgaagccggcccacgccttggcgtcgagctcctcctgggagacagctgcattttccactgcggtcatgtcactccttaaatggggttgtaggtttcgcatcttcacggaacccttggttcaacagtgtagttggcacttgcttgagaaaagctgaaattgggagtgagctatctcacattgtttctgtgaacgctaccattccaatggcttctagatattgatgggactattgcacgtctccagatatgggaaaccgctcatactgtgatgttcgtatgagcggttcggtcttgagattgacagcagaaccgtatccgtcagttttcgaccgtcaatcctcggggcgagcttgtgcgggtttcacgccgtagttcttccagcgccggttctcctcctcccatctggcattgcggtccaccacgatgtcccacgcatgttcggcgtcttccttggtcttgtacggacccatgcgctgttcgatcggtgagaccatgcccaactcggcctgcttcttgacggtgttgaaataccactgcttcttgttatcgtctgtcattggtacctcctcaacggtattacttgctcccgctggcgggagcaatatatgtttattccctgaatgcgttggtgacgggcagtcggcggtcgcggccgaacgcgagggccgtgaccttcggtcccagcgggtattggcggcgcttccattcggcgcggtccaccaatcgcatcacggtgtctacggtgacctggtcgaagccgtcggctaacaggtcggcgcggccgtgcgcgtgctcgatgtatgcggcgagcaccttgtcgagcagcgcgtattcgggcagggagtcggagtccttctgcccggggcgcaactcggccgagggtgccttctcgatggaggagaccggaatcatcacgccgtccttcaacgggatgccggtgttgccgtcctcgttgcccacgatcttgagaccgccgatgccgacgcctgcggccgcggccttgttacgccaacggctgatctcccagacacgggtcttgagcaggtccttgatgggtgcgtagccgcctaccgcatcgccgtagatggtcgagtagccgcaggcgagctctgacttgttgccggtggccacggcgagcagaccgcgcgaattggagctggccatcacgatcacaccgcggatgcgggcctgcaggttctcggcggagacgccatcaaggtcaagttgctgttggtaggcgttgaacaatggctcaatgggctggacctcgtaatgggcgccaatgttggagaccaaatcggcggcgtcgtctttggaaccgtcggaggagtacatggagggcatggagatgccccagacgttctcgccgccgcatgcgtcggccgccatggcggctaccagtgcggagtcgatgcctcctgagaggcccagcgtcacgccggtgaagtggttcttggccatgtagtccttgaggccgagcacgcaggcggtgtatacctcttcgtccgggtcgagttccggaacgatctcggccttggcctgatgttcggcggcggaatcgaagtcccagaacgtcaggttttccatgaacatcgggctgcgttcgataagcgtgccgtcggcgtcgaccacgaagctgccgccgtcgaagacgaggtcgtcttgaccgccgacctgattcaggtagatgaccggggcgttaacctcggcggcacgacgctgggcgagctcgaaacgggtgttggtcttgccttcctcatacggcgagccgttgatggtgagcagcaggtcgatgttcttggtggccaggtcggccaccgggccgccgtcctgccagatgtcctcgcagatggccacgccaatggtggcgccgtccacgtcgagggtcacggagcggtcgccggcggagaagatgcggaattcgtcgaacacgccgtagttgggcaggaagtgcttgtcgtagccagcccagaccacgccttggtgcaagaccaccagtcggttgcgcggcttggaggtcttgcggtcggtgcccacggtgccgaccaccacgaacagatcgccgaggccgtcgtcgttgagctgggtggcgagttcgttggccttgtcccatgcggcttggcggaaggtgcggcgcagggccagatcctcgatggggtatccggtgagggtcatttccgggaaaacaaccacttgggcgtttcctgcggcggctttacgggagtagtcgagcaccttggcggcgttggcgtcaagcgcgccgacgcaggtgtcgatctgggcgagtgcgaagcgaagctgtgtcatagattcttagtgtagccgcgtatgacgtcggattgcctgttcttccggcttggcgtcattcattaggtcgtttttgcgttcattaggtcactgcaatgcgatatcagtcgttgcaatggcgcgattccaacaaccagtatcgccgttcaccgacctaatggacgatgaatcgacctaatgaacgaatgccactcccctcagtcagcttcgctgatagctcgtcctgcacttatggacgggcgaggcccgcgcatatctggttcggctgtcgcctcaccttcggctacagacagcccactgggctgtctgcctaacgcctcagcctccggaggcgagccagaaaaggatttacttcagctcgttgagcacgcgcagagcggtgttgacgtagaagttgacgaaggtgggaatggattcgtcgagacccacgaaatgcgggctatgccagtcggcgcaaccttcctggccgtttgacccgacgaacgcgaacaccggcaacgtcaccttggcgaattcgcagaagtcctcccccgccatcgactgacgtatcggttcgagctgcgcgtagtcgttgacatccgccgccacggccttggcgagacctggatcggagaccagcgggtcttgaaagtcatcccagaccacgtcggcgctgatgccgtatgcctcggcggtgtgttccaccacttccttgaatcggcggccgaccagattgccatccgacttgtggaaatagcgcacagtcccttggaatccggcttcggcgggcaccacgttccacacatggccgccgtgcacttcggtaacggacagcaccagcgggtggaagggcgtgacgttgcggctcacgatggtctgcaggctcagaataatactggcgagcgcttcgatgggcccggtgcccttgtacgggtaaccggcgtgggtgccttgggcgtggagggtcacgcggaatttcacgcagccggccatcatcggctcaacgccgatggccagctggccgggcgcatagttggggttgttgtgcgtgccgataatggcttcgacgtcatccacgagtccggcgtcgatcatggcgcgagcgccttggccggtctcctcactcggctggaacagaatcttgatcgagccggcgaacttgtcacggtgctcggcgagccagaaggcggcaccgagcagaccggtcatgtgcaggtcgtggccgcagccgtgcatcacgccttcattgacggagctgaactccagtccggagtcttccacgatgggcaggccgtcgatgtcagcgcgcagcccgatacgcggcccgggaccggcctcgccctgaatgagccccacaacaccagtctccagcgggttgtgcaggatctcgatgccgtgcgccttgagctggtcggtcagatagatgctggtgccgaattcacggaaactacgctccggatgggcgtgcaggtagtggcggatagtgatgagttcgtggtcgatgtcgatatgttcactcatggttcccgattctagtagcgcgaagaatatattgcggccctcgctccatattggcgagggccgcgatctatggggtcagtatgccttgttattgctggcgtttgagcagtcgtttggcgatggcgttggcgatgccctgcaccacctggaccagtacgatcatgatgatcacggccgtccaggtgacggtctggtcgaacttctggtagccgtaggcgatggcgaagttaccgagaccgccaccgccgatgtagccggccatggcagacatgtcgagcacgccaatgaacaggaaggcgtaggccaggatcagcggtgccagggcttcggggatgagcacggtgcggatgatggtgagcttgccggcacccatcgaacgcgcggcctcgattactcccgggtcgaccggcacgagattctgttcgaccagacgcgaggtggcgaaggtgcacatcaccaccatcgggaagatggcggccacggtgccgatggacgtgccgaccacgacgatggtgagcggctgcatggctgccaggaagatgatgaacggaatcgggcgcacgatgttgacgatgatgtcaaggatgcggtagacgaccgcgttctcgaacaggttgccggggcgggtgccatagagcaccacgccgaggatcaggccgaggaatccgccgatgacgagggtgacgagcaccatggtcagggtctggccaatggattcgaacagtagtggacgcagcacgttccagtcgctacgcgggttggcgaggatgatcatgcgttggctccttcatgtgcggcggcggacgcggcgggcgcggtggcagtatcggccgccagtgggtcatgggcgcggtcttcggcgtaggaggcatgtccggcgactgcgtcggcgtaggccacaggctttgcggcggtgccgaagtcgatgacgtcgctattggcggcgagctcgcgcaggaattcgtccacatgccagccgggcccgttgaattcgtaggtgatggcaccgatggcggtccccttgaccgtgtcgatgccgccgtagagcaggctggattcgacgccgtatttggcgatgagttcggagatattctgtccggatgccttgagttcatggccttgggtgccggaaacgtccttttggcggataagcacggtgacaatgcggcccgaccattcgtgatgcaatcgctcgacccggtcttcctcgggcaggccagacaatgcggtggcaatgaatcgcttggtcaccggctgctggggtgcagcgaacacatcgtatacgtcgccggattcgaccacgcgtccggcgctcattacggccacgcggccggcaatctgctggaccacgttcatctgatgggtgataagcacaatggtgatgccgaattcctcgttcacacgcttgagcaaggccagcacttcggtggtggtttccgggtcgagcgcgctggtggcttcgtcggcgagcagaatctccggattagtggccagtgcgcgggcgatgccgacgcgctgcttctggccgccggacagctgcgaagggtatttgtttgcgtgctcactgaggcccacgaattcaaggagttcgttgacacgacgatcctgatagtccttgcgccagtgatcgagttgcagtgggtaggcgatgttctgggccacggttttggtggagaacaggttgaactgctggaaaatcatgccgattttctggcggatgggccgcagcttggtctcactcagagaggtgatatcagtaccaagcacggtcacagtgccggaggtgggtcgttcgagcgcgttgataagccggaccagtgtggatttgcctgcaccggaatagccgatgatgccgaagatgtcaccgcgatcgatggtcaggctgacgtcatccacggctcgtgcgatgttcgcgccgcgtccgcgtgttttgaattccttcacgacatggtcgaaggtgatgatggggtcgctcatagtgctccctgatgctggttgttggtgtccggtcacggaagcggagcgaatcccgattgttggctcgggtactcgctccgcttggtggtaatggctatggacaggctagtcgtgcgctcgtatcagccgcggctcactgctgggccttggcatccttctcaatgtcggacaggaagccttgcagctcgctggcgctgaacttgtcggcgaacaccgcggtaccgccggagttctcctgcagggcgtcgagcacatccttctgctggtagatggaaacgagcttcttgtaggtctcgttgttcacgtccgccttgcgggccacccacacgttgatgtaggggcgagcctcttcggattcggcgtcatcctggtagatggcgtccttcgggtcgagaccggcatcggccacgtagtcgttgttgatcacaccagcggcgatggtcgggtccttcagggtggtggccacctgttcggccttgagcggggtgaccttgaccttgctcttggcttcgtcgatgtaggccggggtggagaaggcggtccagtcgcccttgagcgtcacgagaccggcggccttgagcacgccgatagcgcgggcctggttggtttcgtcgttcggaatggtgacggtgtcgccctgcttcaggtccttgatgtccttgaccttggtggagtacacgccgagcgggtagatggcggtgccgccgatgggctgcaggtccttcttgttgctcacgttgtagttggccaagtagagcaggtgctggaattcgttgaggtccagctcgccggagtcaagggccgggttttcggaggtgtagtcctggaagtcgacgatgtcgacgtagatgccggccttctcggcgtcctgcttgaacttgacccattcggggttggtagcgccgaccacgccgatcttgaccgggttgcccttgctgcccttggcggacgactcgttggcaccggcaaacgcgcggtagccgaagaacgcggctacggcgataatcgccacgaccacgatggtgatgatgacgttgcgggcggtgtggttcacacgcaccggctcgttattgttaggagcggccggggttgccggctgggttgctgctgtcattggatttcctctctccaaaattgatgtcgggtaacaccataacgcgcttgaaccgcgaaagtgacggaaaatggccgattgccatataggtgtcttttatggcgcgcatgcaatgtccgggattcgtgcgtttgataacccgctataggcgtgccgaacacgccggaaagcacgtcgagaggggctttgacaatggaagctatgactaccgatactgccaatgccgatatccgagccgtattcttcgatatcgatggcacgctcaccagtttcacgacccatacggtgccggattccacaatcgaggcgattcaccggctgcaggccgcaggcgtcaaggtgctgatttgcacgggccgcgcgccttcacagatgcacgtggtgctggataccatgccggtgacgttcgatggcgtggtggcgttcaatgggcagtattgttttgatgacaccggcttctttgcctcgcaggccttggatactgctgatattgaggtgattctcgactggctggaccgtcaccccgatgtggtgtgcaatttcggcgagaaggattacgtgtacttcaaccagtccaatgatctgcttcgcgccacgtggagcaaactgggcaaaaccgcaccgacccggtatttcgaggacccgcgcacccgcgcgctggatcatgagactttccagatcagtccctttgtcgggcccgagctggaggccgaactggtgggactgtgcagcaatgtgcgcggggtgcgttggcatccggatttcacggatctgattccggccgatggcggcaagccgcgcggcatccagcggttcatggcgcattacggcatcacgcgcgagcagaccatggccttcggcgatggcggcaatgacacggatatgctcgcctacgccggcatcggggtcgcgatgggcaatgcgaccgccgagcccaaggccgccgccgactacatcactgacgatgtggaccacgacggtgtgcgcaatgccctgctgcatttcagggtgctacgcgattaaaacatcacaacagttcgctttgttctgccccgccgtgacagggcttatgaataagcaaagggctcgggacgaatcccgagccctttggtgttagcgaactaacaacaccgtggaggtgttatcactcgttgtcgccagcggtagcggcggtagcggtgacggcacccttcttgtcggtgttcacgccggagtacacccagtcggtgtagtccgggtggtcgtagccgttgtcgacggcgaactggaaggcctcatcacggaacttctcgagctcgtcgatcttgtcggcgtacttgtcggcgtcgatcatgcgcagagcctcagcggtcagctcgtagcggtcgatgcggttgacacgaaccatgtcgtacggggtggtggtggagccctcctcctcgtagccgtggacgttgaagttgtcgtggttcggacggtcgtagatcaggccacgcacgtcgtgagcgtaggagtgatacgcgaacagcaccggcttgtcggcggtgaagatgtcggcgaactcctcgtcggtcagagcctcgtcgttctccttggcggactgcagggagagcaggtcggcaacgttcacaaccttgaacttgacgcccagttccttcagcttgtcggaagcagccatgatctcctgagtcgggacatcgccggcggcggcaagcacgacctcggcctcatcgttgttcttggcggtggaagcccaatcccaagcggcggcacccttctcgagctcggcacgagcctcgtccagggtcagccaggtggcagcaggctgcttaccagcgatgatggcgttgatcttgttggtggacttgtagcacttctcggcgatggccagcagcatgttcgcatcggtggcgaagtagatgccgatgacgtggtcgttgtggaagcacttgttcagcaggacggaggtgacacccggatcctggtgggagaagccgttgtggtcctgacgccaaacatgggaggagaccagcaggttcatggaggcgatcggcttgcgccacggaatctcgcggacggtagcctcaagccacttggcgtgctggttcagcatggagtcgatcacgtggacgaaggactcgtaggagctccagatgccgtgacgaccggtcagcaggtaggcctcgaggaagccttccatctggtgctcggacagctgctcaacgacctggccggagacgtgcatgtgctcgtcgacctcgtcggagatgtagccggcatcccactgcttgttggtgacttcgtaggaagcctgcagacggttggaagcggtctcatccggtccgaagatgcggaagtcgcgcgggttgttcttgatgatgtcgcgagtgtaggcacccagggtacgggtggcctcgagctggccccagccgtggccgtactcagccacttccttgacctcgtagtcctcgaggttcggcagcttcaggtcgttgcggatcacaccaccgttggcgttcgggttggcaccgatacgcagctcgcccttcggcatgaaggcaaggacgtcgtccttgacagcaccgttggcgtcgaacagctcttccggcttgtaggactcgagccagttcttgagaacctcgaagtgggcctcggtgtcgcgggcggaagccagcggcacctggtgggaacgccaggagccctcggtcttcttgccgtcgatgtacttcgggcaggtccagcccttcggggtgcggaagatcagcatcgggtagaacggacggtgcacgttgtcggtctgagcggtggccttgatgtcgcagatctcgtcccagatggtctcccacagctcggcgaagcgacggtggatggacatgtggtcctcatcatcgaagccagcgacgaactcgtagggctcgtaacccatgccgtggaagaactcgtggagctcttcgtcggagatgcgggacaggatggtcgggttggcgatcttgtagccgttgaggtgcaggatcggcagcacgataccgtcggtgcgcgggttcacgagcttgttggactgccagccggtagccagcgggccggtctcagcctcgccgtcgccgacgatggccgggacaaacaggctcgggttgtccatgatggcgccgtaagcgtgggacagagcgtaacccagctcaccaccctcgtggatggagcccggggtctccggagcgaagtgggacggaatgccgcccgggtaagagaactgacggaagaacttctgcagaccagcttcgtccttggtgatcttcgggaaggtctcggtgtaggtgccgtccaggtaggactgggaggtaccggccgggccaccgtggcccgggcccatgatgatcacggtgttctggccgtggtcagcaatgaaacggttgatgtggccgatgaggaagttcaggccaggggtagtgccccagtggcccaccagacggtgcttcacatcttcgcgggtgaagggctccttcatcagcgggttggaacgcagataaatctggccgatggaaaggtagttggcaacgcgccagtacttgtcaacgccttcgagggcttcctcggaaaccggagcgttgagcttcttccaaggggtgccaataacaggactcgtcatgtgtactcctgtactcctgcacgtgatcgtgcgattgattatttctgttcggtcacggtccctgacccttgcggtgccaaggttttccgttcccaatcaatcgtcatggtacgaggacaacgcgacttttgaacgatttcttgcgggtgtgttcgaaattgttgcggatatttcagtatttgtgcggttcgactgaccgtttgtcaacattagtttttttcaacatactttttcaaaacggcggaagcatgcggaaatccagcatttggctagaacagcgcacgttcgatttcccatgttcgaaatcggcgtgttgtccgtctacaggcatgtagtttgttcgatttgcgcacatagtctctgcgtgtcggccttgtcgccttgaccagtgataatcaggggtgttcagcccacgtaaaattccaatgaacgttaggggaatatcaatggcaaacggtcctgtgcttgtcgtcgacttcggcgcccagtacgcccagctcatcgcccgccgcgtgcgcgaagcaggcgtgtactccgagctggtccctcattccatgccggtcgacgagatcctggccaaggatccgaaggcgattattctgtctggcggcccggcctccgtgttcgagcccggcgcgccgaccatagacaccaaggtattcgaatccggtgttccggtgcttggtatctgctacggcttccaggtcatggcctatgagctcggcggcaaggtggataaggccgcgctcggcgaatacggcaagacctcagccaccatcgacgacgccgccggcatcctcgccgactcccccgccgagcagaccacgtggatgagccacggtgtggcggtcgaacaggccccggccggcttcgaagtgctggcccacaccgaaggcgcgcccgtggccgccatggcggacgaatcccgcaagctctatggtgtgcagtggcacccggaagtcaagcactccccgcttggccagaagcttatcgaaaacttcctgcaccgttgcgccgcgctgcccaacgactgggatgcctcctcgattatcgaggatcaagtcaagaagatccgcgagcaggtcggcgacgccgaggtgatctgcggcctgtccggcggcgttgattccgccgtggccgccgctctggtacacaaggccatcggcgaccagctcacctgcgtgttcgtggaccacggcctgctgcgcaagggcgaagtcgagcaggtcaagcacgacttcgtcgccgcgaccggcatccgcctcatcaccgtcgacgccgccgacgacttcctcgacgccctcgcaggcgtctccgagccggagcgcaagcgcaagatcatcggcgagaagttcatccgcaccttcgagaaggcccagcgccaggtcctcgaagaggccggcgcccgcggcaaggaggtcaagttcctcgtgcagggcacgctctaccccgacgtcgtcgaatccggcggcggcgacggcgcggccaacatcaagagccaccacaacgtcggcggcctgcccgaggacatcaagttccagctcatcgaaccgctgcgcactctgttcaaggatgaggtgcgcgccatcggcaccgagctcggtctgcccgacgaaatcgtctggcgtcagcccttcccgggcccgggtctgggcatccgcatcatcggcgagatcaccaaggagcgcctcgacctgctgcgcgaggccgacgccatcgcccgcgaggaactctccaaggccggtctcgaccgcgacatctggcagtgcccggtcgtgcttctggctgacgttcactctgtcggcgtccaaggcgacgagcgcacctacggctcgccgatcgtcctgcgcccggtcagctcggaagacgccatgaccgccgactggtcccgtgtcccctacgatgtgctcgccacgatctccacgcgcatcaccaacgaatgccgccagatcaaccgcgtcgtcctcgattgcacctccaagccgccggcgaccatcgaatgggagtaagccgatagggctttgacctgctcttttgagtgccgtggtgtaccgctgagtttcgtttcgtacgagagtcatggcaaaaccgccagcgacggcagtgagtaaaaacgatttcctagcctccgttccctcgttggaacggaggctttttctttgccgttttactccctttcacctgcgatttcgccatttactccccgtgtttcaagacgacaaggcacggggaggtattcgagggaatgggagtaaggatttatcccaagtgagttgacgcgcggtttttgtccccgagggcgaaacggggccgtttcggggcccgtgaaactcaaatcgaactcaacgggcattttttgctgggcgttccaatgttcccgttccgtgggataccctgattctctctgtggtactgtttgtggtgtttcctctggctggcggtatgctgacccgttcggctgtcatcaagcggaaggggcagtgtactttgaggagactttcatccatatgtttgacagtgtaactaccattggcttattgctgacgctggtgatgattttctcgttccaaggcaataccattctggaaaaacctctgcacattgttttgattgcggtaccgctgattttacagaccttcctgatttttgcgattgcgtatatcgcttgccgggttttgaagctgccctacaagattgctgctcccgccggaatgatttgtgcttccaacttctttgaactggctgttgctgttgcaatcgccttgtttggaacgacttcccctgcggcactggcaacgactgtgggcgtgctgacagaagttcccgtgatgctgttccttgtaaaaaaacgcaaataaaacgaaagactggttcaaatatgagtaagaaaaaggtggcatttatctgcgtccataattcctgccgcagtcagattgccgaggccttgggaaagcacttggcttccgatgtgtttgaaagctattccgcaggaacggaaacaaaaccgcaaatcaatcaggatgctgtccgcattatgaaagaactgtacgggattgacatggagaaaacccagtattccaaactgatctcggatattcctgcccctgatattgcaatctccatggggtgcaatgtgggctgtcctttcattggtagagcatttgacgataactggggattagaagatccgaccggaagcgaagatcaagtctttgtcgagatcattcgagagattgaaaaacggattctacagttgaagcagtcccttatttgattgaaatagcactctgcttgtggtataatacagatgatccagaccattgcttttctgctgataacattgggcttgataattttttgataacaggagtccgacaacgccgtataagttggataattggtatcaaattgagcaactaagagtcaaatcccctaaacagtattgtttagaaccagttttactttggcgagtgggagtaaactggagcggattttgcgcaatcgaaattccgtccgtagagtgtcgcagtgtgccgccacgtacgaaaaagcgtaaagccacctgtgatttggggtgagtaaaaactattgagaccctctggaaacaacgttttcagggggtctctttatgccttttgacctgcagtttcagtcatttttactctaaaagcgcgtacaccacggacatggcgacacgcagcggacgaagagtaaaggattttttcgaagagtgaactgtcccagtagtttgtcccaccaccccaaaaacgcccctgaaactcaagtgaaactcaataggagcgcaagggcgtcatcgtgcgagcaccgcagcctgagccgccgataccaggctcgtttgcgacgccgtcgctgcttgcctggatcgtcaacggcaagtacgtcatgtcgctgccgctctaccgcatagagacagacctcaaggcgtgcggcgcgacgatatcgcgccaggacatggcgaactggatgatgaacgtgcacgcgcgctggctggcgaaggtccatgagagaatgaaggtcgagctgctgtcgcatgtcaggattcatgccgatgagaccacggttcaggtcctgaaagagccgaaccgcgaggcgaagaagaaatcgaggatgtggctgttctgctcggcgcgctgcgacgtgcccgtgtatgtattcgaataccacgagacccgcaggaagggcgttgcccaggagtttcttgcgggctggtccggcacgcttaccaccgacggctacaaaccctacttcaatctcggcaaccccaacatcgccaacacggcgtgcctcgtccacgtgcgccgctacttcgcccaaatcgtgaagatcgccggcggcggcgccaaggcggcgtctgcggccagcgttgcgctcgaggcaaggcgcaggatcgacgccatgtttcaaggtcgactccaagttcgacgacatggagccgggtgccaggaaggccgcccgcgacgcggagctccgcccgctcatggaggacttcggggggatgggtgtttgtgttcaattagttgttgcgggtttagtcacgatgatttttcgggtttagctaaacccgaaaaaaatacatgactaaacacgaaacaccgacttgacgaaatacaggatgggcgcgggccagcttcccctagcctcgccgaagctggcgctgcaccgtgcgctgcagtacgccgtggagttctggccctacgtcatgaacgtgctcgaagacgggcacctggagctctcgaacaacgtcgccgagcaggcccagcgaatcttcgtcgtagggcgcaagaactggctcttcagcgatgcgccacgcggcgcgcgggcgtctgcggcgatatacagcgtcaccaccacggccaaggccaacgggctcaatcccaggctttacgtcgagtggctgctgaccgagatgcccaacgccggcgagctcaccgatgaggttgtggactcgttcctgccatggtcggatagggtgcctgagtcctgcaagctcgacccagccgctgccgagaaggccaaagagatgcctgacgacttcataattaacatcgaccccgatgcgttcgacgacgagatggcgaacaacgccgaggagggcctgtagcgacatagcggcctaaggcataccgcaacgcaaagatggaaacgtccaggacttttccatccgtatgccggaatggccctggacgtttcctgctacgcggtcattttgacgcttacgctctaatgcctccaccgcttgtcgcgggcggggtagacgatccaggcggatgcgtagcttgcgataaggcagacaatgacgcagacgatgcttgtctggaacccgaatgagtcattgataacgccccagattacgcttgcgaagccaatgccgatgtcattggcgagcaggaacagggcgtttgcggcgccccagcgctctggcggggtgttctttaccgctacgctttgattaagtggcaggcttatgccagtggcgagaccatagaagattccggacgccaggaagacaggttccccgtacggtgcggcaagtagcataaggcagcagaggatgccgcacgcgacggctccggtcattgttttgattgcaggtacggtgtccatgaaatgctttgaaatcatgcgaatgataatcatgcttaccgcgctgatggtgtagaagagaccggcgtgggtatagccgagagtagtaccgtacagaccggcaaagaagacgccaaagccaaaagtggggcacatgatcatctgtgggatggcgccaggcaatgcgcgcggctcgaagatgttgaatgagtcacgcagggttctcttggacacctggtcgccttcaggacacttttcactgttaattgtttcggatgtagttactgtggtggagctgggtgcctgcccgtcttttgagtcgagttcgagccgggtttccattttgattcggtatgcgctggagcttggcagagtttgccatttactttcatagcgtgcgttgagggcgattacaagccctgcaaacccaaccagggcaaggccgacatagaggttcgttgagggatcggttcctactaggtaaagtgcgaaggctgggccgatgctcatggcgatagcctgtccgaggccgtggtatccaatgccttcgccgagccgttcttgcggtaagacgcttgctgcggcggtcgaggctgctgttgttgctgcgccaaagcccacgccttgcagcaaacggctgattgtgaagaggggatgccctgaacgacagcggacagtgctgttcctgctatgaggatagcgatgccggcgatgataacgagtgagcacttgccgttgtcgataacagggccgacgaacagtcgtgctaacgcggcggcaatggagaagacgagtgcaagtacgccggcaaggctcgcaccgtaaccttggcctgccaggaagacgctggttccactgttgagtccttggcccatgacgaagcaacagaaggtcagcgcgatgataagcacgaaaataagcgaccacagcttcggatggtcgtccttaccgatatttggcatgagaaccctcctatgattccaatacccgtattctacgtctgcaaaaagtgagatgtaagcgccaaaatgaccgcgtcttaacaacccgctgggcttgaggcagaatcatcgcatcgacttatcctagaaactgcctgacgaaggcgacaggatgcttgtcagcaaggcggcaaatcttaacgagagccaaatccaagagcttgcaaatcttcagcgaggcgttgcagcaatatatcagaacgaatggaccgaacctgtcctctgtcacatcgaaccgcatgaacgcggcctagagtactcgccaacacagagcaagcacagcgcgaaggacaaggtttcttctgaagagcttcgctatctcaactcttgtgtgcttaatccgttcaagctcgatgagccaagggaatacaacttctgcgactgtgtgcacaagatggacatacctgactccatgaaggcacgcttgattgagatggcagggactcctctgtcctcgaggaagccactgtttgaatggtgtgcttataggtatttcaatattggacgcatcctcgacgacgccagggatttatctgccgacagcctcaaagagaggctttgctcccatctgctttcaagctggaaattcgaagatgactcctcacccgaaagctggggaccaatccaatacctgttcattcagtcgatgtttaacgctcatctcaacgagctgagaaagaggggtaccggcatcgagacaacggaaaaggcctcagcactcgccgaagtatcagcggtcttatctcaaacaaggccggtgatctaaatggcgtttgaaaatatagagcaattaatgccggatacgaccgaaacgagattggccttcgaggaggcgcaacgcaccgttgctgattgtgcagatgccgcatggcgggatatttcttccggcgatatcctaaccgcgagcatttcaacagttcaagaagccgcagatgacgcctggaaagcatgcgagccaacactcaacgctgcaggcgaaactgtccgcgatggcgcaaggaacggagcttatcttggcggcaggttcgtacttggagttgccgacgttggagaaaacgcatatgtcggtgttcaatcgaatattgaactactggccgaagacgaagaagcagcggtgaaaaccgcgcaaacacacgctgttgacgatgcagccaacgcctggggcgacttcatggaagccgatgagcagatacgggaaatcggagactatgtcgaaactggaggcgaaatcgccactgaagttgcgcttggtgccgtagccgtcaccgcttctgcccctgcagcactcgctgctggggctgtactcgttcttgacgaaatgggaaagagcttggaagccggcgctgaagacggtgagatatctcaggaggatatcgtcggagaagtcgttgcgggaactgttacggcagcaacgcttcttgccggacgaggtctaaataactttcttgcctcaaaggcagcagaatcgggcgcaagctcacgaattctggatgatgccggaaaggcaatttacgaaggcgaccgactgcttcccaataacgagtttgcgatcgacggcgtgaagtgtgcaaccgacgatctcgggcagctttaccgcgttggcgacgacctcgttccgaacatgagctatgagatcaatgggtataaatacgttaccgatgcaatgggtagggtcgaatcggccgaaggcttcttacaactaaagacccacgaaggtcgtttgaccatcaaggacactatccagtcaatcggaaaagggtttgaagagctttttgatcaaagaggccatctgattgccgaccgattcaatggatcaaatggccttgagaatattgtcgccatgggcggcgaggttaaccaaaagcctatgcagcaatcgagcaaaaatgcgccgatgctttggctgatggcgctgaagtgtttttcaaggttgagccactttatgagggcgggtcattcaggcctagctcgtttgctatcacggacattattgacggcgaagagacggttacgtttcttcttaacactgcaaaggaaatgtaatgagtgaaaagaagatgctacaagggatagcttcaattcttgaggaaaccctccccgaagactggagcaaggtcgtgttttacgccgagtacgccgagggtgcgttctctattgagtattacgttgctggcagcggaaaagacgacttcgttaaatgctttgaccaaaaaggcgtttcgagggcatccttgatgaaaaactttatggctatcaacaagttcattgaacctgaaagggccgcgcttaagcccgaaaagagatggggatcgatgacgcttattctccattccaacggcaagttcaaagttgattacgactactccgacatgacagaaaacgcttacgcccgaaagaaggcctggaaaaagaaatatctcgcctagcaacgaacggtctgggaaatcaccgcaaagccacccgtgcatactcttcgagcgcacgcgtcgtcggcaacgtttcgaccagcgcgtttttgggagccatgcaaacccctgttcaacattcctcgggagtgattgctctctatgacgaatgggattccccatcggggaatcccattttttgttgccgacgacgtccggtataatttttccgtttacgacgtcgttcggaaagggatgccgacctctatgcgccagggattcgacaacgaaaaatacatcgagctgcaagccgccaacatcagaaagcgcatcgcgcaattcggcggcaaactctatctggaattcggaggcaagctcttcgacgactaccacgcctcgcgcgtgctgcccggctttgagccggacaccaagttccgcatgttggaaagtctggtggacgatgtggaaatcgtcatcgccatcaacgccaaccatatcgaaaaaggcaagacccgcggcgacctcggtatcccctacgacgaggacgtgctgcgactcatcgacgtgttccgttcccgcggcttcctcgtcggctccgtagtgctcacccaatacgccaatcagcccgccgccgacgcctaccgccaccgcctcgagcaactcggcgtcacctgccgcctgcactacccgatcgccggatacccgcacgacatcgaacgcatcgtttcagacgacggatacggcaagaacgagtacatcgagaccacccggccgctcgtcgtggtcaccgcgcccggccctggctccggcaaactcgccacgtgcctgagccagctctaccacgagcaccagcgcggcatcgacgccggctatgccaaatacgagacgttccccatctggaatcttccgctcaaccatccggtcaacatcgcgtacgaggctgccaccgtcgacctcgacgatgccaatatcatcgacccgttccatctggaggcgtacggcgagaccaccgtcaactacaaccgcgacgtcgaagcattccccgtgctcaaagccatgatggagcgcatcatgggcgaaagcccctatcagagccccaccgatatgggcgtcaacatggccggatacgccattgtggacgacgatgcctgccgcgatgccgcgcgtctggaaatcgtgcgccgctacttcgccgccgccgtgcacttgaagcgcaccggcactggcgaggaacaggtggagcggctgcgctccatcatgaaccgggccggcgtgacccccgatctttctcccgcccgcgccgtggcccttgagaaggaagccgccaccggtgccccggctggtgccatggtgctgcccgatggccatgtggtcaccggcaaaaccggcgacctgttgggcgcggccagcgcgctgctgatgcacgcgctcaaggccgtcaccggtgttgacgaaaccattccggtaatcgacgatgccgccatcgaacccatctgtcggctgaaaaccgagcatctcaacagcgtgaaccgacgcttgcactcggatgagacgctgattgcattgtcaatcaccagcgccaccagtcctgtggccgctcgcgtcatcgacgggctcaaacagttgcggggctgcgacgccttcttctccgttatcatctcatccacggacgaggcgctgtatcgcaaactcggcatcaacgtgtgctgcgaaccgaagtacgaacgggtgagtctgtatcaccggtaagcgccaccgataagcgcggtatgccgcgaatcgtcaagccggtaatcatgcagcatgcggcctgacgattcgctgctgtcgcattgtctctcccctcggccatgctgggcttgttttccgtttgttggagagaacggggaatgccatcagcactacggaaagagaaggattatccgtgaagcggttcgtgggtttagacggtattaaaggactagcgctgatagccattgtgctgtaccactgcatgcagcaacggctgccaggcggattctacggagtcgacgtgttcttcaccgtctctggattcctgattgccgtcagtttgattcgttctctggcgaaaaccggatcgctgaatctcgtgcgatatattcccaagcgtgcagtacgtctctatccggcgctgtttctgctgattccggtcatcgtctccgtcggctggctgttcgatcacgacattctagtttccatccgcgaccaagtcatcaccgtgctgctgggctgctacaactggtacgccattgccggaggccaaagctatttcgaccaaatgaacccgcaggtgtttcgccatctgtggttcattggcgtgctcatgcagttctacgtcatcgcgccgttcatcgtctggctgatgtggaagctccgccagacgaaactgtcttcactcatcccactgggactcgcggcgttcagcagtatcgccatgtgggtgatgtatgtgcccaaaggcgaccccacccgcgtctacttcggcaccgatacccacagcatgggcctgatgctgggtgtggctctcgcctggtgggtcaccgctcctcagttgggccacgctcgccagagggctgtgccgatgccccgcaccattagctcgagcgcttcggcagccgcacatcgggctccgttacctcagattcccgtggagcatcgcatctggaatgcggcggcaccggtattggcgttcctcagcctgattgccttggtcaccatggcggttatcggcaaacaggatgcattcgccttccgcggtggcatcatattgtccagcttgttgtccgtgctgctgattgccggtaccatctccgacgattcctggatgcaaagcctcatggtgttcaagccattggcctccctcggcaagtattcgtacggcatctacctgtggcactggccgttgtggattctttccagcgcccttgccccgaagatcttcaaggcagtagggccttggcctctcatcatgaccgcgttgctcaccgccattgcggtgatgatttcctggctgatggtggagaaaccggcggcaacgcactcggcggtatccgtcgtggtgccccttcgcacgaacaagaagaatcatgtggcccgggttattgccgttgacgttatcctggtgctgtcgttggccggctgcgtgcagggcattgctcatgcacctgcgaaaaccgccatgcagatccagctggagcaacaggccgcacaactggaacgtatgcagaaaaccgaacacgtgctgctgcgccatgccgtgccggcaccgcccaagcccaagcatgagatgcccaccggcgatcagattaccgccataggcgattcggtgatgctggcctcatcacagggcctttcggaagtcttccccggcattcagaccgacgcgagcgtttcccgctccatcatggtcgcccccgaactcatcggcaacgctctgtccgccggcagtctgcggcagtgggtgttgatcggccttggcaccaattcggcaatcacccctgatcagttggaccagattcgtaatatgatcggccccgaccgcgtgctggtactggtcaatgcccacggagaccgtacgtggattccacctaccaaccaggtgcttgccgactatgcggccgcacatccagacaatgtggtgctggtggattgggatgccacagccaacgcgaacgcgcaggtgctcggctccgacggcatccacccgagcatggatagcgatatctatgcaaaggcggtcaaacaggccatcgaacaatggatcgcaagcggcaggtgaacggcaggcaacgctgagttgtccaaccagtcgtgaagaacggctatgctgaagactgcatcaacgagaccacacgttgggagacatggtgagcgcaatccttgaagggaagcccgataagaatcttattctcgttacgggaaggattcatccgaagttggctgaggatgtcgccgagcagctcggcatcgacgtccttgaaaccaccgcatacgatttcgccaacggcgagatgtacgtgcgctacactgaatcggtgcgtggcgccgatgtgttcgtgctgcaaagccactacaagcccatcaacaaggcgatcatggagcagctcatcatgatcgacgcattgaagcgcgcctcggcccgttccattactgcggtctgcccgttgctcggctactcccgtcaggacaagaagcaccgcggccgcgagcccatctcctgccgtctggtgttcgacctgctgaagaccgccggtgccgaccgcatcatgtcggtcgatctgcatgccgcgcagtcccaaggcttcttcgacggcccggtcgatcatctggtggccatgccagtgctggtcgactacatccgtgatcgtttccagggccatctcgacaacgtcgccgtcgtctcccccgacgccggccgcattcgcgtggccgagcagtgggcgcagcgtctcggcggcggtccgctcgctttcgtgcacaagacgcgcgacatcacccgcccgaaccaggcggtcgccaaccgtgtggtcggcgacgtcgccggcaaggactgcgtgcttgtcgatgacctgatcgacaccgccggtaccatcgcgggcgcatgccacgtgctgcaggacgcgggagccaagtcggtgaccgtggtcgccacgcatggcgtgctctccggcccggccatcgagcgactcaagaactgcggtgcgcgcgaggtcgtgctgaccgacaccgtgccgattcccgaggaaaagcgctgggatggcttgaccgtcctgtcgatcgccccgctgctggccagcgccatccgcgccgtattcgaggacggctcggtcgccgaactgttcgacacctaccccgagcaccacggtcaaggcttcctgttcgcctgatcacgtgcgtgtttgttcgtggaaagcacacgatgcgagacgcgacatggcgtagcctttcggtaaataccgacagtatggtataaatgaacacttgtgggccgaaagcccacgactcccccatggtgtaatggcagcacacgggtctttggaaccctttgtcttggttcgagtccaggtgggggaacggctgacggccgctcgacatccgggcggccgtctattgttttgaggtgtttccaccctcaatagacattccgatcgaagggaatacgtcagttatggcattatccgcagccatcgtcctcgccgccggcgagggtacccgcatgcgttccaacaagccgaaggtgctgcatgcttttgcaggcaagaccttcctgaacagggtcatggattcggtggccgccctgaatcccgacacgttggccgtggtcgtgcacttccaggccgagcgcgtcgccgaagccgcccgctcctatgacgagcaggtcaccattgtgaaccaggacgacattcccggtaccggccgcgccgtgcagtgcgcaatggcgcagctcaccgaggctggcaaggtcgatggcccggtgctgatcgccgcctccgacatgccgctgctcgacagcgagacgctgcaccgtctggtcgaattccacaccgcctccggcaacggtgccactgtgctcaccaccatcctcgatgacccgaccggctacggccgcatcatccgcgatcgcgaaggcaacgtgctgcgcatcgttgaacagaaagacgccaaccgcagcgaactcgccgtgcaggaagtgaacacctcagtctacgtgttcgaggcttccgtgcttaccgaggcaatcgccggactgaagtcgaacaacgcgcagggtgagttctatctgaccgacgcgctggaaaccgccaaggccgctggcaaggtcggcgcgttcgccgctccggatccgctcaccgtcgaaggcgtgaacgaccgcgtgcagctggccgcgctgtccaagacctacaaccgccgcgtctgcgagcgctggatgcgcgacggcgtgaccattcttgacccggaaaccacttggatcgaggacgatgtccagatcggccgcgacgccaccatcctgcccggctccttcctgcaaggccacacggtggtcggcgaggacgccatcgtcggcccgtacaccaccctgatcgacgcgaccgtggacgaaggtgccgtggtcgagcgttcccgcgtacaggaatcgcacatcggcgcacgcacgaacatcggcccgtggacctacctgcgcccgggcaacgagttcggcgaggatgccaaggccggcgcgttcgtcgaaatgaagaaggcgcacatcggcaacggcaccaaggtgccgcacctgagctacgtgggcgacgcccagcttggcgaccacaccaacatcggcggcggcaccattaccgccaactatgacggcgtgcacaagaaccgcaccaccatcggctccggctgccacgtgggtgccggcaacctgttcgtggccccggttgaagtgggcgacaacgtgaccaccggcgccggttccgtggtgcgccacgccgtgccgagcgacacgatggtctactccgagaatacgcaacacaacgtcgagggctggaagcccgcctgggagcgctgaaccatgcccgcacttcaggattccatcaacgccgtccgcgtggccgccgaggccgcggaccgtatcaaagccaccgacatcgtggccttcgacgtagccgacctgctcggcatcaccgacatcatgatgatcgccggcgcctccaacgagcgtcaggtactggccgtggccgaggaaatcgaaaaggacctgttccttaagtgctccggccgtcagccgcgctctcgcgagggcctgaccgagggccagtgggtgctgcttgactacggtgatttcgtgattcatgtcatgcacgaggaatcgcgcgaattctacgggctcgaacgactctggcgcgactgcccggccatcgatcttgaactcgcacacccggaaacggcggagcatgcggaagatgctgccgtcaccaccgcgtaacgtgcgaatcacataacgctgatattcgcgtgtcgggctgcctgttgccaaacatcattgacggcatcaggcagccctcccctttttcctgtttcctcactggaaccgaaaggatcgtcactatgaccaatcatgttcgttccgttttccttatccgtcatggacgcacctcctacaacgccgctcacaagctccaaggccaggtcgacattccgctggacgccgtgggtgaatggcaggtcaagcagaccgccgcggccttgaaaaggctgtacgtcgatcgtcggcaggaaatcaaccaccggttcattgtctgctccgatttgaagcgtgcgcacgccaccgcgcaagctttcgccgacgtattgggtggaatcgagcccgtcgatgatcgtcgcgtccgtgaacgcagcttcggtgattgggatggccatgccgtggccgaactggccgaacgctaccccgaggacttccgttcctggatggaatctcggggcggcgagctgaagtatggtgccgagcccaaggaagctgtgggcaagcgcggcgtagaggctcttgaggactggtccacgcgtgccggagacgacacggacctgttcgtgttctcgcacggcgcatggattgcgcagacattgcagaccctgttgggcatttctgcaatcgatccgaccttttctacggtggtttcattgcgtaatgcgcactgggtgcgcttggtgccgatggacaatcccgatggcactgtgcgctggcgtctgctggactacaatcacggtccggccatcgccgacaccgacgagtgggaacgcgaacgctgatcgtgtcacggctccctgctgagccaacaggttcagtgtattcgaaaaaccgttcaagcagtaattgaataacccaatgcctgaataatggcggaaacaagccaaaaagtgtcgccaaatcccacttttgccatttggcgacacgccggcttttgccagaatcgacatctcgtcgtaatgtatacgaggtccaaacaacgggccaacaattgaaaacggggctatagcgcagctggtagcgcatctccatggcatggagagggtcgggggttcgaatccccctagctccacgacgaagccatcaaatcaggcgatatggtggtttctccgctggttcatggcgggtcttgcgactcccatgaatcggatagcttcactcggggctatagcgcagctggtagcgcatctccatggcatggagagggtcgggggttcgaatccccctagctccacaatcaaggccggtgcttcatgcaccggcctttctcgttttctggcctatcggccgacttttgcgcaacattccccggaaagcgtcgccaaggggacgctcttccgattggcgcgacaccggcgtgagcgataacagtaatcgccactacaatgaggtgtggtccctatcgtgttgattatcaaaggagacaaaaacatcgtgaccgtcacccgtgtatatatcgccagccctgaaggcgccaatggccgcaacgtcgtcgcttacggcatgctcaacgcattgacttccaagtacaagaccatggtgttccgccctgctgtgtccaaccatgacgaattcaccccgatcctgctcgccgcctccaatgccggactcggcgtggccctgtccaccggcctcgatgtgcacaaggtgcgcgaggataaggacaccgcccgtggcgatatcgtcggcgcgttcaacgatgccatggacgtttcccgcgcggacgccgccctgatcgtgggcaccgacaagtcccacgtcaacgatccgaccagctatgaattcgacgcgaatgtcgccgctgatctgaaggccggcgtgttcctagccgtgtgcaccatcgaccgttggccgcacgagctcgacgagaccgtcaagctgtccatcgagggcatggaggccgctggcaacaaggtgctcggcatcttcgtgaccggatgcgagccgcgccacgctttctccgttaaggagaccctcgccaagtacggcctgccggtctggactctgccgcaggtgccgttcaccgatgaatccaccaaggatctggcgctggagaccttccgtaagaacgctcccaccgatgaagtgctcgccgcgctcgatgtggacgtcaccgcgcccatcaccccgtacgccttccagttcggcctgctcggcaaggccaagagcaacaagaagaccatcgtgctgcccgaaggcgaggaggaccgcatcatcaaggcggccgactacctgcttgagcgcgagatcgtgaacctcatcatcgtgggcaacaaggacgccattctggctcgcggcaaggaactgggcctgaactacttggagcgcgcccgcttccaggctatggacgacgagaacgtgttgaagcccatggtcgccaagctgtgcgagttgcgtgccaagaagggcatgaccgaggagcaggcccgcaagcagctggccgacgccagctacttcggcaccatgctcgtggtgctcggctacgccgacggcctggtctccggctccgtgaactccaccgccaacaccgtgcgcccggccctgcaggtcatcaagaccaagcccggccagaagctggtctccggcgcatttctcatgtgcttcaaggaccatgtggccgtgttctccgactgcgccatcaacctcaacccggatgccgagcagctttccgaaatcgcgttgcagtccgccgagaccgcacgtgccttcggcatcgacccgaaggtcggtatgctctcctactccaccctcggctccggcaagggaccggacgtggacatggtcgaggaagccaccaagctgctcaaggagaaggctccggatctgccggtggtcggttccatccagttcgacgccgcctggtcccccaccgtggccgccaccaaggccaagggcaacgatgtggccggacacgtcaacgtgttcgtcttcccggacctgtgcgccggcaacatcggctacaaagccgtgcagcgctcctccggcgccttggccatcggcccggtgctgcagggtctcaacaagccggtaaacgacctgtcccgtggtgctctggtgcaggacatcatcaacaccatcgccctcaccgccatcgaagcgcagtgagcccggcttggctcccggtggctcccgccagcgggagccaccgtaatgcttattttgtagcaagcaacgagtaatctaatcaacggtaacccgtgtctcacgggaacattcaatcacaatggaggatgcccacaatggcgaaaaccgtccttgtcatcaattccggctccagctcgatcaagtaccagctggttgatctcgaatccggcgaaggcctcgcttccggcctcgtcgagaagatcggtgagccggtcgacggccactacaagcacgagtacaacggcgaaaagcacgagcttgaagagccgattcacgaccacgagcagggtctgaagcgcgtgctcggcttcttcgaggagtacggcccgaacctgtctgaggctggcattgtcgccgtcggccaccgtgtggtgcagggtggctccatcttcccgaagccggccctcgtgaccgacaagaccatcaaccaggtcaaggatctggctgtgctcgccccgctgcacaacggcccggaggccaagggcgccgaagtcatgcgctccctgctgccggacgttccgcagatcttcgtcttcgattcctccttcttcttccagctgccgaaggccgccagcacctacgcgctgaacaaggaaatcgccgatcagtaccacatccgccgctacggcgcccacggcacctcccacgagtacatctcctccgtggtgccggacgtcgtcggcaagccggctgaaggcctgaagcagatcgttttgcacatcggcaacggcgcttccgcttccgctgaggtctccggcaagccggttgagacctccatgggtctgaccccgcttgagggcctgatgatgggtggccgtaccggtgacatcgacccggctgtggtcttccacctgattcgcaacgcccacatgaacgtggacgagcttgacgccctgttcaacaagcgttccggcatgatgggcatgaccggctatggcgatttgcgtgaggttcaccgtctggtgtccgagggcaatgaggacgccaagctggctctggatgtctacgtgcaccgcatcgtcagctatatcggcaactacacctaccagatgggtggctgcgacgtgatcaccttcaccgctggcgtgggcgagaacgacgacgtggtccgcaagatggtgtgcgacaagctcgctccgttcggcgtcaagctggacgaggagaagaacgccacccgctccaaggaaccgcgcatcatctccactccggactcctccgtgatcatcgccgtgattccgacgaacgaagagctggccatcgcccgcaagtccgccgcaatcgccgaagccggcaccgacacctacggcaacaccttcgccaagtaagtaaccgccgttaggcatctcaccaatctctagttgcaacactatgggggctgattccgattggaatcagcccccattcgtatatggtcatgagaccactacccccgcgtcatactctcctcagtcgcctccggcggactgaggggggtccaccagaacacaggaccccttactgcctcagcatgccgctccacataccgacgaaatcaggcaaggtcttgcgcgtggtggccacgttgatgacctcgatatcgggaatacgcagccccagcatcgcggcgaacgtggccatacggtgatcagcataggtttccatcacggcaccgtgcaacgtctccgccggcaccggttcgatacgcaatccatcaggcaattcctcagccgctcccccaacacgacgaatctcgttgaccaatgcctccagacgattcgtttcgtggccgcgcaagtgaccaataccaaccatgtctgtcgacttatcagcaaacaccagaatcgccgccaacgagggcgcaatctccccggccgccgtcaaatcgaacgtacccagcccatgcacggtgccgtcaccggtcacctcgcaatagcgcacgccatcgattgtcgggaacgatactttggcacccatctgttccagatagcccggcaacaaaccacccggctgggtggtggtctcaggccaatgaggcacccggaccgtgccgccggcgatcaatgccgcgccgaggaatggcgccgcgttcgacaggtcgggctcaacggtcaccttgctcggcagttgcattgcgcgcggttcaaccgtccatgtgcgggcggattcgtcggcctcaaccgcaccgccggcaccggtcacatcggccacggtcatgcgaatgtgcggcaggctcggggtcttctcccccgtgtgcgcgaggtgcagaccgccaggcagtttggaactaatcagcaacaggccggagatgaactgggaagaaccggacgaatcgatgctgacctgcgcctgggcagccggcaaggttgcaggcggcgtaatagtgaacggcagacggccaacctcgccgtggtaatcaaccgttgcacccagctgttccaaaccgtcaagcaccggcttcatcgggcgtgcataagcctgttcgtcgccatcaaaattcactgggccatctgcaaacagggcaaggccgggcacgaaacgcatcaccgtgccggccagtccgcagaacacattgacgttgccatggaatcggccggatacaggaggagtaaccgttacggtggtgtcggttgcggaatccacgtcgcagcggacaccgagggcttcgagtgcgcccatcataaggtccgtgtcgcgcgaacgcagcaggccaatcagagtaacgggcttgctgccgagggcggcgagaatcaggtagcggttggatagggacttgctgcccggcaccgttaccgtagcgttcaacggctgtgcggcgagcggggcaggccagagattcgtgagtcgttcagtcataaggccaaatctatcaaacaaattattcaccggtcggcagcgatgcgggattcgatctgctgatcaggtgcggaagacggctgctcaaaaccgccttcgatggcctgcgcgtgcaacaactgagcggccgcgcgatcggcctcgatggcggcgatctggcgcgagaacacgatgaaccagccgaggaacgccagaccagccaacgcctccacattggtgagggtgttgtgacccatcatcatattgacccagaatgcagcgcatacgagcgcggtcaggtcggaggccaccatcactgctttggacaggcgtggcgcaagccacggcaggagcacgaacagcagcagcatgacgaacggcaggcctttggcgcatatattgtgcaagagattgtgtggcgtgtaccgaaacacgccgatgccgatgaatgccaggccggccaccatcagcaggaaggacagaatggagatgcgcagcatgaaatgtgggatttcgtagccgcgattcggatctctgttggtgcggtcgtgccagaggcgctgtagccgttcggtggtcaccagttcggagatggcgaagtagctgacgatgatgatgcatgtgccggcaagaatcagcgtggagttgaacatacgggccgcaaacgtggttctgtcgccgagctgcgaaaagttgttgtgataccagtatgggtcgtcggtggtcatgccggcggtgaccacgccggagatgacgaagaacggcaacagactggcaatagttttggcgttcatcatctccgcctgtacaaaggtcatgtaccccaccacgccggcgaaggcggcgcagacgctggagatatagccggagaagatggcattgcccatcatgtcgttggccgcaccgatgagtgcaaaagacgacaggaaaatggtcgaggcatacaccaccgaaagggcgacgatttcgaaaatgcgacgaatcggtgcaaaccaaccatgtttgaggttcaatgaacgtgatttgcgcgcatagccaataatgaaggaaatgacgccgcatgccgccacgatgcccgaacataccatgaatcggcgttgcgtcagctgccagatggccggcgcgtattccatgtacaggttcatcgataccgcgccaacgacggcgcaaatcaagaaggagatgagtccggaggtttctgcacgctgatgacgtcccatgccgggcctcccctatctattcgatgccgcgttatctttcaacaacaaacaaaactccccccgaggacaacgctttactagcaagccagcgggatttggctgtcgccattctactgaaaatctgaaacactacaaaaaaacgattatgtacgggcttcttagcctttgcgactatcgttaccgccttgccgagtaccgttgttcatgcagaaagaaagcagtattggacacaatcgaatgagcgtgtcggtatcgttgaaaaagtaatgaatgacggttctatcggttcaacctttaagggacgaaccagccgcggcaccatggcgctgatgcatgactatgccgagctcatcaatgaattacgtccgacagcagagcaattcaccgagatcgagcaatactgggtcaaacgaattcaggcgttcttcaccagcaaaccattcaagctggagtccgacaactcgctttccgttgatgcggccgtggaacatctgctgcggcaggcagcgcagcggcgaagggagaatccgggcaccatgtacgtcggcaccgtcctgcagcatctcgtcgcggcaaagctcaccatcgttgctccggaagtggaaatcaacggcgcgtccgttgctgatgatccgagtccgcggcttccaacggtgaggccgcggaccgtctcacaaaaccgtccgcggctccgccctcctgtttcgtcgcaactgactacaccgacgggttcgggcgcttcgtcacgaaaacgccattgcgatgcaccgtatacgcgccgccgtcactgccccgttccgcccggaacaggacgatcggctcccctgcgatgtcgcgcagttcgacatccgatctgccacgtgtcagatagaagtcgaatatggcgtcatcggattgacgcacggtgtgcagaacgtcagaggtcacgccgctggcgggcgaccgcaggttggcttccggctgccggccatcctgcggctgcgcggcaagccagcctcccacgaatcgcgtcagatcgctcacgcccagatcgcagccgaggaaatacgcctccccttcgccgtacgtgttgcgggtgatcgcggccatgccgtcaagctcccactcatccgcttcttcgccggcatacgaggcaagcacctgcacatgcggtccggcgacggtcacgtcaccgagcttgtcgatgacgcgatcgagccagtcgaaatcccaatggtcttcgatgggctggaggcgatctcagctgaagatggcaagggccacggtgttgacgccggcctggcccatcaggcggatgtcgtcatcccagatttcctccggccattggtcgggactatagtcgccaccgaaagcgatgccgcgtccgtccgcggtcagcagttttggccatgcgaagtcacgtcatgcacgcacggttatctcctttggcaggcggcgcagggccacggcccatatcggataccagctgatagacactcctggccgatagtcgacacgccgccggttccggccccactgccggaaccgacatgggtatgttcatgaccgccgaccgcaggaacgaacaggcccgtccgccacggaccgcatcttgcggttcaggcggacgggccttatgggagggatgggaacgggagatcagttcttaataactgcctgcgcctcatcgtcgacgatctcgccggaagcgagcttggcttcgagctcctcaacgatctgcgcatgcatcttctcatcgatcttgaccttgaaccagaacacgacgaggctgaggatgatgagaacaagcgggacgtagaaggcgaaggtcttgaacgtggcgatgttggacgcggtcatgtcggctgccgtggcatgaccggtcatgccagccgcgagggcaacggcaccgaccgcaccgttggacatcgcgccgccgatcttgtcgagcatgggacgcaccgacaaggtgaccgcctcgttgcgcctgccgttcttcagctggccgtactcgatggagtcggtcagcgacagaatcgcggtcatctggatgaactgcgcaggcacatagaagaagatcagggcgacgatgacgaccggcaggttgctggagaacagggcgagcatcgtgtagccgatgatcatggagaccatgccgccggtgaacaggtagcgacggggaatccagcggttgagaatcgggtacagcggcgccatgatgaatccggcgatcagcgggatgatgccggtgatggagaaggcggcaggctcgtcaagcacgaacacgaagaggtagtacatcacaccggtcgtgatgacgtttgcgatggcgtacagcaggtaggacagggcgacccacagcagctggtcgttctggaacagcgccttgaacgcctcgaacgggttgccgttcttctgggccttggcacgcagcgcgctggtgctttccttggtgccaaaggcgacggtccaggcggtaatcaggccgaggagcgcgacgatgaagccgaaggaggtccatccggcctggccctggcccttggcgccggtgaacgtccaggtgaagtagctgacgatcgggatgacgatgacggtgatgccgttgtagccgatagagccggtgaaggtgccaagggcggtgtaggtggaacgttcgtgggagtcggaggacaacgccgggatcatgccccagtaggagatgtcacgcagggagtagaacacgtcaagcacgatgaacgtgatgatgaacagcacgatgaacagcgtggtgttcacgttgaccagtccgaacatgccggagaagatgagcacgatcaacacggaggagaccagtccgccgatgaactgccacgggcggaaacggccccacttggtggtggtgttatccacgaggttgcccagcagcggatcgatgaagatctcggcgatgcggataacgacgatcaggccggtgatgacggcgatcatttgggcggcgagagccttgctgtagctgacgaacaggcagctggtgacgtacgtgacgaagtacgtgctcatcgcgttgtagaaggcagcctgccccaagttgccgcacgcgtaggcgatgcgctggcctaacccgcccttcctgcggacgtcaccgtccgcgacattttcgttgctcattaatcttctccttaagaacccagagcatggaatcactcattgattttgtaaagtatagcatacaagttttatcaccgtaagcatacaagttttatcaccgaaagtaaaaagcattagtaaacaaggagataaacagcgtgtcgcaaggatgggataacatgagctgaaccgagacattgcatggacgcggcgtagcgtcgacggcaagcagtgccagtgatttggaagcggtaaacaggatttgcgttttatataaaaactgtttattcttttcggtaaaggaggccccgacctcctccataatatcattcacaacgaggtaatgacagaaagcaggagagcatgacagacgtcacacatgtcgatcgcgcatcgcaggcttggctgaccgacccgacggtgttcgaggtgaaccggactccggcccattccagccacaagtggtacgcccgcgacccccagagcggacaatggtccgatctcaagcagagccttgacggcgagtggcgggtcgaggtcgttcaggccgccgacatcaacctcgaagaggaacccgcgacggccgagtcgttcgacgactcctcgttcgagcgtatccaggttccgggccacctgcagacggccggtctgatgaaccacaagtacgtgaacgtccagtatccgtgggacggccacgagaacccgttggaaccgaacatcccggaaaacaatcacgtcgcgctctaccgcaggaagttcaccgtctccgcccccgtggcaaacgccaagcaggccggcggatcggtgtcgatcgtgttccacggcatggccacggcgatctacgtgtgggtcaacggcgcgttcgtcggctatggcgaggacggcttcacgcccaacgagttcgacatcaccgaactgctgcacgacggggagaacgtcgtggccgtcgcctgctacgaatactccagcgcctcctggcttgaggatcaggacttctggcgtctgcacggcctgttccgctccgtcgaactcgccgcccgcccgcacgtgcacatcgagaacacgcagatcgaagccgattgggatcccgaggccggcaccgcctccctcgatgccgcgctgaccgtgctcaacgcggccgacgcggccacggtccgcgcgaccctgaaggacgccgacggcaacacggtgtggcagacgacgggcgacgcggaggcgcagaccgcgatctccagcggaccgctgcagggcatcgccccttggagcgccgaaagcccgacgctgtacgagcttgacgtcgacgtcatcgaccaagcgggcgacgtcatcgaatgcacgtcccagaaggtcggtttccgccgcttccgcatcgaggacggcatcctgaccatcaacggcaagcgcatcgtgttcaagggtgccgaccgccacgagttcgacgccgaacgcggccgcgccatcaccgagcaggacatgatcgatgacgtggtcttctgcaagcgccacaacatcaactccatccgcacctcgcactacccgaaccaggaacgctggtacgaactgtgcgacgagtacggcatctacctgatcgacgagaccaacctcgaagcccacggcagctggtccctgcccggagacgtcctcaccgaggacaccatcgtgccgggcagcaagcgcgaatgggaaggcgcctgcgtcgaccgcgtcaacagcatgatgcgtcgcgactacaaccacccgagcgtgctgatctggtcgctgggcaacgaatcctacgtgggcgacgtgttccgcgccatgtacaagcacgtgcacgacatcgacccgaaccgtccggtgcactacgagggcgtgacccacaaccgtgactacgatgacgtcaccgacatcgagacccgcatgtactcgcatgccgacgagatcgagaagtacctgaaggacgacccgaagaagccgtacctctcctgcgaatacatgcacgccatgggcaactccgtgggcaacatggacgaatacacggcgctcgaacgctacccgaagtatcagggcggcttcatctgggacttcatcgaccaggccatctacgccacccagcccgacggcaccaggagcctgcgctacggcggagacttcggcgaccgtccgtccgactacgagttctccggcgacggcctgctgttcgccgaccgcaagccgtcccccaaggcccaggaagtcaagcagctgtactcgaacgtccacatcgacgtgacgaaggactcggtgtccgtcaagaacgacaacctgttcaccgccaccggcgactacgtgttcgttctgagcgttctcgccgacggcaagccggtctggcagtccacccggcgtttcgacgtgccggccggtgagacccgcacgttcgatgtcgcatggccggtggcggcgtaccgcgccgacgcccgcgaactggtgctgcaggtttcgcagcgtctcgccaaggcgaccgattgggccgagagcggctacgagctcgccttcggacaggccgtggtgcccgcggacgcgaccgcgacgcccgacgcgaagccggccgatgggaccatcaccgtgggccgttggaacgccggcgtgcgaggcgccggacgcgaggtcctgctttcgcgcacccagggcggcatggtctcctacaccttcgccggcaacgagttcgtgctgcgccgtcccgcaatcaccaccttccgtccgctgaccgacaacgatcgcggtgccggtcacggtttcgagcgcgtccagtggctgggcgccggccgctacgcccgctgcgtggacaacgtgctcgagcagatcgacgacagcacgctcaagggcacgtacacgtatgagctcgccaccgcgcagcgcaccaaggtgaccgtctcctacacggcccacaccgatggccgcgtgaacctgcacgtcgaataccctggagagcagggtgacctgcccaccatcccggcgttcggcatcgaatggacgctgccggtgcagtacacgaacctgaggttcttcggcaccggcccggaggagacgtacctggaccgcaaacacgccaagctcggcgtgtggagcaccaacgctttcgcggatcatgcgccgtacctcatgccgcaggagacgggcaaccatgaggatgtgcgttgggccgagattaccgacgatcacggccacggcatgcgcgtcagccgcgccgatggtgccgcgccattcgcggtaagcctgttgccgtactccagcttcatgcttgaggaggctcagcaccaggacgagctgccgaagccgaagcacatgttcctgcgcgtccttgccgcacagatgggcgttggcggcgatgattcctggatgtcgccggtgcacccccagtaccatatcccggcggacaagccgatcagcctcgatgtcgacctcgagctgatctgatcagaattgatccaatagtccaccgtgcaaacgatgtggcccccgacttcctcgcaggaagtcgggggccacatcgtttgcacggtccttgttagtccagcggatgcgccggatatcgatgcagatccaaacctagtcgttgtagagcatcaatgaataaagatgtcactcataagctatcaagagaatccagaaccttttttgaattcatatgctcgacacgcaatgtatccagcgtcgtttataatgattcattgtgccttaatggcgcatcgggctatagcgcagtttggtagcgcgcctgctttgggagcaggatgttaccaaagcgttgcgcttgcaacacccgctgagacctactcccgcttgggttttaaggtctcagaaaaaactgaagaatgaccgccagtaacactcagtaacaatgaccgcagacctccgattttctcggcttatctgaacgtcaaaaatgaggcatctggaagcacaaaccgtcttgaggtatgtgtagactagaaaagttgtgccaaatggcataattaccgggccgtagcgcagtttggtagcgcgcttgctttgggagcaagatgtcgcgggttcaaatcccgccggcccgaccacgaaagccctactcccgcttgggaattaaggctttttcttttgcttgaaaggccgtttcggaggctgaaaaagttttactgggttttactgagtctaccgacgcaaatctttccaccttatacttgttaaacaagtgattcatgcgctttcgacgtcgaagcgtaaggatttaaggagtcgatatggaagacgagccgctgtaccgcctgataatgcctgacgggatgcatttggccaatcctcaagacgatcccagcgtctatctgggagccttcttcgatgatgaaaaccatttgaaaggacaagcacgttgggaacccgtcttcgacaataccgacgacggagacggcgcagaaatcggcaacgatgacggagacacacctgcagcggctatggctgccgccgcaattgcgattgccgcaatagtcggaaccgcatactatctagcgaacaatgagacattcagaagctggtgggataaaaccgtcgttcattggtgggaggattcagttaaacctacgatgggtaaactttggaacaaagtgactcgtcgttcaaaaaaaaatgatgtcgaaacgcctcagccgattgcattactgacttccgctcctgaaacgacaaacgcattctccaaggaagtcgatgacgcgattgaagcatgccagttgcacatggacagcgaggaggcacaaaatcgtttgcttatcatcatgtacaaggcaatggatctcgcaaaggatattcgtgaactttcctcggccaacattcaagaatccgctttcggtgaaaagacgaaactggagttgcgtcagaccatggaaaagctgacaacgcagaacgtgacagatcttatcgacaaggccttggaacggaacattccgcttcttgagaagcaggagaaattcgacgcttggtctgcgcttttagggaagatgaccagtgatggcaaatttgtgcccctacgcagcgatgccttacgaacggcattgagtctagaaccctaccgagcaatgctggaagccccgtcacataaaggcgaataagtaaatgcggtgagtgatactgcgcaagcaacattactcaccgcatgcctatgcccgtcgcctatcaagcaacggcactagttcacttaagccgagtttcccatcattgccataatgcaattgccctcttttcacccatgagcggatagtgttggccggcagacggatccccgctttcgcgcattcagcactcagttgcttggctgtacctcgtacttcgctgacgaccagtttggcaagcagacggtcggcgacggcacgacggttcaccttgttgccgcatccagcgcattcgccgtactgctcgtcgggatcgccccacaccacgcttccacaactggggcaagcgccgaacgctatacgcggcttggcggggttgaccgccgtgtggatccgtcgggcaagattggtgatgtcctgataccaggcgagcacgtccccgctcgacagcaagggaactggatccatgatcgcggcgttcgccagcgccttcacagtggcgcgcgggtccacggccttcgcgtagtcgaaacgcaaacccagttgtcgcagtagctgttccgtctcgcagtacagttcccacatgccgtcacgcaacggcgacggtgcctgcgccggcgtggaatgcctgttgccctgtatgctgacgctggcccgtttggcggcgaccaacagcagcggcatggcatcctcacctatcatggcgagggcttccatgagccgtcgctcgcactccttgcacagcagccttccagcaacagtgctggctccgtcattgttcacgcatggccctgtcatcgtcgttccctccgttcaagtgttgtcttaggtcttgcaggctgtcggtgtcatatccgcacgagcaccaccagcgcagtctgtggccggtagattcggtgatgaccagatgcggttcactcgtggttgtcatcgccgtgtctttcgttcatggcgcggatgtgttcctgcatggcggtgagcgacgggtagttgcggccgcacgagcagacgtagatccgcccgtgcttcgcggtgtccacgagcctgtgcctgatggtgggtgtggggtcgtcaaggaatgccagtgggttgctcatgatggtttctccgatcttgtgttccagatggttggcgaaccggttggggtcgcgtgtggcgtatccgcattggcagacgcgcatgtatccggcggcggtgccgaacccgaccgtgagggccggtgtgcgcagcgtggccagtaccgccggcacgagtttggcgagccgatgcgtgtggatgcttggtggttgtggttggtgtgtgatggtcatggtttattcctctaggctgtctcgaaagcgcttatctcccctttgctgggttgcggtccgttccatttggacgctgccgtgcgtttgggtggtttgaatggcttcacgctgatcggcgtgcggaagcactcgtgggctgcgaggtacatgccgtcaggtttgatgccccgcgtgccgcatggtgtgcgcagtccaatcagcgtggtgccggcgatgggctggatgcgcgtgaacctgcggcccaggatgatggccacggccagatccgttgcgtccagtacgccggggtcgtaaatctcttcgatcggccctccggtgtccaccgccacccattcacggcatgtgccgcagcgtctggctgtcaggtgcgcggggttcgcgcccgacgggcacaggagtttgagccacggtggtttccgtctcggcatcatcggtcgcctcccagctggcggcggatggactgccagatcgtctccaactcagattccttcagtccgctggtctgtccgcgctcgaacagatcacggcgaatggcctcggcattgtcggggtggttcagcagtcttccgtaggcccacgcgtgaaggtcgttgttccggcttccggccggtatcggcgtcatgtcgggtttcccgttcgctatggatccgaccgtgacgggccggcgcattagctcgctcaatgacgggatccgcgccgcatgctccggcttgggcgtggaagcttggccatcgggttcggtcacgtagccgtggtcgatcagccatcgcaccatcctgggcggcatcatcggcggctggccgtctggtaggtcaagcagcaggtagtcgccgccggatatatgactgcccgctccgaccacgtagcccttgccttcgcagcggatgtctaccggcatgcccttctcgtggacggcgttcttcagccggccttgcagttcgggcgggatcaggtagtaggcgtgtgcggagggcaagccgttcctgcggccggtgggtgtgcctacgaggtacgtcttcgggaagtcctcggagccgtattcgccgatttcgcggttgaagacgtcccagccggtcggagcgtctttgagcacttcgccggtggccggatccttggccacgtccagatcgatgaccgccatgcccgcaacgggaacgaccgcatacgcggccacgcccgtcggcggttgcttgccttccggcagcgtgcggtttttggcccagtcgtaggagcgtttcccctcgttgaccgtgccgaacgtgaccggatagccgcaatcgtccggcgtgaccacggtgcctccctcgatgggatccggcaacggtggcaccgtcttggctgcgtcttcttcctgcatggcttcggtcatgtccttggcggtgccgtcgcggtacacgctgaacacgcgttcgttcctgaccaccagcacgcgcacgacctcgccgttgatgcgcttgggcttcgatttcagaccgagcttcgtgacggtgttgcggtgcgccatgtcggtctcgtggtgcgggttgtcgcggctgacggcgtacccgttcgccacgatgcagtccacgatccactgctgcgcttcggtcaggtcgtcggcggatccgatgacgacatcgttccagggcttgtcgccacgcacctcccacaggcggcatgaggccatcagaaacggtgctatgccatgttcgtcgaggaatttcagcaggtcggcgaattcctcctcggctcggccgtccctcatgcgcacgaacacgcggcggcgttccaacgcctcggtcatgctcatgatgactggattgttcgatgcgatgatgaacgtggccttgttcttgaagctgaccgcgttctcctgcactcgacgggcgaccatcgtgtcgccggtgccgatcttcttcagcagggtagcctgttccagggtgatggtgtcggcatcctcgtcgtaggcccacagcgcgccgatcagcttcagagtctcctgatcggtggcgaagccgccgttgccgttgcgccctcccagcagggtcttcgacgtgaccgccgcagacagttcgggaaggctgcgatgcagtgtgtccagtaggatgcccttgccgttgccgccgccaccgtacagcacgtagaacagatgcttgtatggctccaacaaaggggctgcgaacatacgtcccagattctcggcgctgtggctgtcggcggtgacgaaatgcaggaatctgcctgcctgcgacaccagttcgtcggagtagtcaacgtccacgaacgcaccggcgtatggccgctggtctacgtgtccgccgcgttcattccccagatcccggccgatgtgcgtgccaactgcggtctgtgggtggctcagtacaccaacaacaatcccaccggctggcagtcccgaccgtggaactacggcaagtacggcgaggccatgcgccagtacaccagcaacgggcgcatcaacggctacaacggcccgttggatctgaactacttccgtggcacccgcgaacagtgggacaagtacgccaacccgggcaaatccttcaagccgactccgatgccggctccacagcccgcgccgagcgtggactacgaggcattggcgaccgcgacgatccgtggcgactacggcaacggcgaagcccgcagggccgcgttgggagcgaactacgggctggtcatgagcatcgtcaaccagaggctcaacggatccacggcatacacgcccgccgcttccatccggagcgtgagcgtgaccgtgcgcagcggcaacatcaacctgatctatcccggcaacatcgtcacctaccgaggcgcggcgaccgttgcttccagcggatctgttgccacgggtggacgtgtgcatgtcgtcaagagcggcgaaacgctcagcggcatctttggagcttccggttggcagcgcgtcgcccagttgaacaacctcgccaatcccaacctcatttaccccggccagcggctccgctactgaccacaaccatcgtggccttcggcaccgtgccggaggccaccttcatcatcaaactaaggagaaccatatggatatttccaccgcaaccaccctcgcatccgggctcgtggcgctaatcgtgcccgcgtttgtgcaggcgttcaagaagtacattcccagcggatacgtcggactcgtgtccctcgccgcttccatcctgttcggtaccatcgccatcgccgccaccggcggattcgatggcacctacacatggggcatcgtgcttgcaggcgtagtcggcgtggctcagaccgtgtatacgctcgtcaaccaagcgttcgacggtaagctgagcaaagactctgggactatttagatgaaagggttgccggacggcatgcgcgccatccggcaaccctttcatctcatatgccagattccaccgtctgatctatatacttcttccaagcgggagcttccatgagatctctctgcgcttcgcacacttcaatcagctctttgattttctcgtgtttggcactttcgttgctctggaacagtgcgatgaagcatttctggaattgtgcaagcgtcaaaggcagtatgtctagtcgttgcttgacatcgccttttgcataccatacgccgtggcggaaagtttcagcagtgttggtatcgatcttgactgcgatgaacagtccgtacactggaatgtcgtttttcccatacttcagcaccgcatcggatacgtgccgtcttacaggctcgccttccatggattcctggcgggatcctgtggacatagtaacttcggtcagaatggtgaatttatcgtattcgcagtacaggtctccttgtccgccgcccgctgccgatacaggaaggaagtccgagtccaatcggaaacctcgtatatcgctgggatggttgatgaggtttccgaaggcgagcgcggcacgccataatacccattcgagatatgccggagtttcatctttaggtacttcgatgccgttgtcctcatcggcgtcatcgatcttcttgcctccgcctttgatcaacagtgtcatgtagtcagagatctcctgccattgttctggttgtttggcggcgtagttgatttcgtcggttttctgccagagttcttcgagatggaggcgcgctgcattgatctcaggtaccgttgataccgggcgatttccaagatcgtaatatacatggttcttcttcagctgtgcttccatatcgagaagcaaagccttggcggtttcaagatcatccatgggcaaggacgcgccatggcagagctccttgtatacgtccataattgggcgacggctcaatgttgttgaggccagcttttccgctaggaagtgcttggccggaacgatgacaaggcctcgacctttcctttggacgattccactgatgcgaaggtagcgcatgttcatatcgctgtaatcagtgaaattatcgctcttcttgttgtaatcctgaccacgcttcttgatttcgtcggcgtcaaacctacgcttggctgttgctttcttgcgacgctctcgcagatcgatgatatggtttacgacatcgttgatgtcatagctgggattggtggtatgaccccacagtgaaaattcgattcgactgatttcactggtgcctgtacgcttttcaagttccagcatcaccgccaatatccaccttagcggggagaagaagccgagatctcctggaactttggtctgctcaagactcagcgaacgtaagaagcattcctgctgcgcaggataggtgtcggctttgaggaaggtctcgccgaatggtgtcaccagatcttgggggccgagatcttcctgtttgccgcccttctttttaacttgcggataaatgaacccaaaacgggcgaacattaaccgccattttcttgcatagctgctggtgtcttctgcttcgccggtcgaattaactaagccggcatgattaagcagtgtttggaatcgttcttcgttgcttcctcgcaggttcccattgaacggggactcggcgaacagcttcaggccctcccagatgcgcatcggattgcgtaatccagtgttgcccagttgccagatcgttatcggtttgcccatgacttcagtttacagtcaactcagcgtcatgggcattaacctgatgattaccagccaaggaagaagtactcttcgaccttgtttctgtttgccgcacctttatgctgggtgccaatggagtatcggtagtcaacgggaacgacttcgacgttcttcttatgccgaccaaggatcctcagcatctcttcttttgtcggctgactgttggaagagtaggagatgataagaatactatccttgaatcgctcgatcaatttgtcgaatgcgtccgcagctcctgtccgggaagaaaacggggtcgggtaggacttgaatttcttggtcttggtatgctcctgcatcgtaacaccctgccagtcgcatgcaagcccctcgacgaaatggtaacgccgtacatattcgttatccgacaatggcgagtagtacggaggatccatgtatacgaggtcaggatggtttgcctcaagcagcaacgcatcgccgcgaatggacttattcggctgacggttatcgaagacagcgttgttcaccgcttcaacagcttcgaggaactgctcggcaagtgtcttcttcaaatccttgcgtccatcgtcgtaccggtgtccggtgtaagtgaagataccacgcgggcgttttttcgtgcaggcgcgaatcaatgcggtcatagctatagcctgttgatagggatcttcgatgtctttgatacgcgtgcgaagaacgtcgatcagatgattttcttcgtccgtgtaatacagtcccccgaaggtgttcgacacgaaatcgtcggtcgggcaatcctccagcaatgcctttgcttcttgcaaaggcagagtcgtgttctggttttccaccatcgccttggtgaaggtggcgctcatggccatgtagtcgttgcttatgacttgtttgccttgcgctttgaacatgtagctgacgatgcccgatccggagaacaggtctacgaccgagttgaagttgaatctggctgccacgttccacagttcagtgagcagtttctgcttggaacccatgaaacgggttggcggatatagctcaacctgcttggatagatttttcttttccggcagagccgccgccagggtcttgggctctggttctgcaatgatcagtgtgtcttctcccgtgcggctgcttgccctgcaagctacggaacgttttgtaggaatgacctgaatctcgtattgcccatacagatcatggaccagcggatgattcgagttggtcaacagaagatggcatcccagcgaatgcagacgggagaattcaactgcaagccgtgaatggtctgagatctcgaactgttccttcgtatagcgcttgaaatccgagtattcggaaaccggaatgtacggcgggtcaagaaacacgaagtcacctggttcggcgtattcggcaagcacggcggcataatcgccgcagacaattgtggcattctggagcgctttggaagcttcacgcagggcctgagcgtcgcagatcttcggattcttgtattttccgaatggggtattgaactgccccttgcgattgactcgatataggccgttgaaacaggtcttgttcaggtaaatcgttcgcgccgcagcttctaccggtgacagattggtccaatccagagaacgaaccttgagaaactgctctcgctcgttcttgtatccaacaagaatggcgatcacttcttcgacatgatcccttacttgtgtatataggttcacaagttcgggattgctgtccgcgatcacggcgttctcaggacgaagcgcgaagaacagcgcaccgccaccgaagaatggttcgatgtatttgccatagtgcgccggaactttcggaagaagcacgtcaagcatctgggatttaccgccagcccacttcaggataggcttcactcggccattggacaccctagctgatgcttgagcgctatttgtttttgcacgtggacggccagccttcttaggagaaagcatgcgctccagcacgtcggagagaaacggattgccgttatcggaacgcaacgtgccgcgtcgaaccagggtagcgactgtggcattcttcacgcctagtatttttgcggcctctgccttggtgatggttttatcctccatcggcatgttttgagccgcgtaattcccaagcggggtgcgccaccatgaggggtccttctcgctttttttgatcaaaagagtgtagacctgctgccattccggttctttgcgcagttcaggaagggaggtgttgtttgatttgatctgaagaataaggtctcctgcgtccacgccgaacatcggcaagttgtcaaagagtcctttggattcttgaaggaactggagcgtggcttcctcaaccaaggtgttcatcattgtccctcaccatcccatggatctcttagtgcttaatgtctaaaacaagtttgacattttcattggacagatccattcattgctgaatgtctcaggcgtgtcgtacgctcgcgcaaacgagcgtacatgggatacttgggtaaagctgtaacttagcgactgtaagcctacccgaagttggagagcacaagatggcaaagaaagtacgcttctacgcaggtgttgaaattgacaaagatggaatcagacacacttggagtgctgatgcttggcaacagttcatggattcttgcaaaaaagaatcacaagcctttgaaattcgaggtcgcaagatagctgggcaatgtgaatcatgctattctcctgcagtcttctacatgcacttgacaaagagccgagagctatctgattggccggaggctggtgacgcttcaggatctgtttctaatcttgccacgcgcagagaccaaaccggcatcatttcaattttagagtatacgtatttgttgcctgtttcgggcacaccgtatatagcattattgcgttcatcgtcgggacccatgccatcagctattgcagattgggtgtccctcaaatcggatatgcccgcagccggaaagtcttttgaactccagccagttctccgaaatgatgcccgacaaaagttgaatgaatcacttggggtaaagagtcttgaggtcagatttgagggaaagccggatccaaactcaactagttcgattgaacgtgctgctgcagaggcggcatcaacgattgatgaaagcgactatgccaacgtaaaagttgatatgagcatcagcatggggcgcgcgacagtagtaagcaattcgactgaagctatgcgaaaacaagctttgtctatattaacgaacaataatattgccaagcaccctattaaagatatgctttctaaaggctgggtgacaaaattaaaggcgaaaacacttcaagcaaatccagaatccgataaacctatcattgaaccagtggatttcataaaggagcacctcacagaagacgcggactttggatccatgaaagatgatgagatgactccggagatcattctttccggcatgctggaagctattggtaaattccgcaaaagatcaaatgaatattaacaggaggcggaaacgccgtgaaagcaatcataggaaaactcaaagataaaccatcgcttgtcactttattaataatattattgattgtagttcaaattattcttattaagtgtggaattatcgttgattttttcagaaatgctacgcaagagcgataaagcaaatgatctttatttagctatgcttagcgtagcagcgcttcaagcaagttttgctggcgtcatagttgtatttggattgtcaacgcaaccgcaagcatttagaaatttgagaattgctgctggcgatgcacttgtagataattggatgtctattagctacagcggttttctaagtgctggttgtgcactgttcgcttctttgtctagtatgatggctgacacttggttagccccttggttttttgaagcttcgatattgttttgtatacatggagttgtgcgtttgctgtggttgcttaagcaactcattaaagttgtccgagacgtagattcaaaagaggccctaaaagccagcgaacgataacaggaagctcattcagaagattgtgacacgccgaccgtcgtcagctccacgatggtcaaattccagtaaaaaaccagtaacaatgaccgtcacggtgagccaatcccagtcggctcaacaaagacaaccaaaaatgagaaaccgccattttccaacgatattcggctcaacaaagaaacaccccgcgaaaacaggatgataccaaaccagcaaaactatgaccctcgctgaggcctactgccgcttaggttttggaacttcggtaaaaactgaaaaatggcatccgttaacaatggttaacaatgaccgcagacctccgagtttgcggatgtttcagggcttgatcccttgggtgcctgaaggtacagagtgtcccactcggtgcgtataattaaaaagttatgccttaaggcatgaaaacgggctgtggcgcagtttggtagcgcgcttgctttgggagcaagacgtcgcaggttcaaatcctgtcagcccgacaatgaaagccctactcccacttgggatgtagggcttcttcttttttgctctgggggcgtttgctaacacaattccagtgttaacggattggctgaatccgttaacattttctgttaacgcagcttggtgcctgtaatccttgtgattccaatggtttcggtatgatcgatggatcgtcgcaatccctcacacgctgtgagccaattcgtgagccaactgaccggaacgacattcatgtcacgataattccgatacctcccgatcacatctcactgccacgtcaaattgtcgagatccacaccgaatcttgtcgcgttggcttcaatcagtgcaagcagccactgggccaaacccggttccaaagcatcgtaatgctgtacgaaacgctcgtcggccacgtacatgcggccgaggcacacgtgcattgacggggtgacatcgaaccataccaaggaacgacggtgggcttccgccagctcattgccctcatcgctgccgggcttcacgccgtgacgcatggcatcggcgagccgctgctcgatggcttcgaattgcttcatgtcgcgctcctgcatatcagacgttctcctcacctggtattccgcaacctgcatccactgccggctcccgccccaacggctctgcgcttcttcggcccattctcgggattgctgcgtcgcatcattcatatcgattcctttctgtgcaacgttcataagccgatcgatatcggccaatgcctgattgatatgttccgccttgcgtgcaagttggccccgacgatccgccaactcgcgtattacctcactcggcttggcatcgagcagctgcttgatacgcggcacgggtatgccgagctccctgtacagcagcagcctgcgcagtcgtctgagatccgaatcggaatacagccggtatccattccagtcgcgttgcggagacaccagacccatttcgtcccaatgccgcagcatgcgaatactgatgttcgtcagccgcgacacatcccctacgttgagatgggaaatacgctccgccggagtgtccatgtcgtgtgattgccggtcattcatggttacaggctaaagtatgacatcatgtgagggtcaaatcagcatggcgacgcgaacacagacatcgatttcagttcacggtgtccacgactggagtaaaaatccgattatactgaatcgcacatcacactaacggctaaaaccaaccgtctccgacaatccatagggagaacacatggatgacatgaacccacgctgcggctggtgcaatctcagctgaacccacgctgcggctggtgcaatctcagcaatcccgtctatgttgcctatcacgatgccgaatgggcggttccgtcgcatgatgaccaccacctctttgagatgctggtgctcgagaccttccaagccggactgtcatgggagacgatactgaacaaacgcaagcgtttccgtcaggcgttcgatgggttcgacatcgaacggatccggcgctatgacgagaacaagatcgccgaactcatgaacgatccgggcatcatccgcgaccgtcgcaaaatcgtcgcgacggtcggtaatgccaacgcattccgggatatccagacgtcgtacggcagtttcgacgactatatttggcggttcaccggccgtcacgtcatctacgagaccggcatgactacatcccctctgtccgacgccatcgcagtggatctcaagacgtacggcatgcgattcatcggcaccaccatcgtctacgcctatctgcaatccatcggcgtcatcaatgcacatgagcctggatgcttcctgcacagggaaaggtgacccgcgcaaggatttataaggtcgctcgggcagaatctctccgagaggaacccgtgcttctagttattttgcttatcgagttcttggtagcgctctttgaccccggtaaggattccggcagattgttcacgctactgcgcggtgagcgcttcgagcagttcgccgaaagtcaacccaccttcactaccggatgacggatgatggttttgagattttccggtttggctcggcgtgggtcggataggtagatctcgtgatggcggcgggtgtcggagaagtcgagcccgtagccttgcgaacgcgcgtagccgtccagaatcgtcacggttgcgggctcgtcgtcgtacgggcctttgtgcatgacctgcgcgaccacgccttcatcgaagtcgaagagatatgcatgattgatgtcgacttcgggatgcttggcggcaaacgatgccttggcccacgcaaagacctcatcggtcacgaattccggcagacgaatcatcgaagtccaatggaagtcggctttgtgcgcgtaatcgacgccgggcacaccctcccccatgctccataagccctccagcggaggcacggtgtagtcgaagtacccgtcgatatgctcggccgggttctttgacttcttgctcattttgacggtgaacgaaatgccgtacagcagttgcatcgccttggcgtaatcgccgccttcttcgttcgggtcgcccacaccgtccaccgcgacgaaccgcatcgccggcaccgtgacgatggcgggcatcctcttcggctgatacaggtccttatattcctttttatagtcgaatgccatcgctcatttcccctccgccaccgcatcgatctcatcctggcgccgccaccgcttgaggtttggcaacagcgccgacatgcagtcctcggcctgttcgacgctgatatggcaggattccgccatcatcggcgcgcatgcggcgaccaattcatcgctattggcatagtcctgaagaaaaacgccgtcttcatagcagtagttgcaataatctccgtttcgcgttccatccggttcggtgccgtgatcttccgggcagtaaaacggcatggcacaactttgacaaaaaccattgtccggcatttccataagcctcgccatcggcacctcaaaacgggtgctgatcagccgaatcatgtcgatgctcggctctgccgttcccttctcccagcgggaaagcgcctgttgggtgacgaacagctcgtgcgcgaactgcgactgcgtaagacctcgctcctcgcgcacgactttgataacctgaccgattgacatgactacctcccgacatcggaaaacgattcgcgcgtctcgctgtgcgcttgctgattccagtctaagggcatgtcccgttcgccaagcgcgggtacaacaaaccgttgttcgcgcttgtatcccggaggaagaaacggctcggtcgaacctatttcctctccacccccttcaattctcccggttcctctgactcctttgcgagcgccgcggatgggatgagcacgcttacgtatggggttgcgccagacaggacgtcgtcgtagaagcgctgtttggcgtcgacgaagtcgatggaatcctggatttccgcgagctgctcgaccagccgcgcccgcttgccggcgagcatctacttgcgttcggggatgctcggctcgtggaggagcgtaaggggcgcgagtaggggttcgcggctttgctgcggtctctccctcacccggctacactgggagctccctcgtcagagggagcttaaattcggtctggttataggcccatgggcttcttgggctttttgtcgctcatgagcatgaggaagctgcgggactgggcggtgatcatgaagcccgcctcatagctcagttccggctcatccgggttgtgcgtatccacgaccagctgccatttgcggccgtatcgctcatccggcagggtgaacataatcggctcgtaatgcgcgttgaagatcaggatgaagtcattgtcgaccatccggttgccgtaccagtcgacctccggaatatccgaaccgttcagatagatcatcatggagaacgcatgcgtgttctgccagtcgtccatatccatgatcgagccggtgtggtcgaaccattcgacctgcggaatcatgttcgaatcgtcgccgggctcacggcctgtgaagaagcgacggcggtgcaacaccggatgatccaaacgcagatgaatgagtttggaaacgaaggcgagcagttccttgcgtcccttgtcaagatgccagttggtccaggagatctcgttgtcctgacagtaggcgttgttgttgccctgctgggtgcgggccacttcgtcgccaccgcaaatcatcgggataccctggctgaacagcaacgtggcgaacatgttgcgcatctgacgctgacgcaagtcgttgacgtccggaatattggtcgggccttcaacgccgcaattccaagagcgattgttgctctcgccgtcgcgattgccctcgccattggcttcgttgtgcttttcgttgtagctgaccaggtcgttcattgtgaaaccgtcatgcgcggtgatgaagttcacggacgccaccggtcgacggccgttgacctgatacagatcggagctgcccatgaggcgtgatgcgaattcgggcaacgtggagggctgtgagcgccagaagtcgcgcaccgtgtcgcggtagcggccattccattcggaccagctggacgggaagccgcccacctgatagccgccggagcccagatcccacggttcggcaatcagcttcacgcgcgagatgatcgggtcctgctccacgatgtcgaagaacgcggacagcttgtcgacctcctggaactggcgtgccagcgtggcggccagatcgaagcggaagccgtcgacgtgcatttcggtaacccagtagcgcagcgaatcggtaatcaactgcagcgcgtgcggcgagcgcataagcagcgagttgccggtaccggtggtgtcgaagtagtgctgctggtcgccttccaccagtcggtagtaggaggcgttgtcgatgcccttgaagctcagggtggggcccatatggttgccttcggcggtgtggttgtacaccacgtcgaggatgacctccatgccggcgtgatggtaggccttgaccatggacttgaattcgttgacctgctcgccgcgctctccggaggaggagtaggcgttgtgcggcgcgaagaagccgatggtgttgtagccccagtagttcgacaggcccttctcctgcaggaaggagtcgttgacgaactggtggatcggcatgagttcgatggcggtgacgccgagcttcttcaggtattcgatgacgctcgggtaggccaggccggcgtaggtgccgcggatgtccggcggcacgtccatgttgaggttggtcatgccgcgcacgtgcgcctcgtagatcaccgaatcgtggtacgagatgtaggggtgctggtcgttgccccagtcgaaatacggattgatgacggccgacttcatggtgtgggcggccgagtcaaggtcgttcatcgccgaggtgtcgtccgggcttttgaaccagtaggagaacaggctttcgtcgccgtcgatgttgccttcgatggccttggcatacgggtcgagcagcagtttgttggggttgcatctgaggccgtgcatcgggtcatagggaccgtagacgcggtagccgtagcgttggccgggctggaggccggggatatagttatgccatacgtatgagttccgttcggtcatttcgatgcgcgtttccgcatcgtgctcgtcgaacaggcatagctcgactttctgcgcaacctgtgagtacagcgcgaagttcacaccggcgccgtcatagctggcgcccagcggatacattgatccaggtctgatctgcatagttttcagtatcccactttcttgtgtcactgatgtgccggggagttgaacgtcaggagaacagcgacggcttatccttgtcggagttcctggcgatgagtctgcgtaacgcctcatgctggatggcgatcatcgaattggatgaggtgatgcgcgtggcggcaaggtcgctccacggaatccacgcggattccacgtgctcgtccgcgtcgaaatggcgctgctcccgcctgaacgggcccaaatgcaacaccatgatgtgggccagttcgtcggtcatgccttcggacgagtagaaatcgcccacgaagtcaacacccatggtgtcacggtccggcaccacgccggtttcctcggccagttccctcagggccgcgtccatgatgtcctcgccctcgtccatgagaccggcgggaagcccgtaggcgaacatgtccgatccggcacggtattcgcgttcgatgaggtaacggtcggtggacatgtcgtgcacgagcatgaccacacagggggcgtgacgcagcacctggcggccgatctcgtgttccttgccctgcttgtcggtcagagcgatgcgcatgtcgtccacgtggaagatgcgcccggtataaacggtttcgctactgatcactttggcgggcacgtccatgtcgatgccgtccgaggaggcgttcagcttatggtcgagccgatgctccagttgttcctgcttgcttccgccagacatgtcatctcctcggaaaaaacgtttttgccacgttactatagcgtcttaatctcgatgcgcggtaatggacagcgtccatggatcggtcgtgtcgtggaaccactcgacttcaggccttgctccggtcgcttgttcgatggcggctggcacgtcatcgatcgcgtagttgaaccacatggattcgatggcggcatgaggggtgttgatgaagcagggacgcacatggctctcccccgccattccatggccgagcatgatgccttgggacctcatacgggcttcataccgggcttgttcgatggcgtcggtcaccgggtggtgacgcaaatcgctggttacgtacacgtccgcaccggtggcacgtacctcgttgaacagggagtccccggagccaggcagaatggccacatactgaacaaaagtgtccgaatcgccgcatacctggatgccgagcgcgctggtcatgccatgatcggacacttcgtcgaatactcgctgagcgaaatccttcagggcaacaggcttcggcaaacgacccacacgccccaagccgaccggatgagaggcgtttgcatcgtcaatcggcacgagtggtttctggtcgatgagtccgaagtagtcggccgccgcctgtcccacgccgcgatacgcagcgtcggcattagtgtgccctacccacagcccgcagccgtgctggtagagtctgcggacgatgtcgccccggaaaccgagtccgctcgtctcgtgtacggaacggaagaacaacgggtgatgggtgatgagcaggtccgcgccagtagcgatagccttgtcaatgatggcggaggtcgggtcggcggcgaacacgatgcggtgcacgtcgtgactcagatcgccgacaatgaggcccggctcatcccattcctcggcgtagcgcaatgggtacagggtctcgagaacgtcgatgacttgcttgagattcggcatatgtcccattgtagtgggctattgctgcaagggactcattctgcaattgcggacaagccatgctcgtgctcttcattgctcgactatcggctcgccttcgcctacaaacaatccactggactgtttgctcaacggctcagccccctcacccgaggggagctagaaattgtcagtgtgcagcgagttgccagtcggaaccgatgccgcacgatacgtccagcggcacggcaaggtcgacggcgtgttccatggcgttgcgcaccagttcggtgacctggtcgccttctcccggcgcgatttccactaccagttcatcgtgaatctgcagaatgatacggctcttgacgtgagcctcggccaaggtctgctcggcgcgaatcatcgcaatcttcatgatgtcggcggcggatccctgaatcggtgcgttgagtgccgcacgttcagcggcctcacgcgcaacacgattggtcgaatgcagggccgggaagtagcgacgtcgtccgaaaatggtttccgtataccccttctctcgggcattggccaccagcgattcaaggtaatcgtgcaccttgccaaaggtatcgaaataccggtttttcaacgcttccgcttcacgtggcgcgatcttgagttgctgggcaagaccatacgtgctcagaccataggccaatccgtagctcatggcttttacgtggctgcgctggtcgccggtgatctggtcgaccggcagcttgtagaccatcgaggccacgtatttgtggaagtcggctccggagcggaacgcttcgatcagcgcctcatcatcggacagatcagccataatgcgcagctcgacctgtgagtaatcgcagctcatcagggcctcgtacccctcccccggcacgaacacgccacgaatctcacggccggcggcgttccgattggggatgttctgcaggttcggatccacggagctcaatcggccggtggcggcaacggtttgctcgaaagtggtgtggatgcgctcatctgatgtgttggtggcatcgatcagcgtttggacgatctgcttgagcttgttgatctcgcgatggcgcagcaacgctccgaggaaaccgttggcccgctcattgtccactgatttgacatacagatcctgcaatgcggccgcattcgtggtgtatgagccggacttggtgcgtttggtgggtttcaaacccatatcttcgaacagcaccttctgcagctgcttggggctttgcaggttgatttcggtgccggcatactcccaagccatttcctgcgcttggcgagcctcggcggcaaactggtcacgcatggagacgagtcgaacgctatcgactttggctcctgtgtgctccatgccgtgcagcacgcgggaaacaggaagttcaatcgcgcgcatcagccagcattgttcacgctcgtcgataatcggcccgagcgtgacggcgaggctgcggataatggccaaatcacgcagacgatgttcgttcggatcttcttcgacctgatcgtcgtcgaagtccaacgtgccttgcgaaggctgttcggtttcggtgaagtggatgtcgaggaagtgctcggccgcctgcttgaggctatcggcatggaaatccggttgggccagatacccggcaagcttggtgtcgaacatcggcaggtccatgtcaagatcgaccgcgcccaaaagatgcagcaattctttatacccatgcacgatggtgcgggagtgttcgcttttcaggaaccgcgcaagctgtgctcgcagggtatcggtgattggaaggggcactatggccgctgatgttgccgtggccacggcaatggcttgtgccgtggcacgccccggcctttcgtcgccccatgcggccacggtccaagcgtggccgaccgcgtcgccgcagatggcatgccgctgcgagccatcgccatagtcggaaaccgtgaaatcggcgatttcaccgggaaccttgacttcgacgcgatgggccttgacccattcgtcgaactgctccggagcagtgatgctcgtgggttccggcaggttcagatcgaggctgctatcctgctcgttctgctcattattcgtagactcgccagctccggatgtgttggatgccttggccccggtattgaaggttttcagtacacgactcttggtgcgaggtccgaattcaagctccttgaacagggcgtcgatctgtgccacgtccacggtgccgaatgtcagatcctcgatatcgacgcctagatcgacgtctcgtaccagtgcgttgactttgcgattgagtttgacctggtcgatattggcccgcagtgattcgccttttttgccgccgatttcatcggcgtgctcgcaaatgccgtcgagggaaccgaattggttgatccacttggccgcaaagccgtcgcctacgccgggcacaccgggaatattgtcggcggtttcgcctcggagtgccgccagatccggatattgtgcgggagtgactttgtatttgtcgatgatggactgcggcgtcatatgcttcaggtctttgaagtgatggcccgggtacaacacggtgacgttgtcatccaccagctggaaagcgtctcggtcaccggacaataccagtgtgtggtaaccggccttgtctcccatggtggcgagggtggcgatcacgtcgtcgccttcgaatcccggcttctcgatgtaggtgacgccgagggccgtgagcatgcgttgaatcaatggcagctgggtgagcagctcttcgggagccgcctcacgggtgcctttgtattgcggaagcatctcattgcggaatgtgccgcccttcacatcgaaggcgacgcccagatggtcgggcttctccgcatcgatcacctgcgcgagcatggtggcaaaaccccagacggcgttggtggcctggccgctggaggtgctgaagttgtcgaccggcagggcgaaaaatgcacggaaggccagcgagtggccgtccaccaccagcaatgtttcattggtgggtacggtcacgctggcctctcccatagtgtgtttgtgttgctttacgactcagtacggcgacgccgataatcagcgttcgcccgaatcagaaggcttcggatcgccgtacttggcgatgatggcctgagccaggcgcttcttggggatgcgctggtccatggaggtcttctgaatccaacggaaggcaccctgctcggagaagtccgccttgtccatcagcagacccttggcgcggtcgacgagcttgcgctcctcaagcgtgtcttcggccttcttgagcttctcttcggtttccttgagctgatcggtggtttccttgagcttacgttcgctgcgctccacgctgtccagcaaatcgttgatctcggcgaaacggcccatggccacctcgagggtcggcagcagcttggattcctcgtacggcttggtgacgtatgccatggcgccagcgccggtggccttcttcaccagatcggtctgggagaatgcggtgagcatgacgacgggggcgatgttttcatcgcagataatgccggcagcggtgatgccgtccatacgcggcatcttgacatccatgcacaccacatcagggcggtacttgcgggtcagttccacggcttcctcgccgttggcggcctgaccaacgacctcataaccgttgtcttccagcatggcgaccagatccatgcggttcacggcttcgtcctcggccacgacaacggtacgcggaccgtcctcgggcttggccttgcgctcagcaggttcgctttcattggccacggccttgagctcttcgtcggtcagcacctcatcgatgttgatactcggttcttcggacttcttccttgcagccatgccaacctctttcttgaattacccaacaatggggttcacaataatttcagcgaactcctaactaaagtgccctcggtgggactcgaacccaccaccttcgcataccctgccgagctgaggacaattccttgtcaggaatcgcttctgactcagtttaccctcctgtacatcctgttcgcggtttctctgcgagttttgcccgcacgctgaaccgttcccgttttgtacggcagtcaagagtagcggctgcggacgcggcctgtcaaatatcggcgtgtgggagaatggagtttccgttttcgcggagtgtccacatagatgcagggtttaccaaggtgaccgtgttctttagggtgtgcgctgcgcgaagacggttttttattggctgaaggaggccgaagatggttgaagagacaaagaggcccttgcgccgcaggcgttttgggtgcattctcgaacgcaagggttcgacaggggatgtcacgagcatcgaggctcgttatatctcgccgatcaatggtcagcgtgtgtcgaaacgtttcgcgccgggcaggcggggcgatgccgaggattggctcgagaccgagaggtcgatcgtcgatctgcaccgtcgtgggatgatgacgtggattcctccacgggaccgggatgggaacacgttgacaccgaagctgacgttcggcgtgttcgccgacgggtatgtgcgccggcatcgcaggaaggacggcgccgagatcgcgggctcgacgttgcgtaacctgcgcaatgacatcaagcatctcaaggaggcgttcggcgacgtgaaactggccgagttgaccgaggagctggtgaccgaatggtattacgggccgcatccgaacggggaatggcagttccgctcggaatgcatccggttgaagatgctgttgcgggaggcgtgtgcgccgggctccaagggcgctcctcccctgttggcggagaacccgttcacgctgccgattccgcccgagccggaggctgggtcgtcggatattccgccggtcacgcccgacgaactgtaccatatatataatgcgatgccgggctatacgcggttgtcggtgtatctcgcggcctgtgcgggcggcatgcgcatcggcgaggtctgcggtctgatggacacggacttcgacttggagaacaaggtgctgatgatccgtcgcagcgtcagccatggcgcggatgatctgggcccgtcccggatcggcaggctgaagacgaaggggtcccggcgtacggtgcctatcccggacatgctgattcctttgattcgcatgcatctcgaggatcgtccggaccagtcgaaccacatgttcttccaggccaagcgcggcgagatcctgtgtcagaacactctgcgcaaccacttcatgaaggcccgcaaggcggcgggccgtcccgacctgcagttccgcactctgcgcgtgacccatgccacccgtctcatgctcgatggcagcagtctcaaggagacgatggacgccctcggacatgtgagggaggagaccacgttgcggcattacctgcgtgccgtgccggagcatcagagggaggccgcggaacgcaccgccgcctatctgctgtccgcggacccgtcgctcgcgatcgcctcgctgcctcccgctcccgccgggctggacgcggacggcgatgcgggcgacatggccgcgctggcgttgctgcttggccaggtgtcgacgctgatggccggcatcgccgcccggaactcgcagccggccggctagcccggccgtgcgtgaccatacgggttcatgcgcttacggctggaccgtccatgcccgcatcctgcgcgggtccgggacggtccggcgtttccatgggcatcgcgccgggcagtgcggcggggtcggggaacatgttcgcggcgggccatagcccggtcggcccctcgtcgggtgcgggatcgtagccggggcccgtcgcctgcgcctggcggatgcattcgttcacgcttccgtcgaacgtgctcgtacgggtggcggcccggcggaccaggtcgaggccggcggcgtcgctgcgatccatgtcgacgatgagcatggtcggcatgcccgcgccgaggatcaggtgccggcccgtggtctccacgaggtcgtcgtgcggcgtgatgatcggatggtccgtgacctgcaacgggttggcggggtcgtcgggcagagcgaggtggatgtcctccggcttggtggcggggatgcggatgggttggacggcgagcggctgggcggggtcggggtttctggtggcgatttccccggtgatccaggcggcgttccagtcgtagacgccgaggggtgcgtgcaggtcaggctcggccatgacgcgggcctggagcgcgtgggcgcggatgacgcccctgttctcatgccagtgggagttgaggagtccgatggaggcgagcagctggtctcccaccatgcggcccttgtccttgtacctgttccattccgcggctccttgcggctggtccgccgggttgagcgcgtcgcgtgcgatctggatggcgccgagggcgtgcgcgaggtcgagcgcgatgtccttccatgggcggcgggtgtcgatcgcgatggcgtgttcgtcgagccggtagcccatgggttcggcggcggccttcgcctcgtgcctgacggccaggccctgccgcgtgagggtcttcgagagggcctgtgcgacccgtgcgaacaggtgggtctcctcggcctcgtcgagtgtgaagtcgggcaggatgccgcccttctcctggatgttttggatgtcctgttcggtgtagtcgccacggtccttgagatgcgggtcctgccaggctggcgtggtgttgcgggatatgtcggccatgatggtcctccttgatgggcggggccgtctttcggccccttcccatccggcacccgcacgccgcgagccgccggccgattgcattccgtccgtcaccggcatgtacttcacgacgtacaatcgggatatgggagaaatcacgatggaaccggcttaccacggtatcgaggaggagaccgtcacgcgtctgccgtccaaggtgttcgacgagtttctcaaggccctcgacaggccggtgccgcagaccgcccgggaccttatcggcatggagcccgattggctatgaggttcgcgtccccgcgtagggcctggtccggcgacgtgctcgacgggtccggctgcggccgtcgcgcccatctacgagcggctgccacttcgtgcgcgggacgccgagaaacacggacatcggccgtataacgtaagtcggaaaaacagcaggccctccgccgcgggacggagggcctgccttcgggcggagaatcagatctcggccagcgccttgtctaggagcgtgcgcaccgcattgctgcggctcatgtggtgtttgcgcatgtaccgttccagcttcgcgtcgcgttcgtcgtccagacggacgcggatcacgttggaggcaggggtgctgcccacggctaggggacggcctggggttctcttcagcgcctcggatagctgctcgtcggtgtagcccctctcggcctcctcggcatcggccttgagcatcgcggcctcgtcggccggcagttcgtcgtaggagaggatgtcgtagttcatgtccattgcctgcctccttccagcagtttcacgtattgggtcctcatgcgcatcgcatggatgagcgccggccccctcgatgtgtcggccaccaccacctccaggggaaggccatccggtgatatacccagatacaggaccttgagggggtcctcacgcagcacgaggtcgcgaagcggatgctccccacgtacatggcgtcatcaggttcgatgccgtgcttgagcgccgaggggaatatgttcacagtaatattgtgacacaaaataggcgacgggtcaaggacgcatggggcacggtccgtcacggccattgtgatccagtcgacgatcgagattctggtaggtggcgatctcatcctgttgggcttggtcctgcgtcaggtcgcgttgccgttggaggccgcctgctggtggcgttggaggctgtcgcgtatggacgccgaagccgccctgatcctcgcccgggcgttgtcttccttccgggattacgtctcggttagatgagccgccctgttttgtccgcatatcgatggcatgcgtcgcatggcttgagtgacaaccatgacaatgatcaggaggaggcgtgtgatgacgggttcggctcatggcggtccggccgatgacaatgatgtcggaggtgttttccgcgtatgcgtgggcgtggaagaatcggctcgtcccgccccgttgatgtggggtgttttcgatgaaccgttgacggatcatgatctgctggtattgtcgcgcgcgtttgatttttcggacgggctcagggagcattgcgtgccggccgcttgggaggcccttgattcgacgttggattccggtgtgcgcgagcttgtatcgcatccgccccggaccgaggccgagcttgcggcggccatcgcgggtttgggtcatgccgtcgcccggcgggcggtggatggcgcgctcgatcgtcttcagtccagatggctgtaacgctgcacttcgatgatgttgcggggcaatctgttctccgtttccccggatggcgcatgttccgtccatcgtgtggactggttggtccgccggcagtggtcggctatctcctttgatatgagccgcatggtctttcctgacggttcggacggtttcggtcagctggggcatgtacatggtcccattatccccaatatcccttctttggtccgatatcggcgggattcgggccggcggcggcgtggatggccggattgtgcgtcgcgcgtgttgggaggcttgcatggctggtggcgaggggaagcgggggtcgtcgggcaaggcgttcgtggtggccggcatggtggtcgcggccccgctgctcacggtcgtggtcgtgttgttgtgcctggtgatcctggtggtcgcgatactgcagtcggattacggtctggggacgcgttgcgtgacgggttcctcgtcgtgggtggattgggcggtgtcggtcgcgaaggacgataaacatgggtattcgcagccgaaccgcgggggcgacccggattacgactgttcgtcgttcgtgtgggcggcgttgcgccatgcgggcttcgacgtggggtcgagcccgttcaacactgacggcatggattcggtgttgaaggcggccggtttcgaacggtcggatttcagggatgtggcgtccctgcaggcgggcgacgtcgtgtgggcggacgggcatacggagatctacatgggtgatggcgagttcgtgggcgcgcattgggacgagaggcacggggtcgagggcaggacgcccggcgaccagaccggcgacgagatcggcgtgacgtccacgttgaacgcgcggtacacgcgcgtgtaccgtgcgccggcctcgcagggctcgcaggcggtgtcgggcggcacgtcggattccggttgggacgggatgggcgcggagcaggcgaaggccgcctggttcggcggcctggccggtccgggcaatacgtgcgtctcgtatccgcagggccagtgcacgtggggcgcgtgcctgcgcgcctaccgtctggggtggaagcatgtgggacagtattggggcgatggcggcatgtgggcctcgtccgcggccgcggagggttacagggtgacgcggacggccccggtgccgggcgcgatcgtgagtttcccgcccggcgtgcagggcgctgatccggcggccgggcatgtggccgtggtcgagtcggtggacgcgtcgaagggcacggtcacgatcagcgagatgaacgcgcatggcccggtgtacacgtcgcgcgagctgcccatcgcgggcggcgcgaacttcatccttcccaaggacccgatccacggggccggcggcggctcctcgtcgacggcgacgtgctcggcgggcgaccaggacggcgagaaggcgagcgtggaggaggcgaagaggatcgcgaagcgcaagatgaaggacatgggctgggatgacggttcccagttcgaatgcctggacacgatcttcaccgaggagtcgggctggcggtgggacgccaccaacccggacagcggcgcgtacggcatcccccagtcgctgccggcggagaagatggcctcggccggccaggattggcggacgaacgcggccacgcagatcgactggggcctgaaatacattcgtgacaggtacgggacgccgtgcgccgcgtacgcggaacgcagggccaagggctggtactgagattatcggcgtccgttcgggtggtttttccgggagcggtcgtctcatggcgttcccgggccggccggcgcatgatttttcttctcttttttcccgtgcgccggcgggccgctttccttcacggccccatgccccctccccgggcgtggggcctttcctttctttccggcccgttatcggccgtgggccgtgccggcgcgtggtggatgtgcgggcccgtgttgtcgggccgtggaggcttgtgatgagggaggctgtgatgtccgggatggtgttggccgatgattcgctgatcaacctgttccccgatcccgcgtgggatgtggcggggttcagggacctggcggggggcgtgatagcggtgtgcctgtacgcggcggtcgcgatggtgatcgtcggcgtgctgaccctgctgccgggcctgatcacgaacaacatgatggagcgcgcgttctcgtggaagcggctgctgtgcgcgttgatgatcccgttgacgatcggcgcggcgacgggcgggttcgcgtggggcgcgggcgcgttcggcgcggacgggctggcggtgaacgactcgtaccagtccgcgaacggtcatcccgactggaagggcgtgaagagcgacgaggcgaagaagtcggatgatctgggcggcgtggtccggcagttgggcgaggacatcgcgaaccgtgtgggcaaggccgcgggcgacgcgatcgacaaggccctgtcgacgggcaagaaggcgtggcagtggctgtccggcggcgacgggaagggcaacgtgttccagaaggccggccaggcggcgggcgacgccgcttcgggcgcctgggactggctgtcgggcggggacgggaagggcaacgtgttccagaaggccggggacgccgcgtccggggcctgggattgggcttcgggcggcgacgggaagggcaacgtgttcgagaagacgggccgggcggcgggcgacctgtggtcgtccctgttcggctgagccgtccgcccccgttatcggcacgagacgtccgccgcctttggtggcggtggggaaaggagggtgaatcatgaccattattcatccaatcgccgccaccgcgtccgatatcgtgctggcgttgaccgacaacgacctgtccgggttctccgtgtccccgaactggacgttcttcccgttcatgagcctggtgtcgaacatcgtgggcggcctgtgggctttgggcatcttcgtggcgacggccgcgtggatcatcgccgcgttctcctgggtcgtgtccaaggcgatccacaacagcacgatgcagcagtacagcggcatcgtgttcgtgtggatcgcgctgggcatgatgctgctcggctcggccatggcgatcgtcaagttcgcgtccacgcaggccctgttctgacctcggggcccgttccctttttcctccgggcccgtcccgccgtcggggcgggccctttccttttcttgtttttccgttgttgggaggctgtcgtgggcgatgtcgtcgaggcggtgctgcagaagctgttcccgtggatgctggatccgatgggcaaggcgttgcagggcatgatggtgggcgcgttctcgtcgaccgccgggtccgtgtcgtacgcggagtggaacgtggcgatcacggccgcgaacaggatcggctgggtgatgggtttcgtgaacatgctcatctgcgcggtgggcgcggtgcatgcggccgtgaaggccagcccggcggagtcggtcaagtcgttcgcgatggcggtgctcgcctggccgttgaccgcgatctgcgtgagcgtgatgatcacgtgcgaggggatcgtgagcctcctgtccgcgaggatcctcgcggtgggcgcggacacgaccaagggccggggcatggagtcgatggtgtcggccatgttcaagaagatcctggagcaggcgtccgtcctgcattcgctgacgatgctgctcgtctatctggtgttgttcgtgggcgtgttcctcctgtgctgcatgctcgcggcccgcaccctgtgcctggtgctgctggccgcggtcgcccccttgccggtgatgagcgccggctggaaggcgacccggccggcgatgcgccgctggctttcggccgtggtgggcgtgatgctggccaagccgttggccgcgctggtgatcacggtcgggtcggcgctgatgacctcgcagaccacgtcgggcgtgggcgagggcagtttctgggatctgctggtcggcgtcgccgcgatctacatggcctgctattcgccgaagatgatcatgccggtcgtgcagttcctgggcgacgaccggagcatgggcatgcagcaggccgcgagccaggcgggccggaacgcgctggtgaccgcggcccagctgacccggcaggtcgtgaccgcggccgccggggtggcgaccggcggggccgcggcggcgggcgtgcagttgcccggcatggcgcagggcgggctggccgccctgaccggccaatgggggcaggtcggcgaacaggccggaaaaatgctcgccggctccaagtccgacggcaaggacaaggatgatggcggcggggcccgggattccggcgcccatgccgccgatccgtcgaaggacgacgggtacgagccgccggtctccgctcccccgggcccggatggctcggccattccggcgcccgatggcgcgtcgcccgccggaaccgcgcccggcggcgagggaggggacggtggccggggcgtcgcgggccttgacggttcggacggctccgacgggatcggcggcgagggaggcctgggcggcgccggcggcgagggccggaccggatcgtccggcaccccggggtctccgggcgatccgggacctgccgggatgcccggaacggatgcgacgccggcgcccccggtctcgccgcagtcgccgtcgggcccggtcctggcctgacttatcgatgcgttgccgggtggcgtccccgtatgggcggggatcgcgcccggcccttttttcttgtttgatcggaggttgctgatggtggatgccgatggcagggacggcggggcgagggtgcccacggcggcgttcagccgcctgtcggccacgaacgtcttgttcgggtggacatggccgcagatcggcgtgggcctggccggcctggtcatggtcgtgggcggcgcggcggcgggcatggtgctgccgttgatgctcgctggcggcgtggtcatggcgtacgggctgatccgttacgaggggttgagcctgatggcgtggacgtacgtgtggctggcgtggcggcggcgtgtgcgcgacgggtcgacccgatggtcggcgagtccgctcgcctcgggccggccggcgggcgtgctgggcgtgtggggccaggtcgagtcccgggcccaggtggtcgaggggtccggcgtggaggtggtcggcaccccgttccatggggcctgctacctgttcgacccggaacgccggcgggcgaccgcggtgctcgcgttgaaggtcgaggagtggacgttgagcacggatgcgtcgaaatcgtcgcgtgcggccgccttgaacgatctgaccgcccgtctggcggacacgccgggagtggtcgagctcaaggagaccgcgctcctgctgccgggagccgcgcccgctccggacctgcccgacgatggcgggtcgccggagtggatgcgccgtgatatggcggaattgtgggccctgccggaggtcatgaccccgttggcgaacgtgagctacgtgtccgtgacctgcgacgtggaccggctcaagggcgtggaccacgcccggggccggctcacggaacgcgaacgggtcggggtcgcgttgggcgacctggtgaagatgaccgtcgccccggccctggtcgaatgcggggcgcgccccggttcggtgcgctggtgcggactggacgacctgcgcacgctgatccggtcggtttcggatccggccggcaacgcgtgtttgtgttcaattagttgttgcgggtttagtcacgatgatttttcgggtttagaactgttagaattacaggaccaacaagggtgttgcacttctaaatagacatcggggagagacttcacaaaatcttcgtgagctagaatggtgcgtggtgcggctggttgtgaatgccgtgccccaagcgagagcgaggagagtagtaatgtccaatatcttccaatggcaattgcatggcgacggcaagacgctggcgcccggcgaggtagtcgagcccgatgaacgtctgacttgggtgcgcaccgccggtatcggcgcacagcacgtcatcgccatgttcggtgccaccttcctggtgccgattctgacgggcttcgacccgtccaccaccctgttcttcacggctatgtccaccgcactgttcctgcttatcaacaggaacgtgctgccgagctatttgggctcgtccttcggcttcattgcaccgatcaccgcggtctccaccgccaacaagggcattgcggtcgccagcttcggcatcatggtcaccggtattctgctggccctggttggcgtgctcgtgcattacgccggctccaaatggatcgacatcatcatgccgcccgtggtcaacggcgcgattgtggccatcatcggcttcaatctggcaccttccgtgtggaccaacttccaagccgcgcccgacaccgcactggttaccctgttggccgtgctgctcgtggccgtgctgttcaagggcttgctgggccgcctcaatattttggtcggcgtgatcatcggctatgtatatgcctgcatccgtggccaggtcgacttctccgccatcggcgacgccgcatggatcggcttcccgaagttccacctgccgcaggccgatttctccatccttcccatgttcatccccgttgtgctcgtgcttgtggctgagaacgtcggccatgtcaagtccgtggcccaaatgaccggccgcgactacgacaaccagatcggcaccgccctcatggccgatggcctgggcaccacgctcgccggcttcggcggcggctccggcaccaccacctacggcgagaacatcggcgtgatggccgccaccaaggtgtactccaccgccgcctactggtgcgccgccgccttcgccctgatcctgagcctgtgcccgaagttcggtgccgtgatcaacacgatccccgccggcgtgctcggtggcgtgaccacgctgctgtatggcatgatcggcatgatcggtatccgcatctgggtggagaacaaggtcaacttcgacaagccgctgaacatcatggtggcagccatcaccatgatcattgccatcggccaattcgcgttcactgttggtggcatttccttcaacggcattgccattggcacgatcgtgattcttgtggcctaccacggcctgaaggccattggcaaggcaaccggcactattgccaaagacgatccggatattttgtagtgtgttttagggctactgggctgtattttggctcagcccttttgcacaatggcccctaccttcacgggtaggggccatttgcgtgttccatggagcggtgctcgccttacgtggtggtaaaacccatggggcggcaaacatcccatggggtggtaaaaccctcatggggcggtaggtgaaaatggctttattctgcggtttcacaatttcttcaaaccgccccatgggcaagttaccgccccgtggggtcataagtaaagagtgggatgacagtgtggcgagcaccaagcaaagtagggggcttacgctaagctcggaaagcttgcgtaatttgcgtaacctttgacatgaaaggccactgtgccccgtaataatttcgatgatcgtgacgattccgctgatttccagatgaacgacagcgcggaatcccgcccccttacctttggcgaacttggcgtacccggaccgctggtgcgcgtgcttgcggcagatgacaagaagaccgcattccccattcaggccgacaccctgcccgattcactggccggccgcgacattctcggccgaggtcgcaccggctccggcaaaaccctcgcattctccattccgctggtcacccgcctcggttcctacgattcgttcggcgaaatcgcgatggaggagttccgcaaggaaatcaagcgccgcaagaaggccagcctggaagagcgccgcgccgacgacttcctaccgcacccgcgcggcctggtgctggcccccacccgcgagctcgcgaaccagatcaacgacgtgctgatgccgctggcccacacgttcggcatgaacaccaccacggtgtacggcggcgtcaagtacatccaccagatccgcgatctgaaggccggcgccgatatcgtggtcgcctgcccgggccgccttgaggacctgctgcgccagcaggcgctcacgctctcgtccgtcgaagtcgtggtcatcgatgaggccgacgaaatggccgatatgggcttcctgccgccggtcaagcgactgcttgagcagatttcgcccgacgcccagcacatgctgttctccgccacgctcgatcacggcgtggatgaagtggtgaacaccttcctgcacgatcccaaggtgcacgaggtcgattcggccaccaccgaacccgacctgatgacccaccacgtgttcgaaaccacgcgcggcgacaagcacgaactcgtgcgcatgctcgcctcgggcgaaggccgccgcatcctgttcacccgcaccaagttccaggccaagaagctcgccaagaacctgacgcagaacggcattccggccgccgagctgcacggcaacctgaaccagaaccagcgcgatcgcaacctcgctgcgttcgattccggcgatgtgcgtgtcatggtggccaccgacgtggccgcccgtggcatagacgtcggcggcgtggagctcgtggtgcaggtcgagccgccggccgacccgaagtcctttgtgcaccgctccggtcgtaccgcccgcgccggcaaggcgggcgacgtggtcaccctcgtgctgcccgagcagcgccgcgagacgcgccgcttgctgaaccaggccggcatcaagaccaagatgatcgaagtgacccacgattcgcccgaagtgcttgagcttgtgggcgaccgcgccgagcgcgtagatggttggagcctcgacaagtcgcagcccgtgggcaacccgcgcaagggcaagaacaggggcgccaagaacgcggcgggcgacgagtccggccgcggcggcaagcgcaagcacaatcgcaatcgcaaccgtgacgagcagaacgttgccgagaccgagttccagcacgagaacgcaggcggcgagtttgttgccgaaggcgagccgcagcgcaagcacggcgacaaggccagcaagaaggccgtgaagaagaaccgcaaccgtgcggaacgccgtgcaggcatgagcaaccccgaggccgagcgccgcgactatctgttcgagcatggcgatgaccgccgcgaggagcgccgcaagggcgaccgtcgcgacggatacggcaagaaccggtacgacgagcgtcaggacaatggccgcgaccagcacggcaagaaccgtcgcaatgatcggtacggcaagggcgacaagttcgataagcgcgacagggccggatacggtcgcaacgatgatttcggcagccgcaggcacaatgcgggccgtgatttcgaacggtccgattcccgcgatttcgagcgtccgcgcaagcctcggcgcaatgaacgcagccacgaggattacggcttctcctatgacgagcgctcccatgacggccgcagacagtccatgcgcaacacccgtcagggcgaaggcggcaagcgcatccatcgcaagaacgagaaccgcatcgtacgcgacgagcgttcagaaggtgccaagcgtcacgaacgccgcatgatcgccaaatacggcaacacggaaggcccgaaccgccgtcattccaagaagaatcgccacaatgcgccattccgtatgaagtctggacgccgttagtccgacagcgcgtatgaatcaggcccgacgacctttgatggtcgtcgggcctgattgtgttataggccggtgtttgcgatgcggatgcctgttcgcctgcctagcggccatgacgattgcacttatcgccgcagtcgttgtgatcgtggccatgccgaaacggcggtaatggcctgtacgcaccctagaataacggatatgacgcaatcgcagccccgatccaaacgcacgcccacccttgaaatccacgggagaatccttgacgcggcaaggcggatcgtggaacgggacggtgtggatggtctgaccatccgtgcgctgtccgcacaggccgatgtgtcgcccaccagcatctaccagcacatcggcggcaagcaggcggtgtgcgatgcgctcatcgacacatacttcaccgatctgcgcgaacagctcatcgccattgacgaatccgaccccgtgctgcgcctgcgcagggcgggcataatctaccgtgaacacgcgctggacgcccccggcatttacgcgctggtctggatggggcaggcgtcggactcggcccagcactgcctggacgccatcacgcagatcattcgatacggccaggcagcatctgtattccgcggcgatgacccccatctaatcgcatcctccatctgggtgtccatacacgggttcatccaattcgaactgcgttccgcacaaccccgcacacgcggccgcgaacgggtcgaccggtcgtacggttacctgctcgacctgctgatccgaggcattcagaggtgaatgagttagctccctctgatgagggagctcaccattgatacgctgtactgccatcggcgttgcggatggtgaaagtgggggattgctcgatgttgaggtccacggtcagggaatgctgggcgtcggcgctcgtcgaacgatagacgaagtgcttgttttccagcttcacggcctcggtacgcgcatccagcagccatgggttgcgacggcgcagcgcgatcagcgcctgatgcagccggtatgtcggctctcccagcgtggacagttcggcaggggagccggggaacttcggacgtacgtcgtcatcgccgccgaaacgctcctgcttgacgcccacatagccctgttcgtcgccgtaatagatgcttggcacgccgccgaccgtcatgagcaccgccaatgccaacgccgccttggccgggccaatctgcgatgcgatacgcgtcacgtcatggttgccgatgaacgtctgcggcacgaaggaatccaggaacgcgttgtgccgcttcaagttccaatccagctcgaagaagttctccgtctccagcgcatgctggatcgacttccatagctcgtattgcgtgatcgaatccatcgtggattcctcgatgatgcgcgggtaatcgccatggatcacctcgccgaaaatccacgaatacgggtgtgcggctttgacctgcggcaacacgcgcgcccagaacgggctcggcacggcatacgcggcgtcgaggcgccagccggcggctccgcgatccagccaatggctcatcacatggaccacatagtcaacggtctcgtcagccgaatggtccagcgccaccagattcccgtgcccctcgaacacatccaaagcgggttcgccattatcaccgacatgcgcgcggaccagaccatgccacgggttgtcggccggattcaagcgtccggcggtctcgtcaagcgccgcctgaacggccggatgattgcggctcacgtgattgaacacgccatccagcatcacctgcaatcccatgtcccggcaggccgcgacaagctgatcgaacgcggcatccccgcccaatcgcacatcgatatgcatatggtcgagcgtgtcgtatccatgcgtcgccgactcgaacaccggacccagcagcaggccggacgcgcctagatcgcgcacgtactccagccagggaattatcgcgtcaaggccgcggccatggaactggcgcgggccggcgggcctgatatcggcaccgcagaagcccagcggatacacgtgccagaacaccccgtacttcacccaatcgggcattgtgcggctcgaatccatgcttacaaccactgtgcacctcctgattgacaccgtgtccattttcgcacatcgcggtgcgaatcccgggtaatcggcatgaaacgcagtccgtgaacatgtggccaagctcacatattgggacattttcctgaggcgcgacatgccgtggctacgcttccaaccagtgccataagcagacgagagataccccaaaagggtcgcaatgaagagaacctttcccgcaaaggttattgaagaggaacagagggttattatgaccaccgccgcagcccaggccccggcacctggcaagttggaattcaaggacgattacacgccggacgaagccgaacgtgtgattcgcaattcgaagggactgcccgtaggcgtgcgtcccaaaatggtatggacatggaagaaggccctgctgtgggccgccatcgccatcgtatgtgcctgcggatgggcgattctggccgtctcgcgcggtgagcggatctccgccatctggttcctggtcgtggcgctgagctcctacgccatcgcctaccgcttctatgcctattacatccagatcaagatcatgcgcaccgacgacgcgaacgccaccccggccgagcgcgtgcatgacggcgcgaacttcgaacgcaccgaccgccgcgtgctcttcggccagcactttgccggcatctccggcgccggaccgctcgtcggcccgatcctggccgcgcagatgggctacctgccctccactctgtggatcatcctcggcgtgattttcgccggcgccgtgcaggacatgctggtgctgtggatctccgccaagcgccgcggtcgctctctgggccagatggccactgatgaaatgggtaagttcggcggtatgatcctatccatcttcctcgtggtgatgaccgccatcgccatggcattcctggcgctcgtggccatcaaggccatggccgcctcgccgtgggctgtgttctccatcggtatgaccatcccgatcgccctgatcatgggctgctaccagcgtttcctgcgccccggccgtgtcattgagaccacgctgctcggtttcgtgctgctcgtgctcgacatcgtcgccggcggatggatcgcctctatcccggccgtggccgccgtgttcacactggacgccaagcagctcgtcatcgccctggtgatctactcgttcgccgccgccgcgctgccgcactggctgctcgtcaccccgcgcgactacctgtccacgctgatgaagatcggcacgctcgtgctgctcgtcatcggcatcatcatcgccaacccgtccgtcaaggtgccgggtctgaccgaactggcctccacctccaccggcccgaccttctccggcaacctattcccgttcctgttcatcaccatcgcctgcggcgccctctccggcttccacggcgcggtgagctccggcctgaccccgaaggccgtggagaaggagaaccagattcgcatgatcggctacggttcgatgctcgtcgaatcgttcaccgccgtcatcgcgctgatcgccgcgatcaccatctcgcagggcgtgtacttctccaccaacatgtccgccgcacagatcaccgccgcatccggcgtgagcatctccgccacctccacgccgggcgaacaggccgatgccgccgtcaaggccgtggagtcgatgaaggtctccgacatcgaaggcaaccagatgcaggtcacctgggattccgtggacgagaacggcgcggccaagacctacgaaggcgccgcggcgcttgagcaggccgccgccgacatcggcgagacctccatcgtctcccgcaccggtggcgccaccacgttcgccatgggcatggccaacttcctcaagtcctacctgggcggccacgactcgatggccttctggtaccacttcgccatcatgttcgaagccctgttcatcctgaccaccgtggacaacggcacccgcgtggcccgctaccagatcggcgaaatgctcggcaacgtgcgcaagctcaagaagttcgccgacccgacctggaagcccggcaacatcatcaccacgctgatcgccaccgcgctgtggggcggactgctgtggatgggcgtgtccgacgcgaacggcggcatcaacgcgatggtgcctatcttcggcatctccaaccagctgctcgccgccgcctgcttcgtgctgatcaccgtgtgtgtggccaagatgggctactggaagcacctgtggataccggtggtaccgctcgtgtgggacatcgccgtgaccttcaccgccgacttccagaagatcttcgggccgctgagctacttcaccaccgcctccaagtatcaggcgcagatcgactccggcgagctgaccggcgaggcgctgaccaacgccaaggccgcgctgtccaacgcgtatctggacggcgtgctctccgtgttcttcctggtcatgatgggcgtcttcgtggtagtcggcatcgtggtcgtggcgcgcacgttcgccgctggcaagtacggtgccgaaacgacgtccgaggagccgttcgtggaatcccagtggttcgcgccctccagcctggtcgccaccgcgcttgagaagaaggtgcagcgcgaatacagcgccaagctgcatgagcttgtgcggaacgggcaggttgcagcgtagtgcgtcattggctccccttttttcaaggggagccaataatcagcgaaaggagacaaaatgctcggcaaactcgttgccgtatggcacggcatcgtctggtatctgcgtgagatcagcggcgaggcccgctacgaccattatcttgagcatttcgcggccgagcatcccggcgaaacaccgatgagcgaggtcgaattcattcgcgcccgcgaggaatacgaccgtctccaccccaataccagttgttgctgctgacaggccgcaatagcataacaacaccataaaacccgcgcgccatgggaactacgtagccattcttccgttacaatcagtgtgacggcttccgcccccgaagaagaaggtgttaattccccttggacgtctcactggcgcatttcctccaacaagtgctttccaacccggctctgaccgtcacaacgttgctgacgctgggagtcatcttcgtcaacggctggaccgacgcacccaacgccatcgccacctgcgtgaccacacgatgcatgcgcgtacgctccgccgtcatcatggcggccatcttcaacttcctcggcgtcttcatcatgacgcagctcaacgcctccgtggcctccaccatcagcaacatggtcgatttcggcggcgacacgaacgcggcgctcatcgccctatgcgcggcgctgttctccatcgtcgtatacagcgtgggcgcctcgctgctcggcatacccacctccgaaagccacagcctgatcgccggcctgtccggagcggccatcgccatccaaggcggcatcggcggcatcaacatgggagaatgggtcaaggtgctctacggtctggtcgcaagcctcctgttcggcttcgccgtcggctggttggtatgcaaggccgtgaccctgatttgcgctggcatggaccgccgccgcaccaacgggttcttcacctacgcgcagatcgtgggcgcggcggccatgagcttcatgcacggcgcgcaggacggccagaagttcatcggcgtgctgttcctcggcatggcgttctgcaatggccaacccagcgtgaccggtgtgatgattccgatctggctcatgattctgtgcagcaccatcatgggcgtgggcacgtccgtcggcggtgaacgcatcatcaaatccgtgggccaggacatggtgaaactcgagaaataccaaggcttctcggccgatctgtcaagcgcgctgtgcctgctcgtcatgaccgtgctcggcatccccgtctccaccacgcacaccaagaccagcgccatcatgggcgtgggcgcggtacgccgcctctccgccatcaacttcggcgtggtgcgcgacatgatgctcacctgggtgttcaccttccctggttgcggtctcatcagcttcgtaatggccaaactgttcatggtcgtgttctagaaaggaatccacccatcatggcgagacaaaaagacacgttctacttcgacggattccgccgcagcgcggactacgcatgccaggccgcgaagctgctgtccgaggtcatgcacgacttcaatccgggccagctgcgcgaacgcatggacagcatgcacgcgattgagaagtcagcggacgaggtgcgccacgacatgatggacgaactggtgaccgcgttcatcacgccgttcgaccgcgaggacatcgacgagctcggccacgtgctcgacgacgtgaccgacagcatcgaaggcgtgctcaaccgcatgtactacgacaacgtgaccgacatgcgcgacgacgcggtccagatgtcggatatggtggtgcgcgccacggaaagcatctgcgagctggtcaacgaactgccgcgattccggcattccaagacgttgcgcgaactggtgttcgccatcaacacgatcgaaacggacgccgaccacctgttcatcgagtcgatgcgcacgctgcacaccacctgcaccgatccgctgcaggtgttcgcctggcatgacgtctaccgtcacctcgaacagtgctccgacgactgcgagcgcgtggccaacaccatcgacagtatcgtcatgaaaaacagctgaggttggtttttcacaacctccctctgatgagccgagccgtgaagaaaacgccggaggcgtttttaggcgagggtgagtgacaacgagcgaataagaggtcagctgcaagctgtcctgaatcgcgttcgaggtggcatcgcgaagcgatgtcggagggagaggcctacttgaccaaaagccccctcacctatgggcgttgagccagaggatggcgagttgggtgcgattggtcaggccgagcttgtccagtatcgcgctgatgcgattgcggaccgtgccttcgctcaggaacagtctggcggcgatgtcgcggttatcgaggccctcggcgaccagcgcggtgatctcacgttcgcgctcgccaagcaggccctcgatggaatcggcggtatctctggaatcgtcggaatcggcaggatccggagttcgttcggtgagcttgccgagcacttccgcgccgagcaccacctgaccggccatcaccgcctgcagcgcgggcccgaccgccgccacatcctgtttgatgagatagcccttggcgccaagtcccatcgcctgcgcgatatacgactggtccgcaaacgtggtcaggaacagtatgcgcgcggccgggtccgtggccagaatctcgcgcgcggcatccaaaccgctggtgccgggcatctgaatatcgatcagcagcacgtccggtcggctcgccggtgtctcgaaataacggcgcacggcggcgtctccgtcatttgccatccatagcacctcggccgtgccggtggccgtcagaatcgtctccaacgactggcagacgatcggatcatcatccacgattgcgattctcatcaatccctcgattccatggtccaacgcttcttcggcacggatacgaacacacgccagccgtcctcatacggcccgcagaccgcggtgccgccaagggcgcgcacgcgcgattcgatatccgccaaacccatgccgcgcatcagctcatcggccgaaccacgcatatcggcaacgccgtcggcggcgagtcgcgagccgacgtgcgtggcgcgcatcgcacgcgggcgggcagcggccgtccgggacccatcggactcggacacggccggccccggatcctgaatgaccaactgccagaacgcggggaagtcacgcaacgtcacgctcgcctcgcgcgccgcgctgtgatgcaccacgttcgacaatgcctcgcgaatcacggtcgcgaaacagcgcgagaccggcgcaggcgccttggcgatatcgttggccagcgtcacggcgaaaccgggggagatgccgtcgaacgacgtgacggcatcatcgatctgcgcggcgaaatcagtgccatcatcctcaagatcatgcaccgaacggcgcaccatcgtcatcgcatcatccaacgtcgcacccaacgtggcgaacccttgcgcagcgaccgtatcgttcgtcgccttggccaccgttttgccggcctgcgcctgcatgatcgcgcgggtcagcagatggcccacattgtcgtggatctcccgggcgatacgcgtgcgctcgccgagggtcgccatgcgaatcgactgggcgcgttcctcatcgatgtcggcgatgcgcgaacgagtggcccgcgaggattcgcgcgccctgtcctgcgcgtgcagcaacgcgcgccgcgcctcgtccgaggaggcgcgggcccggcccagaacgaatccaagcagggcgaccagcgtcatcaccagcgtctggagacggtcggtgccacgggcgaaccagagcgcgatcagcggcaacacccatatccagcgcgcggcggccgaaagccacggggccgaacgcattgcatcggcaagggaacggcgagaggccgcggtccgcgagacactgggggagcggccacttgccgcagtccgtgccccagcccgggctccggtcgaggcgagggccggcagccgtgcagtatcgtaggcgatgagcggcatgaacgcgcaccatgaaggcaccgccacggcgatgacgagatacgccgtacacaagacccaagaccattgcgcgggacgcagccattccaccaatccggcgacggaaacggccaacagcaggccggcgatgaacacgccatcggaccgtagcctgacaagccaggccaaagccaggcccaacacgagtagcaagcccatctcggccaacacgcgcatggcacctccccggctcgacgctcttccaccaccagtctagcggtgtgcggaacacgacgaacttgacgggcgtgcggaattacccgcatgacggtccaagacaacgggcctacacttcccgaatagatgaggcacaagcgtcggatgtcgtcgacacaaccgtaaagggatgataccgatgattacgcaaagccacagggcgtccaactattcgatggacgagatcagcctgatgccggtcgataaggtgtacaaggccatgcagaccgacgccgaaggactgtaatgacaaatgtcacgcctgtacggccaagtcgtgacgtttgcctgtggcggcgtccggccccttcttgggatgatggaatcgccaaggaagggagtgactatgacaaccgacaacagagcttccgaacacgactcgacaaccaacccggctctggccgtgcacgtcagccaactggtcaaacgctacggcgacatggtggcgctcgactattttgaccttgacgtgaaccagggcgagattttcgggctgcttggaccgaacgggtccggcaaaaccaccgcgatcaactgcatcctcgcgctgctcacctacgattcgggcacgattcgcgtgttcggccagccgatgacgccgacctcctacgcgctgaaacgtcgtatcggcatcgtgccgcagaacgtggccgtgttcaacgaactgaccgtcaccgaaaacatcgactacttctgctcgctgtacgtgccgaagaaaaccgaccgcgcgccgctggtcgaggagtccatcgaattcgtcggactccaggacttccgcaagttccggcccggcaaactgtccggcggtctgctgcgacgcctgaacatcgcctgcggcatcgcgcacaagcctaacctgatcttcttcgacgaacccacggtcgccgtcgacccgcaaagccgcaattcgattctggaaggcatccagcggctcaaccaggccggcgccacggtgatctacaccagccactacatggaggaggtcgaacagatctgcgaccgcatcctcatcatggaccacggccggcacctggcgctcggaaccgccgacgagctcaagaacatgatcgacacgggcgagcgcatcaccatcgaaacgctcgatctggcggattcggcgatggccgaggtccgtgcgctgccgtgcgtgatcgaagccacctacgacggcaaggaactcgacgtgcgatgccgtcgcggcgaacacaacctgaccgacgtgctcgacgcggtgaaacgctccggcgccaacatcggccacctgaccagtcgcccgcccaccctcaacgacgtgttcctcgaactcaccggcaaagcactgagggactgaccatgctcccctcagtcggcaagcaaataacttggctcccctctccgaggggagctgtcaccaaaggtgactgaggggagttcctgagtaaggagacatcatgtggaccacatttctggtcgcattgaaagcgaacttgcgtaaccggtcggcgttgttctggatgaccgtgttcccgattgtgctggcgaccatgttcaacggactgttcggcgggctggccgaagcatacgaactcaagccggtgccgatggccgtcatcgaagacacccgttggcagcaggcggacggtgcccgcaccttcgtagacgcgctggccggggaaacggaatcggcctcagacgacacgacctacgccgaaatcgaccaaaagctgctgaccatcaccacagtcgacaccgtgaaggaggccgaacaacggctcgccgacggcactgccaacggctatctgaccgccgacaataacggccgattggcgatgaccgtgagccgggaaaccgccgtcacagccaaggactccacgcaaaacagcggactggacattagcctcgcggccctgcgcagcgtcatcgacctgtacaaccgcaccgacgccgttacccggcagaccatcgccgacaatccacaggccgcgctcagtcggaacttctggaacagcgtcgggcagaacgtcgacatgacccatgagacgacgctcacgcatttccagcctgacgagatcgcccgatactattacgcgctgctggccatgtcctgcatgatggccatgggatactccatcagcacagtcgccgccgcacaggcgaacctgtccgcgctgggcatacggcggaccgtagcgccgctgagccgggccaaacagctcgtcgcgggcttcctctcctgctggctgtgctcgtcggtcgccctgtccatcgcattggcctatatccggctcgcctgcaacgtctcgctcggcggacgcgaaccggcggcgatcctcgcggtcatcatcgcctcgttcatgaccagctcagcaggcaccctgctcggtgcggtgccgaagctctcgtacaacacgaaatacgggctgtcgaccggcatctcctgcacgctgtcgctgttcaccggactgtacggcgggtttgccatgcagatcagcgactggatagcccgcaacgcgcccatactcggcaccatcaaccccgcacagcaggtgacgaacctgttctacgacatcctgtactacgacagctaccggccgttcatcaccacctgcatcattctgctggcgatgagcgcggtattcctcttggccggcatcgcaatgctgaggaggcaacgttatgaacacctgtaaagccacgctgcgcgtgctgttcgcgcaccgggtctacctgatgatctacctcgtattcataggcatcctgatgatgtccatcagctgggcgatgctgacctccgcatccggctccatgtccgcggtgttcgaatcgaccaagacgcgcgtcgccatcatcgaccgcgactccgaccggggtgatatcgccacgtcgatgcgcgcctacctgcgctattccagcgaactggtggacctcgacgacaccagcgaaacgctgcaacaggccgtcgcctcgaactgggtggacctgatcgtcatcattcccgacggattcgctgacgattatgtcgccgcggcggcggacggcgacaatccgccgaacgtggacacggttaccagctacgcatccggctccgggtcgatggcgcggatgaacgtcggcgggttcctctcgctcacccgcaccgcactgatcggcgcgcagacgagggtcgaccaggcggcgctcgccggcatgatgaacgctacaggaggggccgccggttttgatggcgcgagtctggaccaagacatgctggactcgctgccggaagggcaagtcgacaagccggatatcaaggatctgtcccaggccgccaaaatggccgccgaatcggccagcgatacagacgtgaaccatcagatcgccgtggtcgatacgccgaccgaggagtcggcaagcgctgcggatacggcggtcagcggattcggcggcaccatgaaaaccgcgctgtacccgctgtccctggcgatgaccatctgcggatcgatgatcctgggcgcgttcaccaccggcgaggtgcggcggcgtctcaccgcctcgccccgacgcatggtcctgatgggactccagcggttgctgacgttgggcggattcgcgctcgtcgtatgcgtcggctatttggtgctgtcaatcggtctgatgatggcggcggggctcgatccgttgcacctgagcatcgggggagtgctgatgacgttcggcgcgacctgcgtgtacgcgctgatgaccgtcgcctgcggattcatgctcagcgagttcgggctctcggaagaggcggccaacgggttcgccaacatcttcggcctgctcatcatgttcacgtcgggtgtcgcattgccgattgacatgatgcccggcgtgatggtgaccatagccaagttcctgcccggctggtggtattgcaccgcgatcgacaacgcgctcggcttcggcacggcggcggaaaccggcataagcgtcgccggctggtccggctcgctgggattggtcgcactgttcggtgtgatgttcatctgcatcggcctggccgccggccgcttccgccgatcccgccccgccctggccgcgcccgccaccacgcagctggccgagtgagaaatcagcctttcaaccgataccgctgtgccgggtcgtcggcgaacttgactcgggcgacccgcccttccttcatcagctcgcgcataccggatgtggcggccagcggcgtcaactgcagttcgcgcatgatctccttgacgctcatggccgaatgccgctccagtacggtcataatcgccttgaccacgtcgcccggtgaactgttcgccatcgtgcgctgcttggtgatggtcatcgtgaacgtgttgatgtcgttgcgcgtggtcgccggctcgatgccggcctcgcgcaacgcggcggcgatgcgctggtagccgtcgccgccttccgggttcacaaacccgccgcccggatacggcgtggactccagcagcgtgaacaggaactggtttcgggtggagacgaacggcgcgcccgtcaccggatgagggctcgccagcacatcatgtgtcaccatgccgtacaggccacccggattggtgatctcgatgcgatcggtgaacacgctgatatgcacctgcgtgccgcgcgcatcgggcgaataatcacggtgggtgagcgcgttcgcaatcgcctcgcgcaacacgagcggcggatagtcgggcttcttcgcgccaatccaacgcatcaacgagtcgaccgcatcgtcgatcatcaccggaatcgaaccgaccaccgacttcgaggcgaccaatcgttcgtcaccccggaacacatcgtcccggctcgtccccggaaacacggcaatcgaaatgccgagccgcggatagaacttctgcggatagcggcccaacgccagcagtccggccaaggtggggcgcaggattccgccgacctccgactcgtcggaatcatcatggcgcaacacctgcagatccagcagcacatcgataccgtctcggtcggcgaacacgcgcggatgctgttcgcgcacgcgtgccaacagtccggcaacaagctgcgggtcgaggtcatcggtcgtggcgtcgggcacgatatccagatcgtatgtgggctgcagatgctcctcgatgagccggtcgacctcataggaggtcatgcgccggtcgccgtcgccggtacggatgaacgagccgccgtgcggtccgagcgcggtggtgaagcagggcttgtcgcgcggcagcatctcgtcgatgcgcgcgaacaccagattcgcgccttcgaacgggcaggtgacgatcacgggccgcaccaccggcgtcatcttctcgcacgcctggctcagcgcctcctgcatggcgcgcgcgtcgaatccctcgaccggcgtgaacccgttcttttcggacaggcccaggataatccagccgccggagccattggagaacgcggacagcgtatcggtgatggtcgaggagatcttgcgcttgcattccttgacctcgcactgttgcgtatcgttgccgatcagacgcatgagttcgatcagctcagtcattttggcagtatagtcatcgaccatggcggcctccttgaaaccattgtgccccataatccgccgcccgctcgcctccagccccgccagttcaccccaattcatgcagaattcatgggccaaaccagacgaaacgaacgtcgatgtagggttcggttccgcgtgttcgccgatgatatcggccggtcgaggcgggcgggctatgttgggtggcgtgggaatcttgcgcgtgattgatgctacggctgtgtgcttcgctctgggtatatccggcccgatcagcgggactcagccaatgtgatgccgcccgcagccatctgcttgcgggccgcaacaccaagttcctcgctgaccggcacggtcagatcctcgaacacggtgacctcgaagccgagcttcttggcatcgagcgcggtgtccttgacacaatgcgattcggcgatgcccaccacatccacgcgactcacgccggcggccttcagcgcgttggccagcgtcttgccggcggattgctcggcctcgacctcctcgcgggtctggatacggtcggtattgtcctcgataccctcaaaaccggaatatgccgccgaatactggcccttcttgaaatgatgctcgatattcagcgccttgatcgccggatgcaattcggcgttcagcgtgccggccgcaccatgcttcggccacgtgtccacgaaatccggctccgccgaccagtgcgcgcccggctcgatatgccagtcctgcgtggttgcgatatacgcgtactcgctgcgatgcgcgttcacataatcggcaatccgctcggcgaccgcgttgccgcctgcgacacccagttcgccgctttcacagaacgtcggctgcacatccaccacaatcagtgccttggtcatcgtcattccccttattgccttggattcgttttgaatattgtctcgaactcgacgtgcgattgctctcatcatagccatgcgcggccctgtgggaaacgttcgggcttacactgcaagcagcaatcgaatacaagaaccaggggagggcgaccaagaccatgctggaccatctgacgttgcacgtgaaagacatcgaccgtagcatcacattctacaaacaggcgctcgcaccgctcggctatatcgtcaaggcgcatcatgagcctacgctcggattcggcgtggatgacggaaccctgcactccgatttctacgtgtcaccgattgaagggctggaggcggaggcttcgccggtcacgccggtcacacacatcgcgttcttggctgacagtcagcaagccgtgcaggcgttccatgcagccgcgctcgccgccggcggccgagacaacggcgctcccggtccgcgcccgtaccatcccggctattactccgcattcgtgctggacccggatggcaataacatcgaagccgtcgtggattgggctcattcgaacgagtaaaaacatatccgtatcgtgcctcaggcggcatcgacggcgtaggctccaaccagtcggatttgtggtcgcaacggcggtataggtcacatcacgcaagcgtgaaggtgatggtctgctcggcggtttcggtgccgatccatgtgccggctttgcggttccaatccatgccgtccgcgtgcagtgcgtcaatgccgtattgacgtgcatgcgtgaccagccagcctgccgtctgccagcaaagtcgagtgcggttgtcggcggacaggccgtccggcagcgtgatcgtcaacgttgtgctggccgtattggtcgcagcgccgttgttcgtgccggttttgccatttgggggcacaaccgagacattgacattcggcagtgtacctcctatggcggcaaccaacccgtccgcgtccgaggaggttgctggctccaacgcgcacgtgacgcccgccgaccgttcaccggtcagccccgaggcccaagcgcgtgccatcgcatcccatgcggcatatagttccgggtagcctgagcgctgcacctcctgcgcggcgtcctccaccggaatcgtctcccaatccggcacctgcagcagatgatcgtagaagatgtttgtcgcataggtcatgtcggacacctgctccgccgtgccccagccttggctgggccgctgttggaacaggccgagcgaatccaagtcgccgtagtccagattcgtcagcctcgactcctgcatggccgtggcgatggccaccgtcgccgcgtgatccggcagtccgcgcgtgacggcgatgttcgcaatcagcgccgcgttctgcgcctgatcaggcgtcaaggtgcggcgggctccgtcgggcgacaccgccgcgcaatatgcttcctcggccgtgcgcgcggtctcgtgaggcgtgaatagccgtggcagcagcgtccatgccgcgatcagcgccgcaacaacaagtatgacggctgcaatcagcgcgcccgcgccatgggagcggcgtctgccgtaccgcacctgttgtcccattgcgcctccaatatttcggtgtcatggctgaccgtgaccggctggcctatgcagcatgcgggatttgccgtgttccggctcggccgtcatcatgacagcgtggcatatccacctgaacggcggctgcgtcatcacgcgactttgtgacaagtcttcacgcttcatgacatccgcgcaaatcagcccctcgaaaccgagaatggcggtcgggattgctccgacaccaagggagctgctgccgctattgtgtgaaaggcgatttgtaccgggttgaaggagaggaacacatggcacaattgcagccgtactgcgcgattgagggcaatgatgatggattgcccgtcgtgttcgtgcatggcatgggtgtggaccatcgttcgctgatgatgctcgacaaggcgtttgacggcaatgattcaattcgccgtatatatctggatctgcccggtttcggccgtacgccggcattgcccgagcatgcctgcgggctgccggaaatggcggattggctgcaaacggccattgacggccttgtcggtaaagcggctccattcgccatggtcggcaactcgatgggcggtgcgcttgtccgcgaagtattggcgcgcgaacctcgccgagtggccggtatggcattgatcgcgccggtcgtggacccgcagcatgccggccggcatgtggccgaacatgtggttgcacagcccaatcccaagctgacgcactccttgccacaggaacaggtgttcgatttcattaccatgggcgtcaaccagtcattcgacgcgtggcggcgctaccaacggttcatcctgcccggcgtggcgttgtgcgaccgtgcggcatgcgaacgactggatcagcgttattggctggccgataatcccgaggaaatgctcggcacataggcgggtccggtgctcatcgtcaccggcaagcaagaccagatcgtcggatacgaagaccagcaagccctgttgccgcactatcccaacgccaccttcgtgactctggataatgccggtcacaacgcgcacatcgaccaacccgaagccgtcatcacgctcgtgcgcgaatgggtggctcatatggcgttcgttccgttgagctgacggtctgctgacagtctgccgaagcctatatgtatacgagcgaccaatgccggttgacgcaatacgccttgcaaggtatatcgtttttcgatatagtcatatcgatgttcgcggtgtcgccaaaaaaacgtcggcacctgaaaggaccgggctatgaaaaactacatgaaccgatgggtgttgctcgcgttgaaagccatcgtgattctggtctggctggcctgcctatggggccaactattcgccgtaccgggattgagcggcgcgctggccggcctctacccgagccagacgtcgatgcgctggccatatctcattatgggcgtgctgttcctgttctgcatcgaagcggcgttcgtggccgtatggaaactgttctccttgtccggctcgggcgcgaactcgagcaggtgatttgagatgacgattcgcatcaatctcgacgtcatgatggccaaacgcaagattggcgtcggcgagctcgccgaacaaattggcatcactcccgccaacgtgtccattctgaagaacggacgtgccaaagccgtccgcttcaccacgttggacgccatctgcaaggcactcgactgccaacccggagacatcctcgaatgggaagatgacgattgatcgacacgccaccggctcgaactcatggttcaacttgtagtctctcccaaaatcaatgatgccctatcatcctgcaagacgatagggcatcatcatgtgattatgcgcagctgatatgttgcgttgttatcactcggcgtccgcggccggtgcctccttgggcgcagagaggaagtgctcctcgctgggcagcacggtgttcaggatcacggccaccacgaacgccacggcgatgcagttcgaggcgaagatttgttggaacagtgccgggaactgcgtgaagatgtcgctcacctgggtgaagccgatgccgatggtcagcgaaagcgccgcaatcgtgatgttgcgctgcgtgaagcccgcctcggcaatcatctggaagcccgaaagaatgatgttgccgaacatcatgatcgtgcagccgccgagcaccgcctgcggcagcgagttgaacacctcggcgatggccggcacgaagctcgccagcaccagaatcagtccgccggagagaatcaccttgcggttgacgaccttggtcatggccaccaatccgatgttctgtgcgaacgaggtcagcggcagacagccgaacaggccggatacggtggagatcaggccgtcgccggcgatggcgcccgcggtctcgcgttcggtgggcgtacggttcaggcccaccttggtcagcgcggcggtgtcacccagcacctcgaccgaggagacgacgtagagcaggccgatggagatgatcgagccccagtcgaactcaggcttgaacggcatgaactgcggcacggacacgatggcgaggttctggaaaccggagaaatcgaccttgcccatgcagatagccgccacatagccgaccaccagaccgaacagcacggacagctgcttggccgtgcccttcatcaacagctggaacgccaggcaggcaaccaaagatataagcccgagcgtcaggttctgccaggaaccgaagtccttggctccgctgccgccgccgaagctcgtggcacccacgttgagcagcgagaagccgatcgacgtgaccacgatggcggagacgatgggcggcacgaaccgacgccaatacttggccgtcaaacccagcacaagttccagcagaccgccgaccattaccgcgccgaccaccgcgccatagcccttgtccgcgcagatcgccacggcggccgccacgtaggtgaaggagatgccggtgaccatcggaagtcgcgagccgatgagccacgcgccgtacagttgcaggcaagtgcccaggcccgcaaccagcaggccggactggatgatggtggccgattgggccggggtcatcttcgcggccgaggcgacgatgaagatcggggcgaggttcgccacgaacatggccatcacatgctgcaggccgaacggaatgcccttccagaaggatactggcgcgtccagcgaagacaacgcctcaaaggatacggaatgattggttttcttctctgacatgattctcttcttctctctgttgctcccgccggcgggagcagccaatgtgctcagtgcctaaatgtgatttcgccggtctcgggattcatggactcgacgatggccagcgaatccacctcgtagccttcagcgcgcagcgcgtcaccgccgccctggaagcccttctccacggcgatgccaatgccctcgaccgtggcaccggctgcttcgcacagatcgatcagaccgcgcaacgccttgccgttggccagaaaatcgtcaataagcagcacatggtcgccggcgttcagatacttcttggccacgatcaccgggaactccttctgcttggtgaaggaatagaccgtggtggtgtactggtcgccgtcaaggttgatggactgcgccttcttggcgaacaccaccggcacattgccgaaatgctgggccgccacacacgcaatgccgatgccggacgcctcgatggtcagaatcttggtgatgtgcttgccggcgaaatgagcggcccatgccgaacccatgcggtcgaacaggcgtacgtcgcactggtggttcagaaacgcgtccaccttgagcacattacccgccttcaccgttccctcgctttggattcgctcctcaagttcctgcattgaacctcccattgttgtatgtcagtgaatgatatggatactcgtaagtgtacgttgtcctgcgctgacccgtgcatgtggtaaacatgaatgtcgcgattcaaagggaggcaacagtgtacgacgagccggaagtcatcgcacgcagcgcacaggaactcgtgggcgacctgaacccgcagcaggcggaagccgtgcaataccgcggtcaggcgctgctgatcggagccggtgcaggctccggcaaaacccgcgtgctgacccgccgcatcgcctggatcttgagccagttcggcgcatggccgagccagattctagccatcaccttcaccaacaaggccgccgccgaaatgcgcgaaagactcggctcgctgatcggcccggtggcccagcgcatgtgggtctccaccttccactccgcctgcgtgcgcattctgaggcgcgacggcaagtccatcggactcaagtccggcttctccatctacgattccgccgactccgagcgactcgtcaaaatcatcgccaccgaattcaacctcgacatcaagcgctacactccacgctcgattctcggccatatctccgacctcaagaacaatctgaccggttggaaggaaaacctcgccgttcacgcgcccgacttcacgcccggccagcgcggctaccagttcggcacggtgggcgaccttgaagccatctacgcggtgatctacgccgaatacgagcatcgcttggccctggccaacgccgtcgacttcgacgatctgatcggccgcacggtcgagttgctgcgcactgacccggccgtcgccgagtactaccatcaccgcttccgttacattctggtcgacgagtatcaggacaccaaccacgcccagtacgtgctcgtgcgcgagctggccggcgtggacacgggggagaaggccatcccgggcgcgcctaacgccggcaagtccggccccgcctggatcaccgtggtgggcgattccgaccagtccatctacgcgttccgtggtgccgacatccgcaacattcaggacttcgagcaggacttcccgaacgccaagaccatcatgctcgaacagaactatcgttcgacgcagaccattctggatgcggccaacgcggtgatcagcaacaacgagggccgcaagcccaagaaactgtggaccgcgctcggcaagggcgagccgatcgtcggctacgcggcggacaacgcccagcaggaggcccagtgggtggccaccgaaatcgcgcgcctgcacgccgaagcgggcatcgcctactccgacatggcgatcatgtaccgcgccaacgcccaatcccgctcgctcgaagaggcgctgatcaacacgaatcagccgtatcagctcgtcggcggcaccaagttctacgaacgtcgcgaaatcaaggatgcgctggcctatttgcaggcgctcgtcaatccggacgacgatgtgaatctacgccgtattctcaacgtgcccaagcgtgggcttggcgaccgcgccgaaggcgtgctgctcgcctacgcgcgcgagcatggcaccagcttcttctacgcactcatgcacttggatgagatcgaggtgccgacacgcaccgccacctcgctacgagcattccgcgatctgatgggcgcgctctcgcagttcacgcgcgcgcacgactccaagcccagcgagatcgtggccgaagtattggagaagtcgggcttaagggccgaactcgagaaatccgtggacccgcaggacgcctcccgtctggagaacctctcccagctgcagtccactgccgccgaattcgaacagaacacgcctgacgccacgttgtccgcattcctggagaccaccgcgcttgtggccgactccgaccaactacccggcgaggcggaggactccggcaaggtgacgcttatgaccttgcacaccgccaagggcctcgaatacccggtggtgttcctgaccggcatggaacagggcaccttcccgcattcgcgttcgatggaagacaccactgaactgcaggaggaacgccgactcgcctatgtgggcatcacgcgcgccaagcagcgactgtatgtcacgcgcgccgccgtccgctcccagtggggccaggccgccgatatgatgcccagccagttcctcgacgagattccggattcgctgattgattggaaacgccgtgaagccggcgtggagcgtatgcgcgccagctgggagaccgatggattcgccgacgatttgggcggctgggatgatgacgattttggcggcgccgcgtttggcgggtcgtcgacgttcggctcgcgtggttcgtccggttcgggttcgtcctatgggtcgcggtcgcggtatgggtcgtcgtatggctcgggttccggctcttcgtcgtatggttcccgttcatcgtcgtatggttcccgctccggctcgtcctcctatggttcccgctcccgttcgggttcgtcctatggttcttcaggctccggttcgaggtcgtcctacgggtcgcgttcccgttccggttcttcgtccggttcatatggtggcacccgtggcggcaaggtcaccacgcgtcgtaccgcaccgaaatccgattcgaccggctctgccgtgcctagctcgaagctcaccaaggacaatggcctgaatatcgccgacttcgccgtgggcgacatgatcagccacgaccagtacggtctcggcaaggtcaccgacgcacaagacaagggccgcaattcggtaatcaccgtggacttcggctccgccggcgtcaaacgcctcatgctccgcgtagcgccgattgagaagttgtagataaattggcccctctgacgaggggctgagttatataccaaataaattcgcaaaaaacaagacttgtgttcttcatcacagtgtgggcataatgcggaggttgtgcctacgagccctgggaacaggggagaggaaaaagtagttatgaagaacaagctgtttgcatccgtgcccaatattctgttcggcgcgctgatcaccatcgcgccccagacctttgcgcacgcctgcaccggccatgacatgccgggtgcctgccactactcgcagcaggcggccaccggcatcggcgtcgtcatcctcgtgttcggcgtcgtggctttgttcgtcgccccgcagattcgcatcggcctcaatatcgccgccgcagccgacgccctgctactactcgccgtacccacctttctgatcggcatctgcaagggcgcgatgatgcactgtcgcatggttatgctgcccacgctcatcgtgctcggcgtgctcaccatcgtgttcgcggccatcgccatctggctcgactctcgcgccgccaagcgcaactgatcgagcagacggccggagcccagccattccgaacgctggactccggcctcgcttattgcaaccgcactataagcaacataaggattcatcgtgccatcccatatcgcattgcgcggccttccgattgaaaacctcaaacgcaagccgttccgcaccggcgcactgctcgccgtcgtcaccatcctcgcgctgacattcttcggcggcaccatgctgaccatgaacctcaacactggcatgaccagtatggaaaagcgcctgggcgccgacctcatggtcgtgccgcaaaacaccgtgcagaaggccgaagcgctgctcatcaacggcaatcccagcactttctatttcaccaaagacatcgccgacgaggtcatgcaggccgacggcatcgcacaggccaccgaacagacctatatatcatcgctggccgccgcctgctgtgccgaaaagctgcagatcatcggttacgacccggacactgacttcgtcatcgaaccatgggtcgcctcccagttcgaaggcccccttgaagacggtcagatgattgcaggcgcaaacgtcaacgtgtccaccgacggcaccatcgaactctacggccgttcatggccggtcgtcgcccagctcgccaacaccggcaccagcctcgacaactcggtgttcatcaaccaaaacaccgtgcccgacatggtcgccgcctcggccaaggtctccaagcaggtcatgtccgccgaatatgccggcaaagccgtctccaccgtgatgattaagacgcagcaggggtacgaagcgcagaccgtagctgagaacatcaagcgtcttgattcccgattcgccgatttggggtacgtataccccggcggcatcaccgccaacaccagaacttcgctgaccgcgcttgtcacctacctcaagattttcgtggcggtgatctgggtaatgggcgtgattgtgctgctcgccgtattcgcctcgtcggtgaacgaacgcaaacgcgaattcgcgtccctgcgcatcatgggcgccacgcgcggcatgttgaatgccatcattctgaaggaatccgccatcatcggtctgatcggtggcgtaatcggcgtcggcgcggccagcctggtgattttcccattcagttcgctgatcggcaaacagcttcaattgccgtatctgcaagccagcccggttgcggtgatcggattcattgccgtgaccattgtgtgctctacggtcatcggcatcatcggttcgctggccaccatgtggcgtctcggccggcccgaagcctacctgaccctgcgagagggggagtgatatgactgagacaactacgccgcttcagccgaccacggttgagccgaccaagctccagccgaccacgccagctcagccgaacgcgccgactgcgccggattcgccgcacgtaaccgagacgccctccccggaccatctgctgaccttgacggacctgacccgccagttcgtccgccgcggcacgccgttcgacgccgtcagccacgtgaacctcaccgtcgatgccggcgaattcatcgccatcgtcggccggtcgggcaacggtaaaagtacgttgatcaacatggtcgctgggctgattcgcccgacctcgggaaccgtgagcgtggctggacgcaatgtggccgacttgggcgataaagcactgtccgtgctgaggaatcgcaccatcggattcgtgactcaaagccagaccctgctcggcaacctgaccgtgctcgacaacgtgattctgcccgcaacgatgtttccggagccgctgccgttcgcccaaaacgcagaagcaacggatgccgtggcgcaagccgctgccaccaatgatgaagcggccgccgattcagccgccgacccgttcatgccggatgtcattgcgccaatcacagaccaggaaaacacgccgtcaaacacggctgcgagccgttcggacctgttcgccacccgagctcgcacgctgttcacccagcttggtgttgccgatctggcagacagctacccgcgcgagctgtccggcggtgaaatgcggcgcgtctccatcgcccgcgcgctgatgaaccagccgagcttgctcatcgccgacgagccgaccggcgacctcgaccaagagagcaccgacatcgtaatgcgtctgctcagagaccaagccaacaacggcacggcgattctcatggtcacccatgatcccgatgcactcgaatacgcagatcgggtgtatcgcatggacgccggagtgctgtccatagcctcggtgtaatatggtctgctggtgtctgccaacaggtagataccgtctggagtcatagcccatcagcgggtcggcggtaggtaatcgcaagaaaaccaacccgttcgtgtttattcacgacgaagcgctggggaggcccgactcagcgcttgttaggcatatgcaaggcaagcgttccgttcagataacgacagaaggattaatccaatgacgaacgttcagcgttctcgccgtcaggtgcgtctgtctcgcgccctcggcatcgcactgacccccaaggctcagcgcatcttcgaaaagcgtccgtacgctcctggcgagcacggccgtgaccgccgccgcaccgagtccgattacgcggtgcgtatgcgcgaaaagcagcgtctgcgcgctcagtacggcatctccgagaagcagcttcgcgccgcttacgagaaggccacccgtactgccggccagaccggtaacgccatgctgaccgacctcgagacccgtctcgacaacctggtgctgcgtgccggcttcgcccgcaccaccgcccaggcccgtcagttcgtggtgcaccgtcacatcctcgttgacggcaacatcgtggaccgcccgtcctaccgcgtcaagcccggccagaccattcaggtgaaggccaagagccagaccatggttccgttccagatcgccgccgaaggcgtgcaccgtgacgtgctgcctgcggtccccggctacctcgacgtgaacctgccgtccctgaaggccactgtgacccgtaagccggaggtcgaagagatcccggtgcaggtcaacatccagtacgtggtcgaattctacgcccgctgatccgggccctctggtcaacaaatccaggacataccgctcgaaccccgcgcttctttcgagaagccgcggggttcctgcgttgtagggcgattactggccgcacaccgcctggcgaatcatcgtcgcgtacgcataggcaccggtcatattcggatgaatgccgtcatcgttgaggtattcgctatgaccttcgctatacccatgccaatcgatgatgcccacgttcttgttcttcttggcggcctcacgcagcatcgtattgttgttgttctcctgccacgggtatggcatacggatggtgatgaagtatgtcggcttgccgccggtcaggtcaatgagctgttgcacttcctgctcattcgaaatcacgccgttcgtgccgaggccaaacaccaccacactgccactgtggccggcagcggtgtcctgctgatacacatccaccgcctgcggcagctgacggttcggcaggccatcgataaaagcgttcgggaatgcggcctggatggcgtccgaagtacccgacgtcactgaatcgccgaccatcatcatatccgcgttgcagctttccgttgccggatcataggcgtacttcgaaatgtcaagattgtttggcaccttttccgcaatcggtttgatgatgggcggctgagaatccgaaccgttcttattcgcgtcagcggtattggtttcgccgttcgcggcatttatggcagaagactcgggctcgggcttcgccggtttcttgaccggcttggcgggtgccgcgagttcggggcgcagctgaatggctcgcgcttgagcgatgccattccagtccaccggtgcccacgtcagcgccacaacggtcaccaatccgataaccgacatgacccacgcgcccgggcgcagccggtagccggctttcggcagcggcttggcgtgttggctacgaggcatctgcaccgatttacgggccgcctcgaccagctggtagaaggcttccgacgccgccaacaccacgacggcctcaagaacccaaccccaccacggcaacgcctgcgttcgtgtcgccgggttcatgaactgcagcagcggataatgcatgacgtacagcgagaacgatcgcgacccgatatagcgtaggggagcacaacccagcacgtgcgaccagattgagtcattgttcacggcacaggccaaggcgcacaacgatatgaacgcggtaatcaggtacccgccttggtacatgtacgacagatacccgttggcgaaccagaatccggtcagcagtgccgccaaagccgcggtgccaagaacattgcagacgatagtgagacgggcgcccgtcttgtcgccggcctgacgttcgatctgcactgtttgcgaagccgctccagcttccgcagcttccgtacctcgcgaggaaggcgcaatccagatagccaacagcgcgccggcggccagctcggcgaggcgagtatcggtaccgtaatacacgcgggaggtattggccgggtcaaacagcagcaccatgtcggcggtggaagcagccatgatgacaagaatcgccatggagcgcacccatttggacttggtgattttgccgagcaccaccatcagcaacggccaaaccagatagaactgcatcgtcacgcccaagaaccacagatgggtcagaggagaaggcaatccggccgcctcgaaatacggcaccttgcggaagatgtacacccaattgctggcgaacaaggcgctcggcagcgaatcggaaaccactttctgcaacaggctgggagcgaacatccaagtgagccaaggcaccacggcaatggtcgccagcatcaccggccataaacgagtaatgcggcggatcagatatcggccatatccaaaggacccggtgcggtccaccatgttcagtaccgaacgtgtggcaagaaaaccggtgataacgaaaaacatcgtcacgccaatgaatccgccctgcaatagcgacgggcgggtgtggaatgctatgactccaagaatcgccagagcgcgcagtccatcgatacccctgaaatgggcaggcacagacgatcgagatggtgcaggtttcaaggttatgctcacagtattctaagtgtactctcaggaatcgttaggtatactgcccggattacgcatatctcaggtagtgacctatgccgttatgacttatgacttccggcaacccgcaccgaaaccgccggaatggtgacataatcagaaccatgattcttcatctgcatctggtccgtcacggacagacctatttcaaccgatacaaccgtctgcagggatggtcgaattcgccgctgaccgagtcgggcgtcgccgatgccgtcaaggccggtgagcgactgaaaggattgacgttcgccgccgcctactgttcggacaccacgcgtgcccagcagacggccgagaaaattctcgacatcaacgaagccgcgggtaacccgcgccccgcactcgtgacggacatgcacttccgcgagcagttctacggctactacgagggacttgacatggccatggcctggtacgccgcgggagcgccccacggcgtcaaaacctacaaccaaatcgtcgagaagttcgggttgggggcctcgcgtgattttctcaaggaagccgatcccttccacgacgcggaatccgatgaggaatattggacgcgcgtcgaaggtgcgttccgtcttatcgccgacaacccgaatctcaaggacggcgacgatgtgctgcagatttcgcatggcaacacactgcttagcctcggtcaccggttcggcggccctgacctcgatctgaacgaacgcccggccaatggttcggtaaccgtgatcgacttcgacaccgacaagccgttcggcgaagccgtgaccatcgtttcgtacggcaagtagcaaatagcaagcaatacatatcgaatagcacgtacggtccacggcggcacgccgcaaacgaaagcgtcagcaggacagcctttcgcctatagccgcatacgcccacgcgcacggttttcgccctgcgcatgcaatggtatgccaagaaatagggaaggagtgctacccttaggcgagtaagtgtgaccgcaaggaggaaacaatgggagtcggagagatcgctggcctgatcgcggccatcgcgttcgcagtattggccggtttcatgatctatccgctgatcaggctgggcaagatgtttgatcagatatcgcagacggtccgggagtccggtgaacacgccatccccgcgctggacgaaggcgtgaccaccgtcaagcaggtcaacaagtcgctcgaagacgtgaacaagatttccgccgcggcttccaccaccgccaacaacgttggtgcgttgaccgatctgtatggctccttcctcggtaagcccatcatcaagatcgcttccaccttctacgcgctgaaaaccacgggtcagtccttccttgcgaagaccgccgcgaaaaccaccgtcaacgacaccgccgagaagggggagtgatgttcaaacgcatcttctgggtcggcgtcggcgtggccatcggaatcgttgccgtcaccaaggcacaggcctatgtcaaggccaatacgcctgatgcggcacgccagttcctgcttggccccgatcaggacaatgtgccgatgaaaacactcgaagggttggtcaacgagttcaatgccacccgtcgagcccgcgaggctgagctcaaccgtcagtacatcgagcgcgccaactgacacgcgcatgccgccttgccatctagtcactgaatcagctagaacaaactaatcctcataatccagtcttttccaccaataccaggcgcaactgcgcccattacccaaacaaggagttcatccgctcatgcgcactgcggacatcgcaaagcgatacctcgattattttgccaagcacgaccatctcatcgtgccctcggcatccctgatttccccgaaccccaccacgcttttcaccatcgccggcatggtgccgttcatcccgtacctgatgggtgagcagaccccgccgaagcgccgcatggcctccaaccagaagtgcgtgcgtacgctcgacatcgacgaggtcggcaagaccacccgccacggcaccttcttccagatgctcggcaacttctccttcggcgactacttcaaggaagaggccatccactacgcctgggagctgctcaccacctcgcaggatgagggcggctacggcttcgaccccgagaagctgtggatgaccacgttcaccgacgatgacgaagcccgttccatgtggatcaacgagggcgtggaccccgagcacatccagaagatgggcatggaagacaacttttggaccaccggtggccccggacccggcggcccctgctccgaaatctacgtggaccgcggccccgccttcggcaaggaaggcggcccgattgccgacgagaaccgctacatcgagatctgggacctcgtgttcgagaactacgaggtcgacaacgtcaagtccaagaccgacctgcacatcgtgggcgagcttgagaacaagaacatcgataccggtgccggcttggaacgtctggcctacctgctgcagggcaagaacaacatctacgagaccgatgaggtcttcccggtcatcgaggccgccgagcagctctccggcctgaagtacggcgagaacgaggacgccgacgtgcgcttccgcgtggtcgctgaccacgtgcgctccgccctgatgatcatgtccgacggcgtgcgcccgtccaacgtgggccgtggctacgtgctgcgccgcctgctgcgccgcaccgtgcgctccatgcgcatgctcggcgtgaccgatccggtgctgcccaccctcttcccgacctccaaggccgccatggaggccagctacccggagctcaacgacaccttccatgaggtgtccgaatccgcgtatggcgaggaagacgccttccgccgcacccttgagaccggcaccacgattctcgacgtggccgtcaacaaggccaagagcgattccgccgagcccgtcgtggccggcgaggacgccttcaagctgcacgacacctacggcttcccgattgagctgaccctcgagatggccgccgaacagggcgtgaaggtggacgaggccaagttccgcgaactcatggccgagcagaagtcccgcgcccgcgccgacgccctcaagaagcgtcacaacgtggatctttccgtttacgacgacttcaagaagacgctcgtcagcccgatcgacttcctcggctacaccgacatgtccgcccgcgccaaggtgatcggcatcatgcaggaaggcaagggttccgtgcccgccgtgaccggcccggccaacgtcgaggtcatcctcgaccgcaccccgttctacgcggaggccggcggccagctcgccgaccagggcgagatcctgtccgacgacggcgccgtgctcgaagtcgacgatgtgcagaagcccatcaaggacctcatcgtccaccagtgccgtctgaccgaaggcacgctggtcgtcggcgccgaagtcaacgccaacatcgacctggcccgccgtggcgccatcgcccgctcgcacaccgccacgcacatggtgcacaaggcgctgcgtgaggagctgggcccgcaggccacccagcgcggctccgaagacgccccgaaccgtctgcgcttcgacttccagtggtccaaggccccggccaagtccgtgatctccgcagtcgaggagcgcgtcaatgacaagctgcgcgacaacctcgccgtgaccaccaaggaaatgaagttcgacgacgccatcgccctcggtgccatgcacctgttcggcgagaagtacggcgacatcgtacgcgtggtctccatcggcgaagacggctggagccgcgagctgtgtggtggtacccacgtggaccacgttggcaagatcggcatggtcaacatcctgtccgaagcctccatcggctccggcgtgcgtcgtgtcgacgccgtcgtgggccagggtgcctatgacttcaacgctcgtgagcacgcgctggtctcccagctgtccgacaagctcaacgctcgtccggacgagctcgccgagcgtgtgaacgccctgctcgccaagctcaaggaatccgatcgtcgcttggcctccatgtacgagtcccagctggccgcctcggttccggcgctggttgctgacaccaagaactccgcggccccggtcaaggtggccgtcaagaacgtgggccactttggcgcggtcgatgccctgcgcaagaccgtactcgacgtgcgcgcccagctcggtgaagacgcccccgtggtggtggcccttgccggcgtgaacgaggatgacaagccgatggtcgccgtggccaccaacgaggccgcccgcaaggccggcatcaaggccggtgatctggtgcgtggcgcagccaaggtcctcggcggcggtggcggcggcaagccggacttcgcccagggtggcggtgtcgatgcctccaagatcgacgaggccctcgaagcgctcaagcacgaggcgcagaaagcctgattccgccagtggtgtggttaggcgttgatttgggtaatgcccgggtcggactggcactgtccgacccggagcttacctttgcacatcctgctggcaacattcatgttgccggcgactatttctttgctattgacgaggtcctgaacgtcatcgaagacgaacatgtggaccatgtaatcgtcggactgcccctgcagatggacggtacagaaggcaaaagcgccaaaaaagcgcgcaggtgggcggccaatctggagaagaggctgcaagcagagagtgaagacagtgattctacggagtatcagattccgcaggtatcgttgatagatgagagattgacaacagtcagtgcgcatcgtcagctgttcgaggcccataaagcttcgaacaagcacaggccggtggttgaccagcagtcggcagtggtgattttgcagacggcactcgaccgtacccgggagcagtgaggtatcggttatgaccgatgattttaacgagttctttgatgacaacacgcattgggtcgaacaggggtcagaaccaatgcgcggggccgagccgccagaaccgccgaaatcccgcagggagatgcgcaagcgacgtgcacagcgcaggcgcaagcgtatcagtggcattatcatcgctatcgccatcgtcgccctgcttatcggcggcggctatttcggcgtaaccaagctcatcgcatggcgcgacagccggagcaaccagtcgacggccatcgcggactatccgggaccgggctatggcgaggtcgaattcaccgtgagcgagggccaaggcgcggcggagatcgccgataatctgctcaaggccgaagtcatcaagtctactgccgcgttcaccagcgtggtcaacgccaatagcacgacactctatccgggaacgttcacattgaagaagcatatggccgcatccaaagtgatcgacgttctctccgacaccaaccaggcggcgggcttcctcgaggttcgtcccggtgaacgtgccaccgatgtgttcgccaacgccgcgaagctttccggcattgcccaaagcgaattcgacacgattatcaagaacaagggtaaggatattctgcccaatgaagcgggcggtagctttgagggatggctggagccgggaacctacaacgtcaagagcatgaagagcgcttcggaaatcctcaaggccatggtcgataagcgtatcgccaagttggatgaattgggcgtgccggccggcagtgaccgcgaacgggtgatgatcatcgcctctatcgccgaggccgaggtcaacaaagccgattactacggcaaagtgacgcgagtcatcgcgaaccgtttggagcagggcatgtcgttgggcatggattccaccgtggcctatggcaataacgtcaagcccgcgcaggtgaccaccgagatgacccaagacgagtccaacccgtacaacacgtacaagatctccggcctgccgcctacgccgatcagcaatcccggcgataacgccattcaagcggcactgcaccccgaaggcggcaattggctgtacttctgcacggtcaatctggacaccggcgaaaccaagttcgccgcaaccgccgatgaacatgaccagaacgtggccgaactacgcaagtggcaagccgaaaaccagtagtcatcccgttagcttccttcgcttggggaagctgatcggacgttggtctcttcattggctccctcgccgaggggagctgtccgcaaaaaagcggactgaggggagcactgcagggaatgtaacgctcaacttaagcccggggctcccgcgaagcggatggaagaaatctaggacaacaccccaacagccaccgccacaatcgcgcccgccaatatcaccggcacatacggcaccttgcccgcatgtgccggtgatgtgcgttgtgggtcgaatcgcgtccacaaggcaatccatgtgatgccggcaacgcccatcgccagccaccagaccaccacaggcaacaggccaaacagtccgacagacaatcccataggtatcaaggcggtcacatcgccgaatcccaatgaccgaggcaccagcaacgccaacgcgaactggatcaggcaacatagcacggtgaacaacagcgcctgcaacagcacgaacaggtcgttcaccaccactccatacgcgaaatcggcggccagctgaagcaacgcgcccgcagccacccacgcgatcggcacccgccgatgacgaacatcctcaatggacagtgcaagcccacatagcagaccgggtagcgtgaacaggtatggcatggcttaacattaacccctagctagacgtacacatagacgtacacacatgaaacgagggaagttatgctgcgttggcagacggcaggggagtctcacggagaagcattggtggccatgattgaagggttgccggccggcgtgcgtattagcacggacgatatcgtttccgcactggcacgccgtcgacttggatatggtcgcggtgcccgcatgaagttcgagcaagacaaggtccgtctgctgaccggtgtacgccacggcctgaccctcggctcgccggtggccatcgaaatcgccaacaccgaatggccgaagtggaccgaggtcatgagcgccgatgcactcgaccatgacctgccgcgcgaaggccgcaatgcgccgctgagccgcccgcgcccgggccacgccgatctgaccggcatgcgcaagtatggttttgacgacgcccgcccggtactggagcgctccagcgcccgtgagaccgcctcccgtgtggctttgggcgaggtggccaagcagttcttggatcaggcgttcggcatccgcaccgtagcccacgtggtggcgcttggtggcgtgcagaccaaccccgacctgcctctgcccacccccgacgatctggaagcgcttgatgcctcgcctgtccgtacgctggacaaagaggccgaagcccgcatcatcgaacgcatcaacgaggccaagaaggcctccgatacgttgggcggcgtgattgaagtgctggcttacggtgtgcctgccggcatcggcacgtatgtggagtccgaccgccgactggacgcggctctggcctccgcgatcatgggcattcaggcgttcaagggtgtggagatcggcgacggcttcctggaagcctcccgccccggttcgcaggcgcacgatgagatcgtggtcaacgccgacggccgcatcgaccgtctgtccaaccgcgcaggcggcattgaaggcggtatgtccaatggccaggtgattcgcgtacgcggtgccatgaagccgattccgtccatccccaaggccctgcgtacggtcgacgtgctgaccggcgaatccgcacaagccatcaaccagcgttccgacagcaccgccgtgcctgcggcatccgtggtggccgaggccatggtgcgtctgactttggcgaagtacgcgctggataagttcggtggagacagtgttgccgaaacacggcgcaaccttgagtcgtatctcgcctcgtggccggagcacatgcgctgaacgaagggcgtatggtttcgtgacgactgccgcggaaccatcagcaactgtactcaccaatcgtcgagaggattcgtagattatgaccgcacgcccccgcgccgtcatcatcggcatgatgggagccggcaaaacacgtgtcggtaaggaagtggcgcatatgttgcgtctgccgttcgccgatgccgatgtggagatcgaacgtgaagtgggcatgaagattccctcctacttcgaggaatacggtgagccggcattccgcgaggtcgaggccgatctcatcgccgatatgcttgaggatttcgacggtatcttttcgctgggcggtggcgctcccatgacgccatccacccagcatgccctcgcctcctacatcgaccatggcggtcgtgtggtctaccttgatgccgatccggcggaagccatggaacgcgcgaaccgtgggggaggccggcccatgctcaatggcaacgccaactcccgttggaaaaaactgttcaagcagcgtgacccagtattccgcgaggtcgccaacgttcatgtccatacccgggggcttacgcctcagggcgcagcgaagaaagtgattgatatggtatctgagcgagcagtgcatgttaccggagcggcaattgagccgtatgatgtggtcattggcgaaggtgccatgaaccatctggtcgacgtgctgggacccaaacccgccaaaatcgcgcttatccacactcagccggtgcagcgacactccgatcgtgcccgcgccctgttgcgtcagggcggctatgaggtttccgacatcgtgattccggatgccgaacccggcaagaccattaccgtggccaacggcatttgggaacgccttggcaacgaaggtttcacccgatccgatgccgtggtggggcttggcggcggtgccgcaaccgatttggccggtttcgtggctgccacgtggatgcgcggcgtgcgctatgtaaactgcccgacctcgctgctggccatggtcgatgcctccaccggtggcaaaaccggcatcaacaccccgcagggcaagaacctcgtcggctcgttctacacgcctgccggtgtgctggccgacaccaagacgctggctacgctgcccaatgacatcttcatcgagggtctcggcgaagtcgccaaatccggtttcatccgcgaccccgaaatcctgcatatcctcgaagaccacgcagctgaactgcgcgctttcgacggctctacattcctcggctcgccgctcgaagacgtggttgccgagctcattgagcgcacggtaaaggtcaaggcctaccacgtctcctccgatttgaaggagaagggtctgcgtgaattcctcaactacgggcacacgatgggccatgccatcgaaaagctcgagcatttccgctggaggcatggcaatgcggtggccgtcggtatggtgtatgccgccgagctggcccatctgatcggttacatcgatcaggatctggttgactatcaccgctcgttgcttgcttcgatgggtctgccgacgtcgtggaatggcggctcgttcgacgacgtgctcgcattgatgcatcgcgacaagaaggcccgcggcaatgagctgcgcttcgtggtcctcgacgagattggtcacgtcgtacacctcgacaacccgcccgccgaagccgtggaagaagcattccgtcgtatccagcagtaattgaacggccgtaggccgtgccgttcgccatcccctcagaaaaaagtacttggctcccctctaacggaggtaccccggagtcggatttaccttctacctccctctgatgagggaggtgccccgaaggggcggagggagagaagcacaaacaaaaggagtcccaatgaccaaagtcatcgttgtcaatggccctaacctcggacgtctcggcgtccgccagcccgacgtctacggtcgtcaagacctcgacaccctgcgcaagctctgcaccgaatggggcaaggacctcggcctcgaagtcgaggtgcgccagaccgacgacgaagccgaaatggtgcactggatgcaccaagccgccgacgagaaaaccccggtggtcatgaaccccgccgccttcacgcactattcgtatgctctcgccgacgccgcgcacatggtcattgacgagaacctgccgcttatggaagtccatatttccaacccgtccgcccgcgacgagttccgcaagcgttccgtaatcagccctgtggccaccggcaccatcaccggcatgggtttctacggctacaagctcgcgctcgatgctgtggcgcacttgctgagcgaatagaaccaagccctccagccaatcccgggtagcagtcgacgttgcgcccgggattcctgttacctgaggaaaccataagcgtccaagtaaaggaagccatgactctcaccgccacggaacgtgatctcgtcgatgccgcgtcacgctggtttgacgcccaccgcgcacagttcgtcgatgagctgtgtgagctgctgcgctacccgtcggtttccgacgaatcggacccgaatcctcgtccgggcgcgccttatggacccgaagtacgccgtgtattcgaccatatgctggccaaggcaggacgagacgggctgcctacgcgcgactacaccggccacgtcatggaagtcgtttatccacaggagaacgtggagaccgaccgtgacatcgccttcgtcgaccacctcgacgtagtccccgccgacgacggttggacgcacgatgccttcgatccgcaggttattggcgatattgttatcggtcgcggctcattggacaataaaggcgtcgcgctgaccagctatttcctactccgtttcttcaaggaacacgaccaccgtttccgccaccgcgtacgtatactgttcggcggctccgaagagatcgcgctcaacgacatcaaatggttcgtcgccaacatcggcgcgccgtaccaggccatcgtcaccgatggtcccttcccggtgaacaatatccaaaaagggctgctcgatgtggatgtcgaactgccggtcgggccgcaattgcgcggttggcatgccggcaccgccactaacacggttcccggggccgccgcaatcaccctcaccggcgtcgacgaatctaccgtgcggcaagcattctgccagagcggcaacatcgctccagatatcgccgagcgattgcatatcaacgcaacagcgcaaggcgtcacgattgaggccaccggtgtcgccggtcatgcctgccagccgtccggtaccgtaaacgctatagcggtgctcactacggcgcttgcccggtccggtctgctcgaaggccgtgacctcactgcagcgcaggcgattgcccaatggacaaaagactcatatggcaccggcttgggtatcgattgcgagaatgcggaaagcggaccgactaccgccaatggtggtttgattataccggcgaatgagttcgctgaagcagaccccgttgtctaaatgaaagtgcaacacccgttagattggaaattgcctagaaaacgttttctaggcaatttccaatctaacgggtgttgcactttcatttagacaacggggaatgacattcgtgggcgattcatccgcgcccgtctgcccttggccggctcggcatcttcgcggcgcgtggaacgcatccgagaccttcgatacagtgggctgcatgcatattcctacacaacgggagattcgataccagtgggagcgcggtggtccggtgatgacctgggcgctgattgttgcgtgcgtggcagtgtggctactggaggtattgttgggatttattgccccgggcctgagggcttggttgatgtacctcggcatggcggctccggtcagactggtggctgagccgtggacgctcatcacctcgatgttcctgcatgcgccgaactcgctattgcatatcctgttcaacatgattgctctgtattccgtgggcccagtgctggaacgaatgatcggccactggcggttcttgggactgtatgtgatttccggccttggcggctccctgggacttatggtgtgggctgcggtggctccgggaggcatcggctggcagatggcagcctatggggcttctggagccttatttggcctgtttgcatcattgctggtggtatatcgccgtatcggcgccgatatccgctccatgttgatctggatggcggtgaacttcgccttgccgttcgtggtcggtggcgtggcgtggcaggcgcatgtcggcggctttgtagtgggtggaatactcacatggctgctggtgggtggtgtgccggcgtggcgcggtaaaagcctgaaatggcgcatgcaggtgtacggctgggccatggtggtgctggtcattgcgttgattctgttgtgcaatatggccaatccttacgggtggatgagtttcggctccctgcactgatatggcttgatatggctgtaaaaaaaaacgattgatgccgggtattgcggaacatgcagtgcccggcatcaatgtatgtgcggaaagcgacgatgtggatattagcgatgtggatatcgtcgttcggcgagtgggtgtgtgccgtatgaagatatccacagtaatgagatgcgcgcaatgacgagttatccacgataatgagttatccacaatggtgacttgtgcacaagtgtgtagaaaagtgcataagactgtggataacttatgtggataagttaggaatgccgcggtattattgggtttgttgcagtggataactcgggtgtataactgttccctcgctgtggcgatgtatgccaagccaaagttatgcacgagatatacaccgagaaacgccgcttatccaccacttatccacatggttttccacattcggtggaaaactacatgggtgtaattcatccacaggctgtggataacgtagtggataagtcgtggataagtggtggatagctgtggatgaacaggctaaggcacgaaaaaggccgacctccgcatacgggaggtcggcctttctcataagaattaaggacaacctaacgatagaaaaaacaatctaccgatagataagcgcaacgagccggaactcagcgccatcccatcgtcatcaggaatccgatcatgatcagggcgaagccgatgccgaggttccacgcaccgatgttcggaatcggccaggaaccggacggggagaggtagtacaccacgcaccaaatcaggccgatgatcataaacgcgcagaacagcggcacgaaccaacgcgggttcgacttggtgcccttaatggtttcttcaacgcgcttggtgttctccgcctggcggttcatcatacgctgcatctgcggggtcagcgtggccttatcggcagtggcgttgagcacggcctgcacctgctccatattcacgccgtaagccgcgccttcctcggcagaagcgttctctgcgttctgctcggtgtctttgctggcggtctcgtcagcaacggtgctggatgaggtctcgctctgccagtccttctggttgttcgagtcggtttcgtgcagctcttcgtcagccatcagcatagtctccattcaataggctaaaagtcataatagtggctacactcgaaagcggcgaccagagtcggcaagaagacaggaaattcatggccagacatgtaggtaagcacggtgcacggcactccctatggggtggtgtcgcggtattcgtcgtcattgccttgaccggttttctgctgagcaccaacgtgagggtcaatcgtacggttgccgtcaccaacgatacggctgatctggtggagcaaggcgtggacgaggccaaccagctgcagcaggacgtcagcgatctgaccgaacaggtcgccaatcttacggacgcgctcaaggccgatggcaccgatggcaccgacagcacacagaaccaaggcaaggactccagcaatgtggattccagcctgatgctgcccgcgctcagcggcagcggcgtaacggtaacgctggatgattctccgttgtgggagaacgcagtcaacaacaacggcacgaccgccaatatcaacgattacgtgatccaccagcaggacgtcgaatcggtggtgaatgccttgtgggccggcggtgccgatgcgctgatgattatggatcagcgggtgctgttcaattcggcggtcatctgttccggcaacgtgctgtcgttgcacggtaagaaatactcgccgccgttcaccatttccgcgattggtgaccctcaaagacttcgcgcagcgttgaacgactccgaagccattaccattcttaagcaatatgtgaccgcgtttggcattggctacaaggtggagaatgccgaggaccttcagttccccgctaccgccgccttgctgcagcagttgaaatatgccacggtcgatacgtcaaagaccacagatgaggagcagactcagcaatgagacacggcaggcacaacagcggcgtaccggcgcccattgatctcgcgtccgtgtcggacgtacagcccttccccgaggacgatgccgcacgaatggcggcagacccggccaacgccagtagggcaaggtcccgtcgtgccgcagtacgcggcgcgtcttcgtcccagcggagcccggtctggcaggcactcggcatctgcgccgaactgctgattaccgctgccgtgatttgcgccctgtacatcgtctggcagatgtggtggaccggtgtcgaggcggagcgagcccagaacgaaaccacccagtccgtcgactggagcgaccccagcaacaacgggggaacggtcaccatcgccaaagcccaggagggcgatgcgccggtacagccgaaagacgcgaaatatggcgacttgattgcgcagatctacattccgcgcttcggctcccaatggcaccgcaacatcgtggaaggcaccacgctcgagcagctcaatcgccacggtctgggccattacgacaccacccagatgccggggcaggtcggcaacttcgccgtcgccggccaccgcaacggctacgggcagccgttgggcgatgtggacaagttgcaggaaggcgatcccatcatcgttcgtaccaaggattactggtacgtctaccactacacccggtacgagattgtgctgcccacggacgtgcatgtgatcgcccccaatccggaagactccactgccaatcccaccaaacgcatgatcacactgaccacctgtgagccgaaatactccacccccacccatcgatggatcagctatggtgagttggcgtactgggccaaagtgtccgacggtgtgcccaaagagctggctactactgattcgtccggtgcagtgatgttctccaccaccgaaaccccctcgatcgcttcccgcattggctcgctggacaaggtggtattcggcgcgctggtagtgtggctggttctgttcattgccgctgcggtggcatggcgctggccggtgctgcgcgagattcgcgcgggtgagcgtcgccgtccggatgccagcatctatggcggactgttgcgtctgcagcccggcgtggcaccgattcgatggttgctgctggctctgctgctgttcgcagccgccgcggcgctgttccagtggggattcccttgggccgccgccaatatcccattcctacagcagatgtcgaacttcgtggcagcgagctgacggcatcctagtactatggcttgcagtacacgtccctcaaggagagccctatgaccgattccgcgcatattttggtggtggataactacgattccttcgtctacacgatcgtaggctatctgcaaacccttggcgccactgttgatgtggtgcgtaacgacgctatcgacccagccgcgccgggtgtactggacggttacgatggcgtgctgatttctcccggccctggtgctccggccgaatccggtgccagtgaggatatgattcgcctgtgcgcggccagcggcgtgccgatgtttggtgtgtgcctgggcttgcaggcgctcgctgaggtgtacggctgcactgtggaccatgcgcccaccatcatgcatggcaagaccagcttggtggaacatatcgatgacgagattttcgagggcgtggccaaccccatgaccgccacccgctaccattcgttggccgtcgagcccgattcggtgccggatacgctggtggttaccgcgtggacgcaaggcgaccacattattcagggcgtgcgtgtcaagggcaagccgatgtacgccgtgcaattccatcccgaatccgtgatgacccaggacggctaccgtctgctggccaactggcttaaggtctgcggccaagacaacgccgtggccaagtccgccggcctccagcccaaagttacgaagtagcttttccgcgcggcgatactctccccggaatgtgtcgctagaacgaggcttgcgtactggttttgcgacgcttcccgggattgttgcgctgggatagctctttatacagcaaaggggaggggcgcagaagcccttcccctttgtgttgcgtgtatggttgcgctatttgcgttgcatatgcgcaacacatacacgcccggcgcttacttgctactcaccggttcactcaccggttccgcccccgttgccagtaccgttgccaccgtctccggtaccggtaccgccgccagtgctgccggccttcgtggtaatggtgacggtcgatcccgcatctacctggctgccagcgccaggattgatgctgactaccacagcggtgctgccggttggaccattggcctgagccttgaggcccacggccttgagcatgagttcggcggtgacgtagtcagtgccagcggtgatattcggcacagcgaccttctccttgcccgtggacacccaaatggtgatgaacccgccctgtgcgatggaagagcccgaatcagggcttacacgggtaatcagaccggcctccaccgtatcggagctctcctgctccacagtgaagctgaacttgccctcatactgctgtagcacgctgtccttcgactgaccgaccaaattgctcggtacggtggtcatgccggaagaaacatatatggtgatggtggtgcccttgggaaccgactgaccggcggcaggatcggttttcgtcaccatatccttggcgatgtcggcgctgtcttcggttttgacggcggcgttcaccttgaacccggcgctttccagaatgctgcgcgcctcttcctggctgcgttccttgacatccggaacctgagtggactgcgggcctgcggagaaccacaccttcacggcagatcccttggccaccttggagccggcgtccgggctcatcttggtgcaggtgccttccggctcggtggagtcggtgtcttgcttttcggtcatcttcaaacccgatgccttgagtttgagctcgatgctgtccttggacgtggaagcgttgcacacctcagggatggtgacggtgtcttccgaggacttgttgccggagccgttcatggcgaacacgatgcccacaatgacaagcaccgcgacgatagccgcgatcaccgaaccgatgatgatcttcttgcgcttcttggccttggccgccgccgcacgctgctgcgcacgggactgcaacgccgctgcattggcaccattggccggtggaatctgctcgaactgaccggtcaccgggttgaatgcctgggtgggttgctgatgcggttccaccggcgtggtgggcaaatcacgttcggcttccttgcgggccttcatattcgacaggtccgtcaacgggttgaacgcggccgccaccggcacgccgccgttcatgtaggtcaggatgtcggtcttgaattcggaggccgtggcatagcgattctggcggtccttggccatggccttggcgcagatcgaatcccacatcttcggcagccccggcaccacggcggatggcggcgtggcgacttcggaaacatgctggtaggcgatggccacggcggaatcgccggtaaacggcgggcggccggtgagcatctcgtagagcacgcagccggcggaatacaggtcggaacgcatgtcgacggtctcgccgcgcgcctgctcgggagaaaggtactgtgcggtgcccaccacgccctgcgactgggtcatggtggctgcggaatcgtccagagcgcgggcgatgccgaagtccatgaccttgaccacgccctgctcggaaatcatgatgttgccgggcttgatatcgcggtggataatgcccatgcgatgcgaatagtcgagcgcgttaagcacgcccaacatcacctgttcgcagtcgcgctggctgagtgcgccgttgaccttgatgatgtcgcgcagggtctggcccttgacgtattccatgacgatgtatggcagacgctcggcatcgccgctttcggaagaaaccagttcttctcccgaatcgtagatgttcacgatgttcgggttgttcatctgggccacggcgtgtgcttcgcggcggaaacgggccaggaagatgtcgtcgttgtccagatcggcgcgcatgattttcacggccacggtacggcccagacgggtgtcaagagccacgtggacctcggccatgccgccacgaccgatgagctggccaagctggtagcgtccgccggccaatgcggtgggcatactggtgctcattgcttattccctcccaatcttgaggccggggcctccaaaacaatgcgtggcgtgctggtcactcggcgcggcagtcgattgccggacgtggccatggcggtgttggccatttcggtctgctgatccagcagacggcgttcgatgcgtgccagcgtacgggacaccaccagcgcgtctttcgggcgatccaacgggtccttggccagcattgacatgacaaattcgcgtaactggacgtccaccgagtccggcagcggaggcacgggattgttcacgtgcgctgcggcgatatcgaccggagtggtgccggtgaacggacgatgcccggcaaggccctcgtacgccactacgcccagtgaatagatgtccgattgcggcgtggcctgctggccctgcgcctgctcgggggagatgtattgtgcggtgcccaccaccatgccgtcctgggtgatctggccctgacccgtggagtagctcacaccgaaatcggtgatcttcacttcgccggtgtcggaaaccatgatgttggccggcttgacgtcacgatgaatcacgccgtgcgagtgggccacgaacaggcctcgcgcggtctgaatcaggatgggcagcagttcgatgggatccatcgcgcccttgctatggaacaggtccgccaacgatttcgaggggacgtattccataatcagaaagccgatgccgtcatgctcgtagtattcgaacaacgcagcgatattcggatgcgccagattggcggaattatgggcttcggcacgcaggcggcgtagcttggcctcggcgttggtcacgtccgagcgcagcgccttgatggccacttcacggccgagctgaatatcgtagcctttccagacctcgcccataccgccttgcgcaagacgcgaatcaagacgatatcggcggtgaataagctgtccttcgataagtttcactgctgcaaagcctcctgcatcatcgcgcgcatgatcgggccagcggcgagcgaaccgtacacatctgtgttatgcaccaacaccgcgacggcgatttgcggatcgtccgccggcgcgaaaccgatcacccagccgtcgatggcagagttgtcggtaccgatttgtgcggtaccggttttggccgccaccttgatgccgtcgatggccagctgcggattggcctcggtcaccacgctttccatcatcgtggtgagcttgtctgcggaatcctcgctgaatgcgttggccatggtctgcggcttggtctgcgaaagcacggtgagatcggcggcgcgcacacgatcgaccagcgtgggctgcatcagtttgccgttgttggcgattgcctgcgcgaccatcgccatctgcaatggcgtggccgtggtgtcgccttggccgatggacgccagcgcaagcttgtcgtcggtcggatcagaggggaatgtggacgcggtggccgtcatcggggtgcccgtggattcggtgccgtcaatggtgatggtgctgccgaaaccaagcttggtggccatgtccgaaaccttgctcgcgccgagtttcacgccaagctgggcgaaagcggtgttggacgaccatgcgacggcctcttgcagggagatctgtccgttgacgccatcgccctgtgcctcgtcgttcggcagctgtgtggcggttcccggcaaggtatagctggagcctgcaggaatcttcgtgtccgtctgataatcgccggtttccagcgcagccgaggcgacgatggtcttgaacgtggaccctggcgggtacagctgcgaggtggcgcggttgattagcgggctattttggcccgcagagagttcgttgtaggcctgagacgcggctttggcgtcatgggtcgccagtttgttcggatcgtagctgggcgtgctcaccatggcgaggatacggccggtgttgacttcgatggccaccgccgcaccatcgcgcgtaccgagctgatcgtaggcaacctgctgcagcttggggtcgatggaggtttcgatggacgcgccctgattcgtagtgccggtgagcatggccttggcccgctgccagatcaatgaatcggcctcaccgttgagcagcatgctgcgggaggcttccaggccgcgatcggcggtctggttgatggagaagaagccggtgaccggagcatacagcgggccgttggaataggtgcgcaggtatttgaacgcgtcgttgaccggttcggatttggccatgaccgtgccgtccgaggccagaatggcaccgcggtaggcaccgagctggtggtacagcgaacgggcgttgcgcggatcgttgttcagcgcgttggcccgtaccgccatgatgatggtggacgacaggccgagaatcacgaacagcgcgaccacggcggtgaaaagctgacgaagatatttgttcatacgcgagtgcctccgttaacgggaggaagcgggggaatcgtaccggtaggcgtgtacggttcatcggcttcggcatacgacggagtggtggtatccacgatggggtcgtcaaacgattccgactcggactgcgacgccgtagccgacgcgctgcgaggctgaacgatcggctcagtggcgcgggcccgggcctcaagttccttgttgcgcagcacggccaaagcctcgtactggaacgtatccgaggtcagctccggctcgggcgcattggccgagttcgagatgatgatgagcagggtcgcgagaatatagttggcgatcagactggagccgccggccgccatatagggcagggtcagaccggtcagaggaatcaccagcgtgatgccgccgaccacggtgaacacctggaaggccatggtgaacaccagtccggaagcgagcagcttgccgaagccatccttgattttcatggcggtgataaagccggaggcaatgatgagcaggtagagcatcaaaatggccaggacgcccatcagaccgagttcctcgcccagagaggcgtagatgaaatcggagttcgcaaacgtaacgagcgaaggatggccttggccgagaccggtgccgagcatgccgcctgatgccaggccgaaaatgccggtgaccagctgccaggagccgccgggggtcttgttgtattgctcgttgctgaacgggtgcagccaggcatcgactcgctgacccacgtggctgaacatgcctgcggccagcacggcacccgcggcgaacgcgatcagaccgatgatgatccagcttttacggccggtggccgtgtacagcatggccacgaacatggcgaagaacataagcgaggtgcccagatcatgctgcatgatgagcacgcccatcgaggcgatccacaccacgatgatcgggccgagatccttgatacgcggcagctgcaggccgagcacttttttacctcccacggccagctggtcgcggtgatcgaacaggtaggcggcgaagaagaacgcaaggaacagcttggcgaactcgcccggctgaaactggcccagtcccggaatcttgatccagatgcgcgcgccgttcacttcctgaccgacaaacggcagcatcggggcgagcagcagcactaggcccaccaccatcgacacgtaggagaagcgccgcagcacgcggtagtccttcaaaaagatgatgagcagcgcggaaagcacgatggcgatgcacagccacaccagctggcgttgggccaccgcccaaccttcgctctggtcgatgcgggcgatcatggtcacgccagtggcggtcagcagtagcacgcaaggcagaatcgactggctggcgtacggctggaagcgcacaatcagcccccacagcaccagaaacagcactacggccaatgccagcatgccggcgtattgcatagggaattcgccggcggtgcgctggaacatctggatgaacgccaacgcactgattgccatggcaatcagcaacaaagaaatctgacgtagacgggtaacgatcattgagaatctcccgtggccgcgttgtcggccgctccgataccggatttatccgaggaatcggatgagcttgacgaaccggacttgtctgacgaggagccggactggctggacgaatccttggtgccgtccttggaatcgctctgggaactgtctttggaactgtccggggaattggacgcctcggccttcttggcggcgtcggcttcctgctgcttggccagtttgcgcatttcggtgcggataatacccacatgcgactgcgcttcgtccaacgaaccgactgtgatgccttggctcagctggtcacgccatgtctgaggcaggtccgcggtggcgatattggtggtctgcacttcgtgcgaaagctcaagtccaaagagattggtcggcacgccacgataaatggctacggtgccgttgctatctcccacgtagtagtgcgtctggctccacgtgtacgcgccccagccggcgccggccaatgccagcacggcaagaatgcaggtaataatcaccgcaagcttattgcggcgcttcttggtgcgcgtggccttcttctgctcgacctgctcatcgcggatggctttggccacatccgggtcgttggggtcggcggacaggcgcccatccggcttttgcaccaccggaatctcaccggtatcgggattggctcgttcaccggtctcctcgcggacggtggacggctgcaccacgcgtgtggacgacggtttggccgtggtttgcgtggtctccgcctcgtgcgcgctggcgggctgaatcaatgctgcggcgcgctgggcgggggaatcatcctcacgcagtgcgggcgcggtagccaccggctcgttgacgatgtcggcaatcggctcaagattacggctggcggcaccgccgaccaacggcgtttggtgcggcaggtcgaacgcatcggcatccaacgccaacgtggcatccgcaataacggccgtgacattatcggtgctgcccgcccgcagtgccatctgcaccagacgctgcgcgcattcgccctgatcggacagcgtggtcatcgtctcttcgatggtggaatcttccagcacaccgcacaggccgtccgagcacagtagccaacggtcggcggggtgggctcggcgaaccgaaatatccgggcgcgggtcaatgtcaaagtcgccaagcacgcgcatcacgacgttgcgctgcgggtggttcttggcttcggacggggtgatacgaccggtgttgatgaggtgctgcacgtagctgtggtcgcacgtgatgcggctcaggcgtccgtcgcgcagcaggtaggcgcgcgaatcgccgatatgggcgatgacccagtagccggccaccaatgccactgcggtaacggtggtgcccatgccggcaagcttgcgttcgcgcttggccttgccgacgatggcgtcatgcgcggccataacggaggtttccatcatgcgggagatcgtctcgacgttgccaccggtgtcatcctgctcgatgtgggccagcgaccggatggcgatggaggatgccgtatcgccgccggcgtgaccgcccatgccgtcgcacatggcgatgagatgctcgccggcgaaggaggaatcctgattgttcgcgcgcacggtgcccacatcggacaccgtggtggaatacaggaacagcggttgtgaagcggcggattttggcatgcggctacctcagttcgaaggtggtggcgccgatgcgcacaggaatacgagcgggcagaatggtggggcggttgatgcgctgctggttgaccacggtgccattggtggagttcaggtcttcaatggcccactgcccggagcgcgtgtcacggtagacacgggcatggtgggaagacacgaattcgtcatcgagcaccacggtgttcgaggcggcgcggccaagcgtgatgtcggcttcggccagcggcacggagctgccggcaagcggaccatcgatgatgaccaacagggtaggctgcgccgaggcggcggacgacgcggaagcgctgggctggcgatgcgggcgcggcgcagctgcctgcggcgtttcggccttggccttatgcacttcacgctcacggcgacgacgcgcgcgcgaaggtcgcggactgaacgtctcgatgtccttgcgcagcgaacgtacggccagccagatgaatatccacagcaggatcaggaatccatacttgagcagggcgaatgtcagttcggtcataagtggacgactttcgggcgtgtgctcgactactcctgggcttgggcggaggcccagtacaggatgcgggtacggccgatggtgatggtgttgccgtcgagcagcgtggcggcgggcacttggtggccctccacgtacgtgccgttggtcgaacccaggtcgcgggcgatcacgccgttatccgtgatgtcgatttccaggtgcttgcgggagatgcccggatcgtcgatgacgatatcgcaaccggaaccgcggccgattaccgtcttgtctttggtgagcaggtactggttgccgttcacctcgagcaccgggctatcctcggtctgcgcatcggtggtgaccggcacggcattgccctgcacggattcggaggtgaggttgaagttgcccttggacaggtcaaggtcttcctcgaagatcacgatcaccgggcccacgaaggcgtaatgctggctcttcgcgtactcggtgaggttatcggccagttcgttggccagggtctcgctaccccatgcctcgatacggtcgaagtcaggagtactgagcttgaaacggtattcattcggggccaccgtgcggtcacggcccacgggcatggcctcggcgtcaatctcgcgctccaaggcgctggaaagatcgacaggctgcaggtctttggagccaaacttggcgaatactccgttgactgcaccctccacgcttttttcaaaacggtcgagaacgctcatagtcctccctttctaatcttcacccatcctacgcggtgatgggaatatgagacaaaaaaccggtctttcacgtgacgatgagtgcaaaatatccaaaaattcagggcggaaatgggtgcggcgcaccacccgaggtgctttaccggtggagcacctcgggtgggatgcgcgtgttatcgatttgtcaggccagcgcgtcgcgcaggaaatcgcgctggagggtgagcaggttttcggccacggtctcgtcattggtcatatgggtgatgcccgtcaacggcaggaaggtgtgcgggcgacccgccgccatcagggcttgcgagaggcgcaggctgtgggcgatggtgacgttgtcgtcggcgaaaccgtggatcagcataagcgggcgctcgagtttcggtgcgtcctgcacgatgccgtttcggtagtagacatccgggtcgaggcccagatagcgctcggtgtagtgcgtgtcgtacagcgtccagtcggtgggcggggcgccggcgcatgcggccttgaacacgttcggcgcgtccagcacggccagtgcggacaggaagccgccgtacgaccagccgatcatgcacaccttgtcgaggtccggcatgggaatcgcctcccgctggcgggaggtggcgcgaagcgccggtgggtggttctcggcgtctgcctgatcgcccgcagccggctgtgccgcacgtgattccacatcggcgttgagccgggcgacggcctcgggcagggcgttgacggcctcgacctgatcggccagcgttacgtccttcatatcctcgaagatctcgcggtcccatgccgggccgcggccggtggtgccacggccgtctgccgtgaccaccaggaagccttggtcggcccaccactggccctcccagtagaaggactgcgaggcgatgacctgctggaagccgggcccgccgtacggcttcatcagcaccggcagcttctcggcgtgcgcgtacgggctttccgggctcggcgcgatgatcgccgtgtacagctggtgctcgcccagtcgcgtaaacgtgacgttcggtgtaaagccgggttcggccgccgtggacgcgatagtggcgctctgttctcccagaatatgccgcatctgggcgcgggcggaacgcatatcgcggccggagaccacgatgccgcgctcgccgcgcgaggcggtccactggccgggatcggtcgtgaccggcgtgatcgtgccgttgtaatcgatactcaccacgtcgaaactgcgggcgtcgtggtcgccgaatacggactcggtggcggccgcatcggcccaagcgtccggcacctcaggcgcgatttcgggcgcgcgctgcaccacggccagcacatcctcgtcggtcacggcgagcaccgtgcgcacgttccagccagccggcgtgaacgggcggccgtccattgtcagacggttggtgtccgtggccatatcgttgagcgagcacaccagacgaccatccggcgtgtaggcgggcgtgccgtgaaccaggtcgatccactgctcgttcgcgtgctcctcaagcacacgcgtggcacccagcgcggccccatccgccgcgactgccacctcaagcacctgatcgcgggtctgacggcggttctgcaccagcaccagcggatcgtggccgcgacgccagttcacggcggccacatactcgtacgcctcgcgattccaatccacatcggcgttgccggtgatgcctgcgtaccggtcgttctcatcgaacgccagcgtgatcacggtcagatacacgtcggcattgcgggtcagcgcgcgcgggtaacggcggccggcgtccggcttctcggggtcagccggatcgctgatgtgccaggtcggctcgtcggcggtgtcgaaggactcgaacagcacgtgctgcgaatccggggcccaccagaagccgtcgtatcggtccatctcctcgccggccacgaactcggccagaccgattttccacgtgttttcggccggattgccgtcctcatcctccacgctcacgccgtagacggcggtgatgcggtcacctagttcgccgccgatatcgaccagcatcaggtagctgcccgtggtgtacagcacatgttcgccatccggggcgatgcgcgggttcagcaccggcgtgtacatcgccgggtcctcatcgagccattcgccggccagttcacgggtgtgcggctcgggtgcgccggtctcgtcattccaatcgatgtcggtcaggaacaggcggccgttgatggtgaacacgatgcgattgccgtcgtcatctgcggagtatccgacgatgccggtgccgccttcgcgcgcacgctcgcggcgggccttctcctcggccggcacgtcctcgctgtcggcggttgcgcccagcagttcgcgcgggtcggccagcttggtctcatggtgttcgccggactcgtcgaaccagctcagccacagtgcggtcaccagatcctcggggccgtcggagcgcaggaacagggcccgcgagccgtcgcccacggtctgtgcggagcgcggtgcgccgcagccgaagcgcagcgtgcgcgcccggaggcgtgggaaatgcttgattgcgtcattgacatcattggtttcgctcatacctcacaacctacgcgcctgtgcggtcagtggcgcgcaggcttgcgacgcattcccgggaatgtgtcgtggtgtgggtgcgaggtgtgggcgtgaggcttgtcctaagatgggagccatgcaggtgacgatgatcgacgaaaacaagtacgccgaaacgatgaccgacgtggtgctgcccgcgctcgaacaatgctgcgaggagggctggttcgatccgtccgccgccgaacgttcggccgggatcgagccgctgtccggcattatggacaccggcggccgctcgggccagctgcactacctgtgctacgactccgccaaattcgacgcgattcgcgagcaaggcgccaccgccaccttccgcggggccatcgtcatcagccacggcttcaccgagttcgccgaaaagtacgacgagctcgtctggtacttcctgcttgccggctactcggtgtgtgtactcgagcatcgcggccacggcaagtccgcgcgcgacgtggacaaccgctgcatggtgtggattgatgactggcagcgctacgtggccgatctggccggcttcgccgaaaccatcggccagcagtacgcggccggcatgccgctgaacctgttctgccattcgatgggcggcggcatcggcgcggccgtgttggagcgataccccaccctgttcgacaaagcggtgctctctgccccgatgatcgcccccgccaccggcatgccgctgggcgtggcccgtgtgctggtcggcgcgctgtgcggactcggcttcggcaagaagcgcgtgttcgggcagtcgggcttcacgccggaattctcgatggaaggcaacgagggcgcttccgaagcgcgtgaacgctggtacttcaagctgcgttgcgagaatagcgaataccagacctactgcgcggcgttcgaatgggtgcgccaagcgttgaagctcaaccgggccatactgaatccgtccgcctgcgccgaagtggagacgccggtgctgctcttccagtccggacgcgacatctgggtactcaataagccgcagaatcacttcgtccaactggtcaaggacggcggcggcgaggcgaacatcgtgcgcttccccgaatcgcgccacgaaatcttctccatgcccaacagcacttacaagccctacctcgaaaagatcctcggcttctacgacgaccccatgattgcctgcgccgcgtactgatgtagctcttcacccattgttcaccgtgcggtcaccttgtggcccgacccgctttagatggcgggagagccatggaattatgggcataatgtcttctctccgccgccgcgccgccgcggttgcggccgcggtatgtgccggcgtgctcgcgttgaccggttgcacggcgttcaataattccgatgacggcacagcggacggcaacggcacgtccgccaccacgcagaccttccagccgtccggcggcaaaccgactgccaccctgagcattgcctccggctccgaaaacaaggaagtcgccgtcgccatccagaaagcggccgaccaatccaacgtagccgtgacgatgcactacatgggttcgctggagattatgaacgcgctcaaggccggcggccaggattacgacgccgtctggcctgcctccttgatgtggatttcgatgggagacaccaagcacatcgtcaaagacgcggccagcacctccaccacgccgatcgtgttcggcatcgccaaatccaaggccgtcaaactcggctgggctgacgacaccggcgccaccaagcccgtctccaccgcggacatcctcgccgcggtcagcgacggcaaactcacgttctccatgacctccgccacggtgatcgacagcgcgctcaacgtctaccagaccgcgctcaggaaacccagctggaccatttgggtggtcgattactccggttcgatgtctggagagggcaagaacggcgtggtcaaaggcctgaacgcggcgctcgacccggaccagggcaagaagtcgtacatcgagcccgccagcggcgacgtgaacattctcatcccgtttgaaaccgaggcccaccgcccggtcaaggccactggcacaagcaccagcgacctgctgcatgaggccgatgccaccgatgccagcggcggcaccgatatctatgaaggcctgctgagcgcgctcgacgagctgcccagcgagtcggaagcctcgcaatacaccaccgccatcgtgctcatgaccgacggccgctccaactccgatcatcaggatgaattcgaaagcgcctataagtcgcgcggccgtgatctgccgatcttctccatcatgttcggcgatgccgatcccagccagctgaagtctctcgccaccctgagcaacgccaaggtattcgacggccgctccggcgacctcgccgccgtcttccgccaagtcaagggcttcaactgatgctccaggtaatctgtggattcgttgtcggactgctgctcgccgggctcggtttcggactggtcggcggcggagtgcccggcctgatcgtggccgtggtactggccgcacttgggtatatcgccgcctccacgctcaccgagccggagcgacgcatcggcaaaatgctggtttccgccttgcccaacggtcagaagaccgccgatacgatcgacgcggcgaacgctcaactcaactcgatcgccatgctcaccaagcaagtacgtgacccagccgtcaaagccgaagccaacgacttcatcgccgctaccaaagattgagtgcaatacgtgacccgagacacctccgcctacccgacgttgcgccactacatcaccgtgtacggcgagcagaccgagaaactgttgcgctcctacgtggacgtggaaagttccggcgcacgcgatcagatagccacggtacgaatcgaaaccatcgaggcgctgcaagtgctcgaacagaccgccgccggcgaactcagccgggcggtaagcgccaagacgttgggcattacggccgactccgacgccatccaacggttggcccgcatggatggatacgacgacgtcgcaccttcgcctgtgccttcctcggctgctgatgaaggacggcatgcgcccagtcagactccatctggtggcccggctcaccagtcggaccagaaaacggacgcacaatgaaactctccaaatcaaaaatcatcggactgatcgccctgcttgcggtagtgggcgtggtctgcggcacgctggtgtggcggcaatcgcaaccagcgccggccgaaccgaccgaacaggtgagcatcaccggctatctgggcggcgagaaaatcggcctgttcgatgacgccaagttcaaggcgctcgccgccaagcaaggcattgccatcgactatcgcaaggccggatcgctggccatgatggatgcggaccggaaaggcatggattacctgttcccctcctcgcgcgcggccgtcgaatacggcaatgcgaaaggcgtcaaggccccccaaagcgacatcgtcttcaactcaccgattgtgctatacgcgcacaaggccgtggcggacgggctcgtgaacggcggacttgtgaccaaggacgattctggcgcgtaccacatggatatggccaaagccgtggacgcgatggtcgccaacacaacatggccgacgtcggatacacggcaggctacgggcagttccgcatcgactcgaccgatccggtgaagtcgaactcaggcaacgaatacgcggcgcttcttgccacggtgctcaacggcgggcagccggccatggtcgattcggtggcgcgcgacggcaagaccatcgcctccatcttcgccaaatccggctggatggagacctcttccgaggattcgttcaaccagttcctgaccttgggcgtgggctccaagccgatgatggtgggctacgaatcgcagctgcttgatttggccgtgaaccagccggatgcgttcaagcagatcaaggacgacgtggtcatcgtctacccgacgccgaccgtgtggagcacccacacgctgatggccttggacgagaaaaggcggcacactgctgaacctgttgaaaacaccggcggtgcagaagctggcgtgggagcgccatggcttccgcgcggccaacttcgccggcaccgattcgatcagccgattcggcgtggccggcacgctcgaccagatcccggccgtatccgaactgcccaacaacgatgccatgcaacacctcatcaccaccctccaatccgcgcaagccaaactcgtggccgacatctccatgtacgacacgatgtacacgcagaacgcccagcaataccgcgagctgaaaatgaccgtactggccggcaagaaggcgctcgccgacttcaacgccaaccagctgccagcgctggaggccgaggccgccgccagtggcgacgccatgcaggcgcaagtgctgaagaacttcaagtccaagctcgaccgttttgccaagcgactcgacgacctcgaccgcatcagcgtggttaccttgcagaccgcgccgcagatcaaaatcatccagaacgcggaccagaccatcgtggacaagatcgacaccaccatctccaccacgattccggtgtggaagagtcagatggtgatcgcgctgggcctgtccaaccagcgcaaggctctcgacctgcagaacaaggccgacgaagtgaccaacaagctgctggcgcgtaacgcggccgccctgcacaagggtgcagtggacgcggaaaaggccaaccagcgttccgtggtggaaatcgacacgctggagaagatcaacgccgaactcatcgccaccctgaaggagaccgtgcagatccagaaggaaggcaaggccaaccgcgaggccgcccaggtcaagatgcgccaaatcgagtccgacctcaaaaacgccttgctcgaaaacgcccagcagatgtgagccgttcgcgcgccagcatgctcccgttggcggagtttgcgggaacgtgcaaccatgctcccgttggcagaggtatatgagtacgcctactggtgtgcgtatatatgctcccgctggcgggagctggcagccgtaagactggctgagggtggtcacggcgctcggctcggccggctttaccggcagccattcccgccgcaatttctctgtgggcataatcccggaatgattgccgcgctcgggaattggatgaagtgaaggttaaaggttgagagcccgggagggttccggaaccggccacgataaccgctgctagccccgcgatacgggttggcggccggcagccaagccgattctctcctaatcaaggagtaccgattatggcaatgtttccggctttgatgaatgacacgatgttctcggatctgttcgatgatccgttctttgagggttggcgcaacacggacaacacgatgagtgccgtaatgcccgccaacatgatgactaccgatgtgcgcgagaccgacaagggttacgacgtcgacatcgatatgcctggctttaagaaggaagatatcaaccttgagctcaacaacggctatctgaccgtgtccgcctcgcgttgcagcgagcatgaggacaaggctccggccgctgaggacgaggcttccgacagcaagtgtgcttgcgcgtccgattcgggcaagtggctgcgtcgcgaacgctacatgggctcctgctcgcgtagcttctacgttggcgaggacgtgaaggagtccgacatccacgccagctaccggaacggcacgctgtgcatccaggttccgaagatgcaggcccagccgcaagtcgagtccaagcaccaaatcgcgattgagggctgacgatacttgattcgtcccgaagtcccgcttcgagtagctttgccccctctgacgagggggctcccgcgaagcgggtgggggagagataaatcgtaaccaagccatgcttcccacgccgtctgccctacgctttcaacgccgactaacctgacagacggcgggaaacatagccaatgcaaatgccgggtagggatttaccctacccggcattttgctgtttcaatcaccgaaccccaccctgttcgcgcgccggtcgcgtgccgttctgccgctgtacacatccgatgggtagagtgacttcgaaacgatgcgagagaggcggacatatggcgaacggcgcacagaacgcaagcggcacaccggcaccggcggcaagccattccggcggccacgtcgtatccgcgcgcgccacgaccatcggcctgatggcaatcctgctgtggagcttcatggccggcaccgtgcgcatcgtctccgaaaacttcggcgccacgcttggctcggccctgatctacacggtcggcggcatcctgctgctgatgttccggcgcccggccccgattcgcgagttccccaagaaatacctgattatcggcggcctgttgttcgtattttacgaatcgtcgatatccctctcgctgggtctggcctctaccgacgcatcctcggtggaagtgagcctggtcaactatctgtggcccacgatgatggtgctgctgtcggcgggcgtatcccatcgcaagcacgcggtcgtcaaggtgctgccgggcgcgatcgtggccactgccggcgtggtgttggcggtcggcggtaattccgggctcgactggcatgcggccgtgcagcatatcgccgccaaccctttgccctatgcgctggcgttcgtgggcgcgctcgcttggtcggtgtacgcggtgttcacgccagccatgagtcatggggtggacggcacttcattgttcttcccctgcgtggccgtggcgttgtggattatccacttcgcgtccgggcaggggtggccggccgagccgccgagtctggtcgcatggctgtttgtgttgattgccgcggcggcgattggcggtggttatgcctgctggggctatggcattctgcacgggtctatggagcggctggctattgcgtcctatgccacgccggtgctgtccaccggggccagtgcggtgttgctgggtttagcgctgtcgctgccgttttggtgtggcgcgctgctggtggccgtcggatcggtgcttaattacttggtcagtgcgcgcaaatagcggggtggctttgctcatggggcggtaataatcccatggggcggtaaaaccctcatggggcggtatcccaaaatgactttattctgcggtttcacaatttcttcaaaccgccccatgggccttttaccgccccatggataaattaccgcccgatgggcagcagcaacttactcgccgcgacgctcggacgggcggcgaatcgggtcaagcagcgtattcggatcggagatgccgaacatgctgcgcccgccggtggattcagggtgcttggcgagaacggccagcgaaatcgcccccggaatcataatgatcaccaaaagggccgccaatccccagttcacgaagaatccgagccccagtacgatggccaccacaaccaccaccgtgacgataatcgtcaacagtgctcgacgtgggttggtttccctggcccaagaggtgctggctgcgggttttgctgttgaactggccgcggcgtttgtggctgttgtgccatcagccgtgacggtcgtgggccttgccgccgcgctcgtcgcggggccagtaggggcgtcagacacgttatcggcggcattgccggtcgctgctggacgttgttcgtttgcgtgagtcatatccaccagcatattccctgcttccggctgaagctgggacaagcctgcgcgccgctaatccagcgctgacactggccttgagctgcggacgtccagaccggatgtgaacaggtgctgaacggagtctggggaaaccatgagaactcgcgacaatttttgtgaaattgggtgacgctctatgaatcgcgcgctagtgttgcgtgagcttacaaggcgaggagcctggagcgcgggggggtgaaggatgaagaactccgtttggaaaacgttcatggaattgtctctggtccgcggaatcgtgccacggaccgtgttcggactgaccgcgatcgcggcaatcatactggttattggactggcgctgagcaagagcaataagcgcggccgcctgcacccgctgattgtctcgctgattgccgccgtgctcgccggcgcggctggaatgctggttgcatggctggtgtccgacgtgtttatggtgttcggcgtatcgctggggtggccggtgatcttcaccatcgcgggcggcatcgccggcgtcggcttcgtgatcgccgcagccgtgaccctgcgcggggtccgccgtgcgctggccgtcgtgctggtgccgctggtgctgctgtccaccgcgctcggcgtggactcgatttacggcgaataccagaccatcggcaccctcgtcggctacacgccgtacgcctcgctcggctcaatcgaggtacacaaggccgcgatgagtgtcagcgactggcatagcaaggcgcggaagggcagcctgccgtccatgcccagccaaggcaaggtgctcaccgtcgacattccgaacaccgaatccaacttcacggcccgcaaggcgatgatctacctgccgcccgccgcgctgtccgaccgtccgccggccttgccggtgatggagctgttggccgggcagcccggtagccccagtcgcctcatcgacgccggcaacatcgccgccacgatgaatgcgtacgccgccaaacatgacgggctcgcgccgatcgtgctcgtgcccgaccagaacggcgaggccacgcacaacagcctgtgcgccgacaccacgcaaggcaacgccgaaacctacctcaccacagacgtggtgaactgggccaagaagatgctgcccgtggccaaatcggcccgcatgtgggcgatgggcgggttctcgcaaggcggcacttgcaccacgcagctcgtcccgcgccaccccgacatctacggcgcgatgctgccggtggacggcgaactcaagccgaccaatggcagcgtcgccaagatggtccaggagtatttcgccggcgaccgcaaggcgtacgacgaacaggtgccggtcaacgccatcgccgccaccggtacgcccgagcaggcgctgttcaccggtgctggcgaacgggacaaggaatcgattagcaacatgcgcacgatcgccgacgccgcgcgcaaagccggcatggaggtcaccgagctgatcgtgcccggcaccggccacgactggcacgcggtgcaggcggtctggcggcccggtctcgactggttcggcgaacggaccggcttgggcgagatgacgaaatcgttgaaggagtacccacaagtggaggtgttgcaatgagcgaagaatcgcgtaagcacaacagtcatgcggcggaaagctggcgcgaactggccggcgacgtgcgacagtgggcggacggtcatcgactggccatcactgccacggtggcgctggtggtgctgaacttggtggtgtggctggtggtcgcgatggccggattcgcgttcccgctgcggctcgacaccagcatggccgaattcgatttcggcaaactcttctgcacgctgttcttggcgcgcggcgtcatccagctcattcttgatgccgcgctgtggctcgtcatgctgtcaatcgccgagccgtggcttggccgcgcacgtaccgtcggcaccgcgctcgcctgcgcgctcggcggcgtgatcgtgggcctgatcttgtgtgcggcggccggatggctgttccaggactcccaattcgtctcccgcatgcagttcgccctgagcccgctggtgttgccggtcggcgcgcttatggcggccagcgcgttctgcagccatctgttgcggcggcgtattcggctgatcggctacgtggcgattctggtcgcgctgctttacagcggcaatcctggcgattactgcattctcgccgccgcgctgatcggacacgcggtcggccgcgtgatggccgggtcgcccgcgcatgccgagaccggctggcactggctgcgcagcacctccttcgaggcgcggcgcatgtttgcggccatcgccgtggtgctggcgctggggccgatcatcgccatcacctcgcataatcacgcggggccgctcagcacggtcggcctgctcatgagtccggtctccgttgacgacggcacgctcgcgcgctgcctggccggcgccacgcacagcggctgcttcctgcaattcgacctattgcgagcctcgatgccgggcgcggtactgcgttcgctgctgcccaccgccgtgaccctggtgctggcgtggggcctgtatcgcggccgtcggttcgcggccatgtgtgccgtggccatcaacctgttcactgcgggagtagccatcgcctactacctgatcgtgccgctgagctttgcgccggacggcatgacctcactgctgcagcacggcgcgatcaccgcctgcgtggcgaacgccttgccgccgctgttctttgccgtcgccttgactgcggcgttgaagcatttcccgattcgcgtcggctggcggcgactgatcggcggcgtcggcgccatcgtgctggttctgctggcgtgcgccgccgtgtacctgatgtacggcatcgcccagccggacgccttctcgccgcgcgccacggcctcgtcgctgttggccgaactgccggggcgcttcctgcccatcggcttcctgagccatatgaagttgtcgttcgtgccgcgtaccccgatggcctcgatcgtgtatcagggcgtcggcctggtgttctggatcgtggtgctggtcgtggtgatccgctggatgagcgacgtgagcgaatcgaacgagcgggcgcaggcacgcgccgagcggctggtcgaaaccggcggcgaatcgatgagcttcatgactacgtgggaaggcaacagctactggctctcgcccacgggcaaatcggccgtggcatatcgcgtgctcaacggcatcgccttgacctgcaccgggccgttcggcgagccctccgagtggatggacgacctgaccggcttcacccagtattgcgtggagcggtcgctttcgccggtgttctacagcgtgcatcgcgaacagcgcgacgcgttgctggaggccggctggagctccatcgaggtcggcagcgaaatggtcgtggacccgcgcggctggaagacgaccggcaagaaatggcaggatgtgcgcaccgccatcaacaaggccaagcgcgacggcgtgaccgatgtgcagtccacgttcctggaagcgtcgctcgatgtgcgcgagcagatcgaggacatctccgaggagtgggcgcagctcaaggcgctgccggaaatgaagttcacgctcggcggtgtcgaggaactgcgcgacccgcgcgtgcggctgctttacgccatcgacgcggacgggcgcgtgctgggcgtcaccagctggctgcccacctggcgcgacgggcgcatcgtcggctggacgctggacttcatgcgccatcgcaccgacagtcccaacggcattatggagttcctgatcgcgcgcatggccgagcgcctgcgcgacgaggggcttgcggatcctgagcatgccgtagagttcatgagcctgtccgcggcacccttggccggcatgaaccccgagcgagacaatgcccgggaaggcggggtgccggccggcgaaggcacgcaggtgctccaacacgcgctgcagattgtggccgactggatggaacccgcctacggcttccactcgctgttcaacttcaagcgcaagttccagcccaccgaagcgccggtctacgtgtgctacccggacccggcggcgttgccgcagatcgggctcgcggtggtgcgcgcctacgtgcccagcgtgacgcccgccgaagtagccggcatgctcagcacgctgcggtcgtgaaggtgtgcacacgggtacgcaggctagccgattcgagcctgagacggggtatctgctttcagagaggtacatttggcctcttgcggacaactaactgccttcaaagaggtacctgaactctgaaatcccgagtatgagcgttgcaatgacaacgtttgtactcggggtttcccgtattcggtacctctttgaacgaagatagcattctgcagaagcccgaatgtacctctttgaacggagaaagcctgacaaggagggcgcggcaagcgctatctccgtttcgaggggctgatttggtctctcccggaggtctactcccgtttcgaggggctgatgccgaagtattcacgctccaaaatcggcggaatggcgttggcgcggatgggtttttacatgcggtctagcggccgaccagccccttgaaacgggagtagacctccggcgggggtcaaatcagcccctcgaaagcggttttgccggtgcagaggtgtcgttgactgcatcgcgagccgcctcgacgtagtaacgtggggcgtatgagcgaacgtaacgaacacaatgacggaaatacgcaaaccgcatacttcgccggcggctgcttctgggggctggagcgctacttccagaacgtcgacggcgtcacggacaccacggtcggctacgcgcaatccaccgtcgaatcgccgacctacgagcaggtctgcgcgggcggcaccgatgcggccgaaaccgtgaaagtcgagtttgacccggcacaggtcagcctgcggacgctgacattgctgttcctggaggtcatcgacccgttctccgtggaccagcagggcgaggaccgcggccggcagtaccgcaccggcatgttctacacggacgagacgcagcgcgccgtgtatgtggcggctctggagcagctggtcgaccgccagccgcagcgcccggccgtactggtcgaaccgctgcgcaacttctacccggccgaggcacaccatcaggactatctggtgaacaaccccggcggctactgccatgtaccgatcgccgcaatcgcgaacgtaaaacgccgtcagaagtacgtggaacgcatctgggatctgacgcttgagcagttcgcggtcacgcagaacgccgctaccgagcgcccgttcgtcaacgagtatgacgaggagtttgagcccggcatctacgtggacatcgtcagtggcgaaccgctgttctcgtcgcaagacaaattcgattccggctgcggctggcccgcgttctcccgcccgattgccggtgacttgctgaccgagcatgaggaccaccgcattccgggccgcgaccgcatcgaagtgcgcacgtcggacacacagattcacttgggccacgtgttcaccgacggcccggccgaccgcggcggcctgcgctactgcatgaattccgccgccctgcgcttcgtgccgcgctcgcgcatggccgaggaaggatacggcgactggatttcggttgtggatggggatgagcaggcatgagcatggagaatattgcgggcgctcgcaagcccgccaagcgtgaggatgagcacacggtcgccggcgagcatcgcatgatgcgccgcgcggaccgcgaggtgaccaatcccgagcagatcgccgcgattgtcgccgcttgcgacatcgtcgaagtggcctatgcggatgctgagggcctgaccatcgtgccgctgaatttcggctttgattacgagtacgacgaggcgactggcaagctgacgctctggttccactccgcgccgcgcggccgcaagctcgacgcgattcgcgccgccgccggtggccgactgcccgtggctttcaccatgcagaccgactgcgaggtggtggcgggccgcaccacgtgcaattggggcgagacgttcaagtcgatcgtcggcaatggcacggcgtcactggtcgaggatctggatgaatgccgccacggcctgcagacgctgatggcgcagcaggcgcatatgccgaatgtggaattcaccgatgcgcaggtccgcagcgtcacggtgtggaagattgagtccgactacttcaccaccaaagtccgcaccaagcctgcgcccacgcacatgcatcagcaccctgccgtgccgcgcgcaggtgtgatcggtgcccgataacatcattgcagcaaggatgggatgtcggttgtggtgcggctcaacggttcttaacgtaccgggtgccgcggccggcgcccagtttggtgatggtgccgttgtcaagcagtgtcttcagtgtacgttcaacagtgctggcgctgatatcgggcaattgttgaagtatgtccgcttttgagagcggcgataacgtgcgctcaaatagattgccgatacgctgctccttggtgggttttctattgctgccccagtcggacacttccccaatccgttcgtcgaactctttacaggcagtgaggatgacgccgagtaaatagttcacaaatggtgcatagtcgttgacgttgtcgttccagccgtatgtgctcgcggcaagtgcctcgtaataggtgtctttggtccgttcgataaggtgttcaatgctgatatatttacctacttggtaaccattgcggtagagcagtagcaaggtcagcagtcggctcattcgaccattgccgtcattgaatgggtggatgcaggtgaagtcgaaggtgaacattgctgtggcgagcaatggatcgatatgtccgtcttggatggcttctgtataggcggcacaggcgcgctcgatgagctccggtgtgatgagtgcgtttgggggcgtgaaacgaatgatttgttttccggtggcgtcgcgctcgatgatggcattgtcgctgtctttgaaatgtccgccgaaagcgaggccggtgtatcggaacagatcgcgatgcagttggaggattgtatttggggtcggtggaatgtagtcgtggctttcgtggatggtggcgagtacgtcgcgatagccggtgatttcctcctcggcacgattgtgtggcgtggtttttcctgcaaccagtgcgttgagtcgcttgtcgctggtagagataccttcaatacgattggatgcgttggtgctttgaatgcgtgcaaccgcgatgagtgtgttcaacaaatcaggcctgattgcagcctgtacgctttggcgacctttggcttcgtggatggcggatagcagcgttgtggttcgtggggtgagcagtcccttggcggcggtgatgtagtcaaagtgcttcattgtgagtctctttctgcatcatcaaatagctttctgcatcatattctatcaatatgatgcagaaaaaacgatagatgatgcagaaaagtggattgttattcccttgatgatggtgttgctcaaatctcacctcccgttggcgggaggtggcgcgcagcgccggtgggtggcctgcgcccgaacccgataaacttgccgcatggcagcagtgacagtcgtaattaccagctacaaccagggtccgttgattcgcgaagcagtcgagtcggcattgtcccagacagttcgcccggaacgcatcatcatcgtggatgatggttccgatgagcaaacatctgttgatgtattgagcgcaattctcgatgattgccggcatggagcgttggatacgggcggtgtcgccgtcgatttcatcgaccaggtgaatgcaggtccctccgccgcgcgcaaccgcggcatcgccgctgccgggacgccgttcgtggtggtgctggatggcgatgaccgtttgatgccgaccttcattgagcgtacgttgccgttgctgactgctgatgattcgatggttgcgtcctctggttggctgcgtacgttcggggttctggactcagtggtccagccgaccggtggcgacgcgggagcgttcgtgtcgcataactgttgcccggcaacatgcatgattcgccgctcggcgtgggagcgttgcggcggatatgacgagtcgatgcgcagcggctttgaggattgggatctctttttgtcgatgttggagcggggattggaaccgaaagacgacgccgggaagggcgcggcccatatcggcatcgcccccgagcccctgatcgaataccgcacggccccggcctcctcaaacgtgaccagcatgaccaagcgcctcgatctcatgcgcttcctgatcgccaagcatcgcgatctctacgccgcgcacatcgccgacgccatcctcggcgtcgaagccatctccatgagccgcctagccatgtgggaatcgttgatgcgcggtgacaccaccgccagccaagccttcatgacccaccccacctatggcgacggcggaatggccgccgccgttcggctacaaagctgagtctgactgttaatacgcttgatctatcaactgtttggtgagatcattggcgtgacgtaaggagccgctgatgtcctcataccgtattgacgaattatccgttgaccaactcgatcgcataagtttgccaaaattccaacgagggtttgtttggacaaaaaagaagcaggaagatttcgtgcagaccctgcatgatggatacccctttggtactttacttgtttatccggagaacgataacgataaagatgcgaagctccaactattggacgggcagcagcgtctatctactattaagaagtatcggcaagatccattgcagttttggaaaccgttgaacagggaatcgtatacaagcgtctatcagtctgtaaagaagatgttgccggaaggggatcccgatgtctatttagaagtgcaacacccttgttggtcctgtaattctaacagttgttttctaggcaatttccaatctaacgggtgttgcactttcatttagacaacgggctcttccgggaaaggctatttgccgtaatactccagcaggtgtgggtcgacggcctgcaccacatccaccaaatcgccattggagagatacgggcgcttgaattcgcgccacggctccaccttgacctcccagcggccggtcgtctcgtcgagcacgggccgggcggtctgctcccagcgcacacgcttggaggtgcggccggtttccgggtcgcggcgtgtatagtgcaggcaggtgcagttggtgatcttccagtcgtccgaatcggcgcgatgcaggaattcctcgtcggccaaatcctcgatggtgagcatcagggcgagcatgaagtcgccgtgggtgaccatgaccacggattccgaatcggatttgcggctcagcgaggtcaggatgttgtgcacacggtcctcggccacatcggcaatcgactcgcctgccggcggacgccagtacagcggatcggtgttcttgaagttccagttgcgcgcgtagttgtttttgaattcgtccttggtgatggtgttgatctcgccccaagaacgttcgcgcagcacacggttctcctcccatttggctttgggcaaggccatggtggccgcggtctcgcgggtgcgcacatacggcgagaccatgtagcggtcgaacagctgctgctggctgaccagccagcggccgatgcagtcggcctgcttgcgtccggtggcggtgagtctccaggagcggtcgggtacggtgacgttgtcctgcgtgtacagggaattgtcgccctgctcgcccgcctggacgatgacgttcgcttcggattcgccatgccggattacgtatagatcgagcggcatgctcatatatgttcccctttcgttattggttacgttgtgttgttttctgttgtttcctacttgacttgcgtgatggtgttccccttgaccatgaacgcgtgccgggccatgtcgatcatcggctgatcgaatttggagtcggtgtagaactcgtcgatgacgacgtccggaccgtacagttcgcggaaccgtttggccttgttggtgctgaagttgaggtacgtgaccttcatcgtccccacatccacctcgctggccacgagattcctcacgccgagtctgcggcaggcctcccccaccgtcagatcgaaggatgcggtgaggatcacatcgtccgactcaggctggtaccaaggcttgatacgtgcgtaatatcggtcccagaagtcgtccacgagctgttcgacgctcgccacccgtttggatcggctcagttccgtgagatagccttcggtcatcttacccacgccgtattccatttgttcaagcgtggcccggccaagcttgtatttgactgcgtaccgcagcacgggggcgatgtagcggaacactttcgggtcgtgccgggcggaatacaggtacaagtcgaacaggctttcgccatcatagatggttccgtcgaaatcgaatacgcgcataccttctgcttctactctgttattccttgtctaaggctaatctcggtaagccggcgaaagcgcaaatacgcagtgaatttcacatgaacactgttttttggattgatttcggtacaggtaacgtacactggtgacagcgtggaaggaggtgcgtaatggcgacgtctgaaatcgaacaatggtggattgataagtttcaggagaacctgggtccgattcgcaaggtagccggatggacgactcagcaactggccgacgagctgggagtcgcgcgacagacggtgtctaacttggagaccggcaaaagcccgatgaccaaactgcagtatctcgctttacgtacggtgttcagcgccgagatcgcacgtcgtgaagaccgcgatctggcacgcatcatcaagactttggtcgacgatcccattgagcaacgcattcgcgaacggcgcgcccaagagcaagacggcgaggccgttgccgacaatgccccagtcaatacaggctgtggcaacgctgccgacaacgccgccaccgagaaacgcaagcccagtgccgccacattgaaggcttcaaagactgccgcaacgggcaagcccacgctcagcacggcgatgcaggctctcgccgtcatcaccggcgcattggccagtggaaccgccgccggcatcatcacctacttgatgttcccggacggcggcccgaacaagcgctgagtcgccgaaatatcgaaacggattgaacaacccagttcgaagccctgagcaccattttgtccgtgtcgcaccagcgtttccctcattatcagctgtttcgagttgcatgaatgcaccgtttacaggccgagaatttcgtgcttttttgcatcaaattcttcttgggagagaatgccgatatcaaccaattccttcaatttcttcatcgcctcgacttgttcttccacagacatggatgccgtgtgagaggcgggagcagcggcttccggtgccggcgcaggtgccggcgcttgaaccggggcggcagtcataggattgatggcttgcgccatattcataccaagcaacatgccgccatcgccaaagccgttgtcttgaataccttgcgcaatgcgctgctgggcagccatattgccagcttgttgggaaacgccctcgtatgcggcaacattcatcttattcgaggcgaactgctgcacgagctgacgtgattgctcggtgaactcgatgctttcgatgcccacgctggacacttcaaagccaaaacgatcattccatgtaccggcattggctcgatcgccacgcacgcatgctgcgatgtcattcgccttgccgggcaattgcgaaatacgatattcattggacaacgaattgatggccacaataaacgactgtacgaattcggacagaatctgcctacgtggcccttcatcatcgaatgaatacgacacggtagtggcaggcacaaagttacgaacgaatcgaactggatcagtgacctttagcgacatggctccgcgtgcgcgaatttccaaatcgacgccatagaaccggtcgttatacaccagcggcgcagaagtgccgaatttgatgccacgaatctcacgcaggttgacgaaggccacatatttggtgcggccaggctgacctccgaaggtgaatcgatcggcgacctggttgaagaacgatccgatgccgtctccggcgagcacgctctgttccccgttgcgatattcataaccgcccgactcggtgatgacgttttcgatacctgtttcagagaaaatgaacgccgcagtattctctggcacatagatacgcgaaccattggtgattattccctcggaaccgtattcattcgaaccgcgatcgttgttgcttccgcggggaatgcccggcacaacgacggtgtgttccgtgaacggaccagcggtgatgatatcacgccacaggtccgcgaatgtaccgccgagcgcgccggcgaacgccttaataactgccatctgttttttcctcgatatctcatgcatatggccgatcttgcgactatgcaatcgcaagaccggccgttatgctggcatgttggttatagctgcgtttcgcgatcgcagtattcgcatcgaacgacttctttgcgatgaccggaaagcggagcgccacaaccttcgcaattcaccgaaaccacgggttcggtaatcccaagcccactacggaatgcgccaaaagtgtccttcagcgccccggccagagcctccgttccggggatggccttgttgaagaccggctcatccattggcgtgtactgtctgccgcgtatacccatgtatcgtcatcgttcctttcttggaaaaccgttacctcgatacgccagtctgatcactggcccaccgatgcgagcttctgcatgcatcgagtcatgacctcggtgtagtaggccgaatcctcactgctgagggagttttcgtcaatggcgtctaccttctgggagaactcagagtaacgcttcatcatgctggcatagtcggtagccatgctgaccacgttgtcggatttctgatatttgttcatgaaggcaacatactcatcgataaaggcctcgtagctgtccatcgtggccttgaagtcagcactgtcattggtgttctgctgcgccttctgatccgaagactggtcgctctgcttgttggcatcgctggaatcagtgcccgtaccagtgctcttatcatcctgtttcgcggcgtcgccgtccgtagacgtatcttccttcttttccggaacctggatagtgatggacatgatggtctcgtcgtcagtgttacgagaaacgctcacactgtatccatcggcgttcttggcattgaaactgtcagcggacttgctatagtccacggtgaaaccgttgtcttgcacggacttgacgtagtcggcatactgcttggcgtcggtaccgcacacctcgatggagaaatagtccgaagactcgcttttaatttcaccctttgtggatttcggctgcggcagcagcgccgcgatatccgactccggccatgaatatgcttcgcacttggtggcgagcgatgcttccaattccgcccgatcagccttggccttcgcatcgtcacgaattacgaacacgccaccgattaccagacccacaacggtgataccgactgccacccaggccagcactcggccttgcaccttgccactcgggcgggtcacgtatacggcgaagcctgagagcagtgccggaatcaccgtggcgaacagcagtccgccccaggatcggccagaaacatccacaaattgggcgagtacgaacaacactccccaaataatggcgaacacagccagcttggaagtcttcttcaccccttgtgcattcggagcaagcacggcaggcgcagcggcaccagcaaaaccagtggcagcaccggcaccatgtgtggcgggtgcaggagccacaccaatacgcttgtccagagcggcgaggaactcatcaacgcgcttggcgctttcgtttccagtcgcctccagacgaatggcggcccctgccgcaccctgcgggactacggttagcgtgcagttcaccccatcataggagtggaaggaaaacgctccggtctgggtgttttcgttatccaaggtaaacgtggcgccagtagtcagctggtcgtgaataacttggaacagctgttgcggactgaccgcatatacacgatcaaatggcgcgccggcgggccgctgcgatgccgtagccggagccatcggagtggtggtagcaccatcagacgctacgttcggttggccagccggtacagtattcggcatggtaggcgcattcgcgcgatcttccggtgcgtcattcgtgccttcggacggtggaaccggctgaggttgttgatcaaatggcgttgtcatgatgcccttctttccttaagcagcagcattaccagcacagaagaggcaagcccggcaaccgttacggtcaatccgactgccatggcaagccggtatcgttcgctcatcattgcgtcccttcttattgctcgctttgctctgcgatacatcgaaaccagtgtatggcgttgttattatgtacgcaaattagcattttgtatgcatgttagctttattgtcgatgcttgataccgcgcatgaacatcctttccgccaccgcacctacacggatggcatcgaccattgtcggcgacacgcgcgggccatacatcagctgacaactgaatttttcggcgtgtttccgaaaagtcggcgtcctgtacgctgggaatcgagcaaccgcgtacgatggcgcagcacagcacccgcaacacagcgacaaggagcatgggcaatggcagacatccccgaagaacatttgaccgaggaactgttggatcggctgctcgccagcgccagcattgagcagtatctcgatgagggactcgtcagcgcacgcacgctgaccgactatctgttcgaccgtatggaagcccatgacctgagacgagccgacgtggtgcgggcatccggcctcaacgccacagtggtttatgacattttctccggcaaaagccgccccggccgagatcacgccattatgctggcttttggtctcaagtgcacattacgtgaaacccaacggctacttcgtcttgcaggcgtttccgaactgtggtgcaaacagcgacgcgacgcgattatcatctggtgtatacgcaatggattcgaccgcattgccacggacgacgagttgtatcgtatgggagaggcgacgttgctaccggccgattgacgacattcggcccaacaacactcaccagtgagacgcaagtaagagggcgtcaaggagagacatggacgataagcaggcgatgcatgcgatgagcatcgacgatgcgtaccatgtcgagcgtacgctcgctcgcggaccttccggcgtcaccgaactggtgagcattgacggcaacggcccgttcgtacgcaagaagattccctctcccctagcgcaacgcaatgtgtgggcggcgctcagcgcctgccagagtaatcgtctgccgcgtgtggaagcgacgtacgagctgcccgaccggttcgtcatcgtctacgattacgtgccgggcagcacgcttgcgcaaattgcggaggaaaacgggcggcttgcaccgaatgtggccgtgcagcttatcgaccaaatttgcgaagccgtgcaggagcttcaccagcacggcgttatccaccgcgacatcacgccggccaacgtcatcgtggcccaggatggcgcgcatctcatcgatttcggcatcgcgcgcatccggtcagaggcaagcaaccgttcacgggataccacggcgcttggcacctacggattcgcctcgcctgagcaatatggctttgccaaaaccgacgcgcgttccgacgtattctcgctgggccggctactcggattcatgctgaccggcgtatatcccgatgccagcgactacgagcagcgacttgccgatgatgccgcagtaccggctcgactacgcgccgtcatcggctatgcgtgcgcattcgagcccagcaaacggccacagagcatccaagagtttcaccaggcgctgttctcccagtccaatccgcccataccgaacgcatcatcggcaaatccgccatcaacgagaacaacgaacggcagcgcgtcggcgtctcgactattccggcgtctgcacttgagcaaacgcgccatcgtgctgtggtccattgccggagcggcactgataatcgccgccattgcgggaggcattgtgttggcaggccaacttggcattatcgggtcggcaacatcacccgattcctcgacacaatccagcagccaatcaaccgataaggccgatggcgggcactcctcgaacgggtcaggaaccgacaatgccaatggcacgggcggagtaggcggcactgacggcgctgatggagacaatcaagacaccgtcaccgacaatcctctgaaaatagtggaatccggctggtcggcggaccagcaagggtatgtccactacgctttcgccctgcgcaacaccagtaagacccagcaggtgcagtatccgcagattaccattacggggcgggccaaagacggttccatcgtgttctcgcagacgcaagcactgaatatggcattcccgaatcagactgtatatgacgccggccaagcgggcgagggcacggccccggccaccgtagatttcgttgtgcttagccctgatacgtacaacgtcaccgaggctcaaggaaccgctaccttccccatcagcggaacatccaaaatagacaacagggacggcggcacgacgttcaatggcgaggtccgcgccgtggcagatggattcaagccatctgatggacagcaaatcaagatttccctagtactgcgtaacgcacagaacgcaatcatctatggagatatcgcattcgtggattggccgggcaatggccgatccacgccattctcgattaccgtctacgatctgccgaagtatgtgtcttacgatctgtatgcgcaaatctggtagttgactttacgtctggcaggtggccgtcaggtgcctgtcaggccgctgttcgcgtcacctgcgcactgacgttacggcgcgcctggccgaacagatagatgccgatgggcagggtcagaacaccgccgatgatgaacaccagcgaaatcgggatcacgtcggccagtggcgcgaagatcaacatgccgagcggcattccgagcgtgctcagggtggtgtcaaggccgaatacacggcccaccatcttctcatcggcctcggtctggatgatggtgcgcatcgggcccatgcagatggccgaagccaaaccgttcaccacatcaatcagcaaatacgccagcagattgtgaaccacgccaagaccaacgacggagacgcccaccagagcgatgccgaaggcgaccacgcgcatgttgttgcggatgagcttggcaccgatggtagacatcagcgcgccgccgagcagcataccgatgctccatcccagctcgttggcggcgagtttatcggaggcggtggtcaggttgatgaatccgagattcaaatcgatgccctcatattcgcgggtcatgagcaacagcgtaaggttcatcggcgccacggccacgaagcacaccaaggcgtcaccgagcaccacgttgcgcaggttcgcccggcgccatgtgtagctgaaaccatctttcaagtcagcaaacacacgacggacgctggcaatcagcgaacgatcagcattggcatccgacatcggttcgagtgtgggttgcccgctattctccgcttcagccatacgcctcgcaacatgttccgtgctcttcttcggcgctttgatcaacgccacaaagccgacgccgataatggccgtggtcacatcgactaacagaatcgaccacagcggcactgtgttgataagcacagcagccaccgcaggtgccacaatcatattcaccgaattaatcacgccgtatattgagttgacgcgcaatagtttgcccgagggaacaacatccggtatgaacgactgcacagcgggcgtctgcaccccgcctcccgccgaacgaatgaacagcaccacgaaaatcatggtcagactcgcccatcccatcgcgaagctcagcgacagcacgacggtgaccacagcaatcaccatatccggcagcataatcagcaacttgcgactgtgacggtcggcccaggagccgccgcaaatcgagacgatggcctgcggcaccacgccaaacaacgtggccagcagcatggccgaaccggttttagtctgcaatacgatccaccaccagatggcatattgcacaatattggagcccagcagcgagaacgcctggccggtgagtagaagcactacacggcggatccacgcacgctcggattccccgttggccactgctgcggcataggcggcaccgggtttgttcgcgctatggaccgctgcgcgcgcattcgcattgtcatcgccggaaacctcgggtgtttcgcgcacagttggttcagttgttgtactactagaagacatacgagtgttctcaattcttcaattccactacaaaggtcacatcacggcatacgcacgccgacgcgcgtatgcgtgcacgactccagcaacgagccgtacccgccgttagatggcaggcttcagtatcgtgacgccatgcgttagcgtcaccatgcaacgataggaacacactattcgatagtataatcatgaaggcgtgacgttgccccccgatgtctatttagaagtgcaacacccttgttggtcctgtaattctaacagttataatagatatatacaatacatgtttttacccggatcatagagttcttaagacaaataaaatttatagagacttgttcagtctacttctctctaaactaggccccggctcctgccagtacccacttagaaagaaataaaaaaacaaatcagacaacaaaggcttaatctcagcagatcgtaacaacaaggctactctactgcttacaataccccgttgtacatctaagtcgtatacaaatgatttatccccacgcaaaatgacattgcaattcgccagcaagcacccaaggcctttccgccaagtgcaccgttgctagcctgctatggttcagcgacgccacaaggacgccttattcgtatccatctatattgtgtggagcaaagaaatcaccgcgttctagcatggattctgacttagaggcgttcagccataatccagcggatggtagcttcgcggcaatgcctgatcagacagccgcaaaaaccaattatccgaatgaactgttcctctcgtactaagttcaattactattgcggtaacattcatcagtagggtaaaactaacctgtctcacgacggtctaaacccagctcacgttccctattagtgggtgaacaatccaacgcttaccgaattctgcttcggtatgataggaagagccgacatcgaagaatcaaaaagcaatgtcgctatgaacgcttgactgccacaagccagttatccctgtggtaacttttctggcacctctagcctcaaattccgagggactaaaggatcgataggccacactttcatggtttgtattcacactgaaaatcaaaatcaagggggcttttacccttttgttctactggagatttctgttctccatgagccccccttaggacatctgcgttatcgtttaacagatgtgccgccccagccaaactccccacctgacaatgtcttcaacccggatcagccccgaatgggaccttgaatgctagaacgtggaaaatgaattccagctccgcttcattgaataagtaaagaaactataaaggtagtggtatttcactggcgccgaagctcccacttattctacaccctctatgtctcttcacaatgtcaaactagagtcaagctcaacagggtcttctttccccgctgattctgccaagcccgttcccttggctgtggtttcgctagatagtagatagggacagtgggaatctcgttaatccattcatgcgcgtcactaattagatgacgaggcatttggctaccttaagagagtcatagttactcccgccgtttacccgcgcttggttgaatttcttcactttgacattcagagcactgggcagaaatcacattgcgtcaacatcactttctgaccatcgcaatgctatgttttaattagacagtcagattccccttgtccgtaccagttctaagttgatcgttaattgtagcaagcgacggtctacaagagacctaccaaggccgtctacaacaaggcacgcaagtagtccgcctagcagagcaagccccaccaagcagtccacaagcacgcccgctgcgtctgaccaaggccctcactacccgacccttagagccaatccttatcccgaagttacggatctattttgccgacttcccttatctacattattctatcaactagaggctgttcaccttggagacctgctgcggttatcagtacgacctggcatgaaaactattccttcctgtggattttcacgggccgtcacaagcgcaccggagccagcaaaggtgctggcctcttccagccataagaccccatctccggataaaccaattccggggtgataagctgttaagaagaaaagataactcctcccagggctcgcgccgacgtctccacattcagttacgttaccgtgaagaatccatatccaggttccggaatcttaaccggattccctttcgatggtggcctgcataaaatcaggcctttgaaacggagcttccccatctcttaggatcgactaacccacgtccaactgctgttgacgtggaacctttccccacttcagtcttcaaagttctcatttgaatatttgctactaccaccaagatctgcactagaggccgttcgacccgaccttacggtctaggcttcgtcactgacctccacgcctgcctactcgtcagggcatcatatcaaccctgacggtagagtataggtaacacgcttgagcgccatccattttcagggctagttcattcggccggtgagttgttacacactccttagcggattccgacttccatggccaccgtccggctgtctagatgaactaacaccttttgtggtgtctgatgagcgtgtattccggcaccttaactctacgttcggttcatcccgcatcgccagttctgcttaccaaaaatggcccactaaaagctcttcattcaaatgtccacgttcaattaagtaacaaggacttcttacatatttaaagtttgagaataggtcaaggtcatttcgaccccggaacctctaatcattcgctttacctcataaaactgatacgagcttctgctatcctgagggaaacttcggcaggaaccagctactagatggttcgattagtctttcgcccctatacccaaattcgacgatcgatttgcacgtcagaaccgctacgagcctccaccagagtttcctctggcttcaccctattcaggcatagttcaccatctttcgggtcccaacagctatgctcttactcaaatccatccgaagacatcaggatcggtcgattgtgcacctcttgcgaggccccaacctacgttcactttcattacgcgtatgggttttacacccaaacactcgcatagacgttagactccttggtccgtgtttcaagacgggcggcatataaccattatgccagcatccttgacttacgtcgcagtcctcagtcccagctggcagtattcccacaggctataatacttaccgaggcaagctacattcctatggatttatcctgccaccaaaactgatgctggcccagtgaaatgcgagattcccctacccacaaggagcagagggcacaaaacaccatgtctgatcaaatgcccttccctttcaacaatttcacgtactttttcactctcttttcaaagttcttttcatctttccatcactgtacttgttcgctatcggtctctcgccaatatttagctttagatggaatttaccacccacttagagctgcattcccaaacaactcgactcttcgaaggcactttacaaagaaccgcactcctcgccacacgggattctcaccctctatgacgtcctgttccaaggaacatagacaaggaacggccccaaagttgccctctccaaattacaactcgggcaccgaaggtaccagatttcaaatttgagcttttgccgcttcactcgccgttactaaggcaatcccggttggtttcttttcctccgcttattgatatgcttaagttcagcgggtactcctacctgatttgaggtcaaactttaagaacattgttcgcctagacgctctcttcttatcgataacgttccaatacgctcagtataaaaaagattagccgcagttggtaaaacctaaaacgaccgtacttgcattatacctcaagcacgcagagaaacctctctttggaaaaaaaaaacatccaatgaaaaggccagcaatttcaagttaactccaaagagtatcactcactaccaaacagaatgtttgagaaggaaatgacgctcaaacaggcatgccccctggaataccaaggggcgcaatgtgcgttcaaagattcgatgattcacggaattctgcaattcacattacgtatcgcatttcgctgcgttcttcatcgatgcgagaaccaagagatccgttgttgaaagtttttaatattttaaaatttccagttacgaaaattcttgtttttgacaaaaatttaatgaatagataaaattgtttgtgtttgttaacctctgggccccgattgctcgaatgcccaaagaaaaagttgcaaagatatgaaaactccacagtgtgttgtattgaaacggttttaattgtcctataacaaaagcacagaaatctctcaccgtttggaatagcaagaaagaaacttacaagcctagcaagaccgcgcacttaagcgcaggcccggctggactctccatctcttgtcttcttgcccagtaaaagctctcatgctcttgccaaaacaaaaaaaaaaaaatccattttcaaaattattaaatttctttaatgatccttccgcaggttcacctacggaaaccttgttacgacttttagttcctctaaatgaccaagtttgtccaaattctccgctctgagatggagttgcccccttctctaagcagatcctgaggcctcactaagccattcaatcggtactagcgacgggcggtgtgtacaaagggcagggacgtaatcaacgcaagctgatgacttgcgcttactaggaattcctcgttgaagagcaataattacaatgctctatccccagcacgacggagtttcacaagattaccaagacctctcggccaaggttagactcgctggctccgtcagtgtagcgcgcgtgcggcccagaacgtctaagggcatcacagacctgttattgcctcaaacttccatcggcttgaaaccgatagtccctctaagaagtggataaccagcaaatgctagcaccactatttagtaggttaaggtctcgttcgttatcgcaattaagcagacaaatcactccaccaactaagaacggccatgcaccaccacccacaaaatcaagaaagagctctcaatctgtcaatccttattgtgtctggacctggtgagtttccccgtgttgagtcaaattaagccgcaggctccactcctggtggtgcccttccgtcaattcctttaagtttcagccttgcgaccatactccccccagaacccaaagactttgatttctcgtaaggtgccgagtgggtcattaaaaaaacaccacccgatccctagtcggcatagtttatggttaagactacgacggtatctgatcatcttcgatcccctaactttcgttcttgattaatgaaaacgtccttggcaaatgctttcgcagtagttagtcttcaataaatccaagaatttcacctctgacaattgaatactgatgcccccgaccgtccctattaatcattacgatggtcctagaaaccaacaaaatagaaccaaacgtcctattctattattccatgctaatatattcgagcaatacgcctgctttgaacactctaattttttcaaagtaaaagtcccggttcgccaagagccacaaggactcaaggttagccagaaggaaaggccccgttggaaatccagtacacgaaaaaatcggaccggccaaccgggcccaaagttcaactacgagctttttaactgcaacaactttaatatacgctattggagctggaattaccgcggctgctggcaccagacttgccctccaattgttcctcgttaaggtatttacattgtactcattccaattacaagacccgaatgggccctgtatcgttatttattgtcactacctccctgaattaggattgggtaatttgcgcgcctgctgccttccttggatgtggtagccgtttctcaggctccctctccggaatcgaacccttattccccgttacccgttgaaaccatggtaggccactatcctaccatcgaaagttgatagggcagaaatttgaatgaaccatcgccagcacaaggccatgcgattcgaaaagttattatgaatcatcaaagagtccgaagacattgattttttatctaataaatacatctcttccaaagggtcgagattttaagcatgtattagctctagaattaccacagttataccatgtagtaaaggaactatcaaataaacgataactgatttaatgagccattcgcagtttcactgtataaattgcttatacttagacatgcatggcttaatctttgagacaagcatatgactactggcaggatcaaccagataactatcttaaaagaagaagcaacaagcagtaaaaaagaaagaaaccgaaatctcttttttttttcccacccattccctcttgctagaagatacttattgagtttggaaacagctgaaattccagaaaaattgctttttcaggtctctctgctgccggaaatgctctctgttcaaaaagcttttacactcttgaccagcgcactccgtcaccataccatagcactctttgagtttcctctaatcaggttccaccaaacagataccccggtgtttcacggaatggtacgtttgatatcgctgatttgagaggaggttacacttgaagaatcacagtcttgcgaccggctattcaacaaggcattcccccaagtttgaattctttgaaatagattgctattagctagtaatccaccaaatccttcgctgctcaccaatggaatcgcaagatgcccacgatgagactgttcaggttaaacgcaaaagaaacacactctgggaatttcttcccaaattgtatctctcaatacgcatcaacccatgtcaattaaacacgctgtatagagactaggcagatctgacgatcacctagcgactctctccaccgtttgacgaggccatttacaaaaacataacgaacgacaagcctactcgaattcgtttccaaactcttttcgaacttgtcttcaactgctttcgcatgaagtacctcccaactacttttcctcacacttgtactccatgactaaaccccccctcccattacaaactaaaatcttacttttattttcttttgccctctctgtcgctctgccttaactacgtatttcttgccgagaaaaacttcaatttaagctattctccaaaaatcttagcgtatatttttttcttttttttttccaaagtgacaggtgccccgggtaacccagttcctcacttttttttactgcggaagcggaagcggaagcggaagcggaagcggaagcggaaaatacggaagcggaaaatacggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccagttcctcacttttttttactgcggaagcggaagcggaaaatacggaagcggaaaatacggaagcggaaaatacggaagcggaaaatacggaaacgcgcgggaacatacaaaatatacctttctcacacaagaaatatatgctacttgcaaaatatcataccaaaaaacttttcacaaccgaaaccaaaaccaacggatatcatacattacactaccaccattcaaactttactactatcctcccttcagtttccctttttctgcctttttcggtgacggaaatacgcttcagagaccctaaagggaaatccatgccataacaggaaagtaacatcccaatgcggactataccaccccaccacactcctaccaataatggtaactattctatgttttcttactcctatgtctattcatctttcatctaactacctaatactatgcaaaaatgtaaaattatcacacaaaacataaacaatcaaaatcagccatttccgcaccttttcctctgtccactttcaaccgtccctccaaatgtaaaatggcctatcggaatacatttcctacatcctaactactataaaacaacctttagacttacgtttgctactctcatggtctcaatactgccgccgaaattctgtcccacatactaaatctcttcccgtcattatcgcccgcatccggtgccgtaaatgcaaaacaaataccatctatgtcttccacaccatcattttactatgcctgccaccatccatttgtcttttgcaccatatcttcataacctgtcaccttgaaactacctctgcatgccacctaccgaccaactttcatgttctgtttcgacctacctcttgtaaatgacaaatcacctttttcatcgtatgcaccttattctccacatcacaatgcactattgcttttgctttttcacctctcatatcctattgctattagatgaaatataataaaaattgtcctccacccataacacctctcactcccacctactgaacatgtctggaccctgccctcatatcacctgcgtttccgttaaactatcggttgcggccatatctaccagaaagcaccgtttcccgtccgatcaactgtagttaagctggtaagagcctgaccgagtagactgcaatagatcggaagagcggttcagcaggaatgccgagaccgatctcgtatgccgtcttctgcttgaaaaaaaaaaccagatggtccggcagattcgacgtattatccgccacaggggcttcctgtacgtgtggtgcggcggcgtgctactctcccacaccctgtcgggtgcagtaccatcgccgtgccaggccttagcttccgggttcggaatgggaccgggcgtctcacctgggccatggccgccgcaaatcttctcttgtacggtcagacgctggggtctgccggcctgtggcggcctgggaaccggacagcggacgcggatatgtcgatgtttcgtcttgtggccagacaatgctcattgccgtctggtgccgtttgcaggaggaagatgcggtccaaccgccaggggttggaatgtcagtgttgcctttcgtccgttagtaccggtcggctccacccctcgcggggcttccacgtccggcctatcgaccacgtgttctgcatggggactacaggaactcgaaggttccacggaatgcttatcttggagcaggcttcccgcttagatgctttcagcggttatcccttccgaacgtagccaaccggccgtgccactggcgtgacaaccggcataccagaggttcgtccacccaggtcctctcgtactatgggcaggcctcctcagcattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgtccgtacaccggcaccggatcactagtcccgactttcgtccctgctcggaccgtcgtcctcgcagtcaagcccgcttgtgcacttgcactcgccacccgattgccaaccgggctgagcggacctttgggcgcctccgttactctttgggaggcaaccgccccagttaaactacccgccaggcactgtccctgaacaggatgactgttcgaggttagacatccaatgcgaacagagcggtatttcaccttacggctccgcgcgatctggcgaccgcgcctctcggcctcccgcctatgctacacaatccacaccgaatgccaataccaaggtatagtaaaggtcccggggtcttttcgtccttctgcgcttaacgagcatctttactcgtactgcaatttcgccgagctcctggtcgagacagtggggaagtcgttacgccattcgtgcaggtcggaacttacccgacaaggaatttcgctaccttaggatggttatagttaccaccgccgtttaccggggcttgaattcaccgcttcacccgaaggctgacggatcctcttaaccttccggcaccgggcaggcgtcagtgcatatacagcggcttgcgccttcgcatgcacctgtgtttttggtaaacagtcgctaccccctggtctgtgccacccccaaaagctcccacagcaagtgtgttcaccatcgggggtctcccttaaaccgaaggaacgggagtgatttgccgagttccttgaccaggattcgctcgatcgctttggtattctctacctgaccaccagtgtcggtttggggtacgggcggctttgagcctgacgccgaagcttttctcggcagccgggatcaccggatatcgggccataaggcccccatcatcgcacctcggacccatgcgggacggatttgcctgtcccacgccctgcgtgcttgaccacggaagaccacctccgcggccggctacccttctgcgtcactcctgcgctgacctactacaaggatcggtcccaacaggccagggcatcccgcccccgaaggagcagtaagcccggacccggaggttagtactccaagcctcggttttggcggctgaaagccggtacgggaatatcgacccgttcatccattcgactacgcctgtcggcctcgccttaggacccgactcacccagggacgatgaacgtggccctggaacccttggtcatccagcggacgggatcttcacccgtctctcgctactcatgtctgcattctcactcccatgaagtccacggcgcgttcacacggccgcttcgcccctcatgggacgctctcctacccagtacaaaatactgccgcgtcttcggtggtgtgcttgagccccgctacattgtcggcgcggaaccactagaccagtgagctgttacgcactctttcaagggtggctgcttctgagccaacctcctggctgtctatgcgactccacatcctttcccacttagcacacgcttcgggaccttagacgacggtctgggctgtttccctttcgacgacgaagcttatcccccgccgactcactgccgggatacgcgtcaccggtattcggagtttggttgctgttggtacccgatacgggcccgcaagcatccagtagctctacccccgggacgtaatgacccgacgctgcacccaaatgcatttcggagagaaccagctatcacggaatttgattggcctttcacccctagccccaagtcatccccccggttttcaacccaggtgggttcggtcctccacgcggtcttacccgcgcttcaacctgctcagggctagatcatcccgcttcgggtccaggacacgcgactcaaacgccttttaagactcgccttcgctacgcataccccacacgggttatgctcgccacatgccactgactcgcagactcatttttcgataggcacgccgtcaccccacaaaagggctccgacggattgtaggcgcacggtttcagagactgtttcactcccctcccggggtacttttcacctttccctcacggtactcgttcgctatcggtcagacaggaatattcaggcttacccaacggtctgggcggattcgcacggggttccacgggacccgtgctacttgggagacgcgatcggcagaccatgcgcgttcaggtacggggccctcaccctctgcggcccggtattcaacccggttcccctgacacatggttttctgcaactgccggccggcccgtcggagccggcgcacgcgatcccgcaacaccccgcgcgcaacccccgacgggtatcacacgcgcaaggtttggccatcatccgctttcgctcgccactactcacggaatatcctttcctgcaggtactgagatgtttcacttccctgcgtaccccccggccgaagccggtaccgacccatgacggtcggtgggttcccccattcggaaatcctcggatcaaagccctgttggcggctccccgaggcatatcgcagcctcaaacgtccttcatcggtcctgtctgccaaggcatccaccatacgcccttgcaagcaacacacaccacgaaagtgcatggccgcaagattcctctagcaaattcccagacgacaaatcatcacactaaaaatgatcacaaaacgatcgaaacgaacaatagagttcgattcgaaatcaacagcaaaacaaagattcaaaaacccttgttttgctcgcgtccactatccagttctcaagccaccacgcaccgccacgccatcgcgccggcacacggccggcccccaggcacgacgggcatcgaatcgcgccaggcaaaaagcctggggtggcgatccgggagcccaaaagcgcatccataccaccccggcacccaccgcacgaccggcagggcaaagccaacgacgtcttccacaccagcaaccccgccgccatcgcaccatgcgacgcgcggggcgcacaccgtcggacgaacatccgactgaattctccgtagaaaggaggtgatccagccgcaccttccggtacggctaccttgttacgacttagtcccaatcacgagcctcaccttagacggctccatcccacaaggggttaggccaccggcttcgggtgctgcccactttcatgacttgacgggcggtgtgtacaaggcccgggaacgcattcaccgcgacgttgctgattcgcgattactagcgactccgccttcacgcagtcgagttgcagactgcgatccgaactgagaccggttttcagggatccgctccgcgtcgccgcgtcgcatcccgttgtaccggccattgtagcatgcgtgaagccctggacgtaaggggcatgatgatctgacgtcatccccaccttcctccgagttaaccccggcggtcccccgtgagttcccggcataatccgctggcaacacggggcgagggttgcgctcgttgcgggacttaacccaacatctcacgacacgagctgacgacgaccatgcaccacctgtgaacccgccccgaagggaagccgtatctctacgaccgtcgggaacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttagctccgacacggaacccgtggaacgggccccacatccagcatccaccgtttacggcgtggactaccagggtatctaatcctgttcgctccccacgctttcgctcctcagcgtcagtaacggcccagagacctgccttcgccattggtgttcttcccgatatctacacattccaccgttacaccgggaattccagtctcccctaccgcactcaagcccgcccgtacccggcgcggatccaccgttaagcgatggactttcacaccggacgcgacgaaccgcctacgagccctttacgcccaataattccggataacgcttgcaccctacgtattaccgcggctgctggcacgtagttagccggtgcttattcaacgggtaaactcactctcgcttgctccccgataaaagaggtttacaacccgaaggcctccatccctcacgcggcgtcgctgcatcaggcttgcgcccattgtgcaatattccccactgctgcctcccgtaggagtctgggccgtatctcagtcccaatgtggccggtcgccctctcaggccggctacccgtcgaagccacggtgggccgttaccccgccgtcaagctgataggacgcgaccccatcccataccgcgaaagctttcccagaagaccatgcgatcaactggagcatccggcattaccacccgtttccaggagctattccggtgtatggggcaggtcggtcacgcattactcacccgttcgccactctcaccaccaagcaaagcctgatggatcccgttcgacttgcatgtgttaagcacgccgccagcgttcatcctgagccagaatcgaaccctccacaaaaaaaacttcatgaaaagcatccgaatagatgactctcaaaacaaaaattgacgagcacgtccttaaggaaggacgccctcaaaaaacctcacccctcatcaaaccctcccgggtacccaaccaccacgacaggcaatcaggcgaggaatgaactggcaatcattgactataaagaagtagtacaaacacgctcttgagttctcaaaccaccaccactgtttgtgttcaattagttgttgcgggtttagtcacgatgatttttcgggtttaggcagagcatgccgaccacggaatggtcttaactggatggtgcttgtatctccgccagaaaggaccggaaaggattatgatcagcatgccccaagtacagtctatccgtcgtttgcggcggaacggggaatccgtcgcgtcgatcgcgcggaaaacacatgtcagcgagccgacggtgcgtaagtacctcgcgaaggaggatctgtcggccgtgccgtcggtgagaaagccgcgcgcgtcggtgatcgacccgtatctgcccgtgatcgagcagtggctcgcggaggatcgcgcgaactggcgcaagcagcggcataccgcgaccaggatctgggagcggttgagggacgagcatggcgcggaggtctccctgtccacggtgacgcgggcggtggcgcggctcaggcgtgagttcgcggcggagcgtgatgaggcgttcatggatctggtatggcatccaggcgaggcgcaggccgatttcggcgaggtcgacgtgctgttgcgcggcgtggtgcagcggatgcatcatttcgtgcttgatttcccgtattcgaacgtcggtctggtgcagttgatgccgggcgagaacgctgagtgcacgtgcctggcgttgcgcaacctgttcgagtggctgggcggtgtgccggagcggatcgtgttcgataacgccgccggcgtgggccataaggggtacggggagcgcgagccgcgcctgacgcacctgttccaggccttccaggcgcattacgggttcgattgttcgttctgcaacccgtattccggtcatgagaagggcgcggtggagtccaaggtcggcatggtgcggcgcaagctgttcgtgccccggccgagcgtatggagcctggagaactttaacgccgggctgccggaccggtgcctggagctggccacgaaaccgcattaccgcaaggacacggaggaacgtggcctgttctccgaggaccgtgcggcgctgctgccgttgcccgggaagcgtttcgacgtggtcacgtggcggcatatgaaggccgaccggtacggcgtggtcacgctcgagggacggcatcgttattccgcggaccgggcgaacgcgggcagagaggtgatcgtgggcctccgcgcgctcgaggtcgaggtcctcgactcgtcgggcaagcatctggcgacccatcctcgggcgtacggccaggccagcacgaacagcgaggacccgtccatgcagttggcgctgctgtgcaacaagcccgcgtcctggcccaacagccgggtacgtgacgcgttgccggacccgttgcgggaatggctggatcggcaggacagacagacacgcaacgaggcgctgcagaccctcaaacgcgttgacagggaatccgggtgggcgaacgcggtcgaggcgatgctttccatcctcgaatcgaccggcggggcggaccgcgccggtgtcacactgctcgcggccaggctcgccgagggcgtggcgggtatcgaatacgacgatgacaggccggatctgagtgaatacgacatcgcgttcaccgcggacgtcggcgtgcaggaaggagggcgatgaacacgaagacggacgaagggctctacgagaaggcccgcaagctgttcatctccaaggcgagcatcgacgaattcgccggctgggccacgccccgccaggtcgacgccgtccaccgcctgctcgacacggaactggcgaacagggaacgcgcgaagcacgacaggctcctgcgccgcgcccggttccccgtcgtcaagggtctcgacggctacgacttcacgaacgtcaggctccccgacggctacatgctcgatgagctcctagggctcggtttcatcccgcgcgcgcaggacctggtgttctacggcaagaccgggcgcggaaagacacatctcgcgatcgggctgggcatgaaggcgatcgacatggggctgggcgtgcggttccatcagaccgccgagctcgtcctccagctgggcaaggccaaacgcgacggcacgctcgagacgatgctccgggacatcggccgtgccgacctgatcatactggacgagttcggctacgtacccttcgacatcgacggggcgcgcctgctctaccagatcatcgcgggcagctacgaaagacggagcatcatattcaccacgaacatcgagttcagtaaatggggcacggtcttcgcggacgacaaactcgccgcagcgatcatcgaccgcatcgtgcaccacgggcggctcctcgagttcaccggccagagccgccgcgtcagtgaggccctcatgttcggcaggaacacctccgcgcaaccggaaaaataaggaaaatgcatgcaactgcctaaacccgaaaaaaatacatgactaaacacgaaacaccgacttgacgaaatacacattcacaggctggagttcggagaggtgtccgggcatcgggttcttatcaagaggggaccgggaaatcggggtcctacggaatgtggaaccacccacgaggccacgtctggaatgtcttcgtgagaccggcctcatcctgaggtgcgaccggaaggtcgggaaccccttccagacaaagcaggggagtcgaccctcctgtccagatcaggaggggagaaagggctcagaggagggggtgccggaaaacctcagtgttcctctcgagggagaccgggatttcggggaactttgtgggtcgcatcaagggtgccaagtgccctttcgacctccaattcctaacgtgggacttctcctgaggcgctgtagcgggaaagggcttcatcttgcgatgacgggggagccacgtggtttttctcgagttacggcgggattctcgagttacgacggggaattcaggctgcctcttgtgttggcccaggcaagtccaatcttccattcgagttgcgaaggaaagctggggattgctctcgagtgactgcagggccaatagacctcatctaggcttgtgtccagaagccaatgttcctctccaggggcgacagggatctcggggttgcattccagacgcacccggggagacaggcattcatctcgagtggaagcaaagaaccccgctctgctctcgaatcgcgacgggtatctcttggagctcactgggtggactcaagggagtcaagcctcctgaggcgtttggagagaggtcgcgagattggtctctaggccatgcaggagacgaaggccctcatctctcgatgacgggggaatctcggggttgttctcgagcggcggccccagtgtgcggtttctcacgaggtacgacggcgaggtcagtgagcctctcgtggggcgccagggaagtcgggtctccatgcgagtggcgagggggagcgcgtcattgctcccgagccatggtaggggaatctggcctcgagacgtgttgaagaaggtctctcgaggtctttcccgggttgaggcaggaaaccctgggttccctcgacttgtgcaggtgacctcagggggcttctcatggtggctctgagaagccagggaaactggaggtgggaggggcctctcgggactccactgggtttggtgcattggaagagggcctcatctccagttgaggcaggaaccgcagggtacctctgatttcagactccgatcgcagggtccctgcagactggggacaggagagtcaggcctcgtcttggcttgaggcatggaactccgcttgcctctcgagatgtccccggggagagaggccgcttgtcgagctgtatttggaacctggggttttttccgaacgatgcacggaaaaactgccccttcgtgttgacttcattcacagggtggagttcggagaggtgtccgggcatcgggttcttatgaagaggcccgatgtctatttagaagtgcaacacccttgttggtcctgtaattctaacagttcgtcggcgaacgcctcggcgggcgtccggtagtccagcacgcgcatggggcggttgttgatctcgtcgacgatctccctgacctcctttgccatgtccatccggatctcgcagcgtttgggcagataccggcggatcatgccgttgcggttctcgttgcttccccgctgccagctggagtacgggtcggcgaagtacgtggccatgcccagcccgtcgcgcagcctttcgtggtgggcgaactcggtgccgttgtcgtgcgtgacgctgacgcgcgcgccggccggcagcggcgagaacatgtccagctgcgccccgacgctctcgccggcggtcttgtccggaacgatgcgggccatgaggaacctggtcctcctctccacctcggtgtgcaggttgcatcccactccgatgacgctgtcggcctcccaatggccgaacgcgctcctgccgtcggcctccggcgggcgttcggagatgggcactcggccgggaatcgggaagcgcgacgtcctcctgccgccgtgcctgcggcgccgcctgtgccctcgcggcaggcaccgcgcccagcgttcccgaagcggcctgctggagtagacccatcggtagatggtctccgggcacacgcgcatgagcgcatcgtccggccacaggacgcgcagcctgccgctgataagcagcggcgaccagccgcggcccagccattcggccacctgcgcccacaggcggtcgtgcgacagccggtagggctttcgtggcttggatctcctgcggtcggccttgcgctgcgcgggcccggcgatgtagtagcggccggtccatggccccgccttcagtcttttcggccggtacgggcggtacgactcgttctcgttggacgggaaccatgtgttgcgcttgatctcccggctgatgctggacgggctgcggcccagcatcgcgccgatcccgcgtatgctggcgccgttgcctacctcgatctggatgacctggcgttcctcttccgacaggtgcgaatatacttctcccataggtgcgacatcccttcggactggttttctaggcaatttccaatctaacgggtgttgcactttcatttagacaacggg
